United States Patent 12,577,609 (METHODS FOR CELL-TYPE SPECIFIC PROFILING TO IDENTIFY DRUG TARGETS) - sequence listing, part 15

SEQ ID NO: 20087 - DNA, 3459 bp, Homo sapiens
  ENST00000240123
cgcgcgcgccccgacggacggagagcactcgcacgtccctcctctccggcccagccccggcccgcagtccagatccgagacccaaactccgcccgccccgccgcgcgactctcacggtccggcctccggcgcgcgccccttcggcctccctcttcctgcgccggcgcccggcccggcccggcccgtcctgacccggtcacgagggccgcgacggcccgcgcttctccttgcccttcctcctcgagcgcccgcgccaggcagcagccgggcagggatgctcctgcgctcccgggcggcctcgggcccagccacctgctcgccggggaagaggacacgcagaggagcagctggcttgcccggagtcctcccaccttgacccaagcatgcagggcccaccccgcagcctccgcgctgggctcagcctggacgacttcatccctggccacctccagtcccacatagggtcttcctcccgggggacacgggtgcccgtgatccggaatggtggctccaacacccttaatttccagttccacgaccccgcgcccaggactgtgtgcaatgggggctacacaccaagacgagatgcttcccagcacccggaccctgcgtggtatcagacctggccaggccctgggagcaagccctctgcaagcacaaagatccctgcctcccagcacacccagaactggtcagccacgtggaccaaggacagcaagcgtcgggacaagcgctgggtcaagtacgagggaatcgggcccgtggacgagagcggcatgcccattgccccccgatccagcgttgacagacccagagactggtaccggagaatgttccagcagattcaccggaaaatgccagacttgcagctggactggaccttcgaggagccacccagagaccccaggcatctaggagcccagcaaagacctgcccacaggcccggcccggcaacatcttccagtggaagaagctgggaccactctgaagagttacctagaagcaccttcaactacagacctggagcattctccactgtgctgcagccctcaaatcaggtgctcagacgccgggaaaaagtagacaatgtctggacggaagagtcctggaaccagtttctgcaggaactagagactgggcagaggcccaagaaaccgctggtggacgaccctggtgagaagccctcccagcccattgaggtgctgctggagagagagctggccgagctgagcgccgagctggacaaggacctgcgggcaattgagacccgactgccgtcccccaagagctcgccggcgccccgacgggccccggagcagcggcccccggccggcccggcctcagcctggagctccagctacccacatgcaccttacctgggttccgcccggtccctgagtccccacaaaatggctgatggaggaagccccttcctaggtcggagggactttgtctacccttcctcaacccgagaccctagtgcctctaacggagggggcagcccagccaggagggaagagaagaagagaaaggccgccaggctcaagtttgacttccaggcgcagtcccccaaggagctgactctgcagaagggtgacattgtctacatccacaaggaggtggacaagaactggctggagggagagcaccacggccgcctgggcatcttccctgctaattatgtggaggtgctgcccgcagatgagatccctaagcccatcaagcccccgacctaccaggtgctggagtatggagaggctgtggcccagtacaccttcaagggggacctggaggtggagctgtccttccgcaagggagagcacatctgcctgatccgcaaggtgaacgagaactggtacgagggacgcatcacgggcacggggcgccaaggcatattccctgccagctacgtgcaggtgtctcgtgaaccccggctccggctctgtgacgacggcccccagctccccacgtctccccgcctgaccgctgccgcccgctcagcccgtcaccccagctccccctcagccctgcgcagcccagctgaccccatcgacttggggggacagacctccccccgtcgcactggcttctccttccccacccaggagcctagaccccagacccagaatcttggcacccctggtccagctctgtcccactctcgaggtcccagccatcccctggacctggggacctcctctcctaacacctctcagatacactggaccccgtaccgggcgatgtaccagtacaggccccagaacgaagacgagctggagctgcgcgagggggacagggtggatgtcatgcagcagtgtgacgatggctggtttgtgggtgtctcccggaggacccagaaattcggaacgttccctggaaattacgttgccccggtgtgagtggtctccatggcaacttggagccagccaggatggggtggggagcggtggcactcgtgggagggagaggacccccgcccacatcctccttccccaggacctgagctcccagcatctgcagacgacccccgcagcctttccctcggacccccctcgaagccccctggactgattcccacccacgactcacaggcattcctcccacagccctttcatttcctccccaccccactccccaaatacagaggtctgctttgaagcggagaccatttccaggccttattgagaccagaccccaagtcccccacccccatcctgctccagcgtttcctctaacagggaccagctctccgctttgcccccacggggttcctctaaccagaaccagcttcctagcctcgtagagaccaaaggccgcccccgcctgctggggttcctcccagcaccccagcttgctggctgccctctttgccttctggcctccagctgggtgtgggggggcggagcaaggcgggggacagacgcagcaccttcttagcgatctaggcctggcaagagctctggccccaaggcctcctcttcccaggggctgccaagtcctggccctggccctggcatatcaccccgcactgtggggccaggcaccactagcctggctcaaatattccccagggagactgctgtgtgctgcccgcctgcctgctggctctcccccagccccacatcccctctggaagagaatgtaaaataaacctggacacaagggaccttgtctctgcggccttttccttggggtaggggatgcctcctcctgtctaggagatgggaattccttctgtggagggctgtgctgggagacaggtgggacaggtgtgtgtgtaagaggaggaggatggaaaaacaccattattacctccaaagatctctgcccttgggtgtcaggcaggttgcggcagcccccacaattgggcagctgtgtggcaagaagtgctgggagaatgaacagtgccaggccctggtagcagggagacaccagagatgggggactgaatgtggcctt

SEQ ID NO: 20088 - DNA, 1228 bp, Homo sapiens
  ENST00000517500
cttcctcctcgagcgcccgcgccaggcagcagccgggcagggatgctcctgcgctcccgggcggcctcgggcccagccacctgctcgccggggaagaggacacgcagaggagcagctggcttgcccggagtcctcccaccttgacccaagcatgcagggcccaccccgcagcctccgcgctgggctcagcctggacgacttcatccctggccacctccagtcccacatagggtcttcctcccgggggacacgggtgcccgtgatccggaatggtggctccaacacccttaatttccagttccacgaccccgcgcccaggactgtgtgcaatgggggctacacaccaagacgagatgcttcccagcacccggaccctgcgtggtatcagacctggccaggccctgggagcaagccctctgcaagcacaaagatccctgcctcccagcacacccagaactggtcagccacgtggaccaaggacagcaagcgtcgggacaagcgctgggtcaagtacgagggaatcgggcccgtggacgagagcggcatgcccattgccccccgatccagcgttgacagacccagagactggtaccggagaatgttccagcagattcaccggaaaatgccagacttgcagctggactggaccttcgaggagccacccagagaccccaggcatctaggagcccagcaaagacctgcccacaggcccggcccggcaacatcttccagtggaagaagctgggaccactctgaagagttacctagaagcaccttcaactacagacctggagcattctccactgtgctgcagccctcaaatcaggtgctcagacgccgggaaaaagtagacaatgtctggacggaagagtcctggaaccagtttctgcaggaactagagactgggcagaggcccaagaaaccgctggtggacgaccctggtgagaagccctcccagcccattgaggtgctgctggagagagagctggccgagctgagcgccgagctggacaaggacctgcgggcaattgagacccgactgccgtcccccaagcccggcctcagcctggagctccagctacccacatgcaccttacctgggttccgcccggtccctgagtccccacaaaatggctgatggaggaagccccttcctaggtcggagggactttgtctacccttcctcaacccgagaccctagtgcctctaacggagggggcagcccagc

SEQ ID NO: 20089 - DNA, 3067 bp, Homo sapiens
  ENST00000517535
attgtgcccctgggagccggcaggcacgggcagcctgcaggcgggtgcctggcgtggcctgtttcctgggtccttgagctagtacccagctggtcctgaccccctcccacagccggcccctcctcccctatcccagggtcgagccaagagggcatgggcagcctagcctagcagggctttcccttccttcctccttccccacagaggacacgcagaggagcagctggcttgcccggagtcctcccaccttgacccaagcatgcagggcccaccccgcagcctccgcgctgggctcagcctggacgacttcatccctggccacctccagtcccacatagggtcttcctcccgggggacacgggtgcccgtgatccggaatggtggctccaacacccttaatttccagttccacgaccccgcgcccaggactgtgtgcaatgggggctacacaccaagacgagatgcttcccagcacccggaccctgcgtggtatcagacctggccaggccctgggagcaagccctctgcaagcacaaagatccctgcctcccagcacacccagaactggtcagccacgtggaccaaggacagcaagcgtcgggacaagcgctgggtcaagtacgagggaatcgggcccgtggacgagagcggcatgcccattgccccccgatccagcgttgacagacccagagactggtaccggagaatgttccagcagattcaccggaaaatgccagacttgcagctggactggaccttcgaggagccacccagagaccccaggcatctaggagcccagcaaagacctgcccacaggcccggcccggcaacatcttccagtggaagaagctgggaccactctgaagagttacctagaagcaccttcaactacagacctggagcattctccactgtgctgcagccctcaaatcaggtgctcagacgccgggaaaaagtagacaatgtctggacggaagagtcctggaaccagtttctgcaggaactagagactgggcagaggcccaagaaaccgctggtggacgaccctggtgagaagccctcccagcccattgaggtgctgctggagagagagctggccgagctgagcgccgagctggacaaggacctgcgggcaattgagacccgactgccgtcccccaagagctcgccggcgccccgacgggccccggagcagcggcccccggccgggtgagtgggagacgcgggaggaggaagggggctgtcccaggccgggcgggagggaacgtggcgcggccgggcggggcggacgggggcgatcgcggggcccagccgggggaggaaggaaccgcagagccgtgtccgggagggaccgcagcgccactctctgcggggcgccgttcccgcgccaccgagggcagctaactcctagcagaggaccggggtcgcggccgccgggggcgcagcgcggttagggcggccccgccacggcccaggcactcccgctgggccctgccgggcctcacccttccccgcgcagcgactcgggaagtaggacatcctgtggagagcccaggacccgggagacgccctgggaggaggtggcagggatgggggcgatggggggtcagagcggtctaggggtgaccagggtggggtgcggagccccaggctggaggctcagtctctgtgccccgtgcagcccggcctcagcctggagctccagctacccacatgcaccttacctgggttccgcccggtccctgagtccccacaaaatggctgatggaggaagccccttcctaggtcggagggactttgtctacccttcctcaacccgagaccctagtgcctctaacggagggggcagcccagccaggagggaagagaagaagagaaaggccgccaggctcaagtttgacttccaggcgcagtcccccaaggagctgactctgcagaagggtgacattgtctacatccacaaggaggtggacaagaactggctggagggagagcaccacggccgcctgggcatcttccctgctaattatgtggaggtgctgcccgcagatgagatccctaagcccatcaagcccccgacctaccaggtgctggagtatggagaggctgtggcccagtacaccttcaagggggacctggaggtggagctgtccttccgcaagggagagcacatctgcctgatccgcaaggtgaacgagaactggtacgagggacgcatcacgggcacggggcgccaaggcatattccctgccagctacgtgcaggtgtctcgtgaaccccggctccggctctgtgacgacggcccccagctccccacgtctccccgcctgaccgctgccgcccgctcagcccgtcaccccagctccccctcagccctgcgcagcccagctgaccccatcgacttggggggacagacctccccccgtcgcactggcttctccttccccacccaggagcctagaccccagacccagaatcttggcacccctggtccagctctgtcccactctcgaggtcccagccatcccctggacctggggacctcctctcctaacacctctcagatacactggaccccgtaccgggcgatgtaccagtacaggccccagaacgaagacgagctggagctgcgcgagggggacagggtggatgtcatgcagcagtgtgacgatggctggtttgtgggtgtctcccggaggacccagaaattcggaacgttccctggaaattacgttgccccggtgtgagtggtctccatggcaacttggagccagccaggatggggtggggagcggtggcactcgtgggagggagaggacccccgcccacatcctccttccccaggacctgagctcccagcatctgcagacgacccccgcagcctttccctcggacccccctcgaagccccctggactgattcccacccacgactcacaggcattcctcccacagccctttcatttcctccccaccccactccccaaatacagaggtctgctttgaagcggagaccatttccaggccttattgagaccagaccccaagtcccccacccccatcctgct

SEQ ID NO: 20090 - DNA, 889 bp, Homo sapiens
  ENST00000523402
gaggacacgcagaggagcagctggcttgcccggagtcctcccaccttgacccaagcatgcagggcccaccccgcagcctccgcgctgggctcagcctggacgacttcatccctggccacctccagtcccacatagggtcttcctcccgggggacacgggtgcccgtgatccggaatggtggctccaacacccttaatttccagttccacgaccccgcgcccaggactgtgtgcaatgggggctacacaccaagacgagatgcttcccagcacccggaccctgcgtggtatcagacctggccaggccctgggagcaagccctctgcaagcacaaagatccctgcctcccagcacacccagaactggtcagccacgtggaccaaggacagcaagcgtcgggacaagcgctgggtcaagtacgagggaatcgggcccgtggacgagagcggcatgcccattgccccccgatccagcgttgacagacccagagactggtaccggagaatgttccagcagattcaccggaaaatgccagacttgcagctggactggaccttcgaggagccacccagaggtgaggggatgcgggcccacctgcctgccatagccctgcgcctgcgtccgcccctccctggggctgggactcgcagccccgcctggctttggggctctccagttggctcagttcaacctgagaggtttttatagctcatttccagagcacttcaaatcccccggtaggtggtaattaacagcctcagcttgcacggggaacgcgcgctctgccactccctggccgggatttctctgggcctccctttcctcatctataagatgagatcatcacctactcggagttgttttgaagatgtagtaaatgtcgtaaagct

SEQ ID NO: 20091 - DNA, 456 bp, Homo sapiens
  ENST00000520563
taatttccagttccacgaccccgcgcccaggactgtgtgcaatgggggctacacaccaagacgagatgcttcccagcacccggaccctgcgtggtatcagacctggccaggccctgggagcaagccctctgcaagcacaaagatccctgcctcccagcacacccagaactggtcagccacgtggaccaaggacagcaagcgtcgggacaagcgctgggtcaagtacgagggaatcgggcccgtggacgagagcggcatgcccattgccccccgatccagcgttgacagacccagagactggtaccggagaatgttccagcagattcaccggaaaatgccagaagaagctgggaccactctgaagagttacctagaagcaccttcaactacagacctggagcattctccactgtgctgcagccctcaaatcaggtgctcagacgccgggaaaaagta

SEQ ID NO: 20092 - DNA, 564 bp, Homo sapiens
  ENST00000524057
actaatgctctcctgcacgcacccaacagaccctgcgtggtatcagacctggccaggccctgggagcaagccctctgcaagcacaaagatccctgcctcccagcacacccagaactggtcagccacgtggaccaaggacagcaagcgtcgggacaagcgctgggtcaagtacgagggaatcgggcccgtggacgagagcggcatgcccattgccccccgatccagcgttgacagacccagagactggtaccggagaatgttccagcagattcaccggaaaatgccagacttgcagctggactggaccttcgaggagccacccagagaccccaggcatctaggagcccagcaaagacctgcccacaggcccggcccggcaacatcttccagtggaagaagctgggaccactctgaagagttacctagaagcaccttcaactacagacctggagcattctccactgtgctgcagccctcaaatcaggtgctcagacgccgggaaaaagtagacaatgtctggacggaagagtcctggaaccagtttctgcaggaactagagactgg

SEQ ID NO: 20093 - DNA, 755 bp, Homo sapiens
  ENST00000518512
gaaattcccaggcaccttgaggagctaggagtgggtcttggcaaatggggaaggaaagcgtttggaagagggtgcaagtcgagtttccccagcctgagtggtgagggcaagtccacaaagacttgcagctggactggaccttcgaggagccacccagaggtgaggggatgcgggcccacctgcctgccatagccctgcgcctgcgtccgcccctccctggggctgggactcgcagccccgcctggctttggggctctccagttggctcagttcaacctgagaggtttttatagctcatttccagagcacttcaaatcccccgaccccaggcatctaggagcccagcaaagacctgcccacaggcccggcccggcaacatcttccagtggaagaagctgggaccactctgaagagttacctagaagcaccttcaactacagacctggagcattctccactgtgctgcagccctcaaatcaggtgctcagacgccgggaaaaagtagacaatgtctggacggaagagtcctggaaccagtttctgcaggaactagagactgggcagaggcccaagaaaccgctggtggacgaccctggtgagaagccctcccagcccattgaggtgctgctggagagagagctggccgagctgagcgccgagctggacaaggacctgcgggcaattgagacccgactgccgtcccccaagagctcgccggcgccccgacgggccccggagcagcggcccccggccgg

SEQ ID NO: 20094 - DNA, 699 bp, Homo sapiens
  ENST00000520574
atcaggaaatattcttggaggtggagctggacccttgagaagctccgagggcctgattcggcgaagacccatagcagaggctggcaggaagcagcgtgggggtgggggctccggtccctggggtggcgggggaacctggatgggcacagtgaagccaggccttggagggcgggagaagatgggagaggaaatggggaaccccattggtgctgtaacagagacacaacttggcagaaactggcaggactgcggaatcgcgggatcaggaagcgcgtaggcactcccggggcgtgctgggcaggtgctgctggagagagagctggccgagctgagcgccgagctggacaaggacctgcgggcaattgagacccgactgccgtcccccaaggtaccagcccccagggttcacccgcggggcacgccggcgaccgcagggtcggggcgagccgggagcctcggcggctgggctgggcggaggacgggcagccgaggtccggcctccagcggcgcgcaccggcctcgggccctcctgggcgctggcgggctcgctcctccataaataaaatacagggcgtcgactttcgcaagtgaccccgaggagcctttctaagcggactccacgtcagcccgacgaccgggcgcccgccccgtccggcccccgggccccagcctcggggacccccgccccttcccctagtt

SEQ ID NO: 20095 - DNA, 561 bp, Homo sapiens
  ENST00000521787
gattcggcgaagacccatagcagaggctggcaggaagcagcgtgggggtgggggctccggtccctggggtggcgggggaacctggatgggcacagtgaagccaggccttggagggcgggagaagatgggagaggaaatggggaaccccattggtgctgtaacagagacacaacttggcagaaactggcaggactgcggaatcgcgggatcaggaagcgcgtaggcactcccggggcgtgctgggcaggtgctgctggagagagagctggccgagctgagcgccgagctggacaaggacctgcgggcaattgagacccgactgccgtcccccaagcccggcctcagcctggagctccagctacccacatgcaccttacctgggttccgcccggtccctgagtccccacaaaatggctgatggaggaagccccttcctaggtcggagggactttgtctacccttcctcaacccgagaccctagtgcctctaacggagggggcagcccagccaggagggaagagaagaagagaaaggccgccaggctcaagtttgacttccagg

SEQ ID NO: 20096 - DNA, 983 bp, Homo sapiens
  ENST00000523740
gtgggggtgggggctccggtccctggggtggcgggggaacctggatgggcacagtgaagccaggccttggagggcgggagaagatgggagaggaaatggggaaccccattggtgctgtaacagagacacaacttggcagaaactggcaggactgcggaatcgcgggatcaggaagcgcgtaggcactcccggggcgtgctgggcaggtgctgctggagagagagctggccgagctgagcgccgagctggacaaggacctgcgggcaattgagacccgactgccgtcccccaagagctcgccggcgccccgacgggccccggagcagcggcccccggccggcccggcctcagcctggagctccagctacccacatgcaccttacctgggttccgcccggtccctgagtccccacaaaatggctgatggaggaagccccttcctaggtcggagggactttgtctacccttcctcaacccgagaccctagtgcctctaacggagggggcagcccagccaggagggaagagaagaagagaaaggccgccaggctcaagtttgacttccaggcgcagtcccccaaggagctgactctgcagaagggtgacattgtctacatccacaaggaggtggacaagaactggctggagggagagcaccacggccgcctgggcatcttccctgctaattatgtggaggtgctgcccgcagatgagatccctaagcccatcaagcccccgacctaccaggtgctggagtatggagaggctgtggcccagtacaccttcaagggggacctggaggtggagctgtccttccgcaagggagagcacatctgcctgatccgcaaggtgaacgagaactggtacgagggacgcatcacgggcacggggcgccaaggcatattccctgccagctacgtgcaggtgtctcgtgaaccccggctccggctctgtgacgacggcccccagctccccacgtctccc

SEQ ID NO: 20097 - DNA, 563 bp, Homo sapiens
  ENST00000522315
actcccggggcgtgctgggcaggtgagaggccgtggcggggatgccctcttggcaccctgggccacacctcctggcaggagcccggcccgtgcgctgaggcctgcccttacgccggcccggtgcgctggccttgcttttcacagtcgatctttgaccgctgcctcccacccccacggtgcgctgcccctcactgcccagcctctccccgcccccaggtgctgctggagagagagctggccgagctgagcgccgagctggacaaggacctgcgggcaattgagacccgactgccgtcccccaagaccctagtgcctctaacggagggggcagcccagccaggagggaagagaagaaggtaaggaggggaccaggtgtgggggacctggagtggtcccaaggctgccatcctggatctgccacccgcccaactgagagagcccactctgtcctctcccctgcctagagaaaggccgccaggctcaagtttgacttccaggcgcagtcccccaaggagctgactctgcagaagggtgacattgtctacatccacaaggaggtggac

SEQ ID NO: 20098 - DNA, 560 bp, Homo sapiens
  ENST00000519453
aggtgctgctggagagagagctggccgagctgagcgccgagctggacaaggacctgcgggcaattgagacccgactgccgtcccccaagagctcgccggcgccccgacgggccccggagcagcggcccccggccggaccctagtgcctctaacggagggggcagcccagccaggagggaagagaagaaggtaaggaggggaccaggtgtgggggacctggagtggtcccaaggctgccatcctggatctgccacccgcccaactgagagagcccactctgtcctctcccctgcctagagaaaggccgccaggctcaagtttgacttccaggcgcagtcccccaaggagctgactctgcagaagggtgacattgtctacatccacaaggaggtggacaagaactggctggagggagagcaccacggccgcctgggcatcttccctgctaattatgtggaggtgctgcccgcagatgagatccctaagcccatcaagcccccgacctaccaggtgctggagtatggagaggctgtggcccagtacaccttcaagggggacct

SEQ ID NO: 20099 - DNA, 670 bp, Homo sapiens
  ENST00000523900
gagctggccgagctgagcgccgagctggacaaggacctgcgggcaattgagacccgactgccgtcccccaagcccggcctcagcctggagctccagctacccacatgcaccttacctgggttccgcccggtccctgagtccccacaaaatggctgatggaggaagccccttcctaggtcggagggactttgtctacccttcctcaacccgagaccctagtgcctctaacggagggggcagcccagccaggagggaagagaagaagagaaaggccgccaggctcaagtttgacttccaggcgcagtcccccaaggagctgactctgcagaagggtgacattgtctacatccacaaggaggtggacaagaactggctggagggagagcaccacggccgcctgggcatcttccctgctaattatgtggaggtgctgcccgcagatgagatccctaagcccatcaagcccccgacctaccaggtgctggagtatggagaggctgtggcccagtacaccttcaagggggacctggaggtggagctgtccttccgcaagggagagcacatctgcctgatccgcaaggtgaacgagaactggtacgagggacgcatcacgggcacggggcgccaaggcatattccctgccagctacgtgcaggtgtctcgtgaaccc

SEQ ID NO: 20100 - DNA, 2028 bp, Homo sapiens
  ENST00000523965
ccgggatcggccgcgcgggcgcctctaggaccccgcgtcccgcccgctctcctcccctcccgagccgcgaacttttccggaggcggcggcctcggctgccgctgggtcccggggtcgcgggccctgattgcgccgtttccccgcgcagagctcgccggcgccccgacgggccccggagcagcggcccccggccggcccggcctcagcctggagctccagctacccacatgcaccttacctgggttccgcccggtccctgagtccccacaaaatggctgatggaggaagccccttcctaggtcggagggactttgtctacccttcctcaacccgagaccctagtgcctctaacggagggggcagcccagccaggagggaagagaagaagagaaaggccgccaggctcaagtttgacttccaggcgcagtcccccaaggagctgactctgcagaagggtgacattgtctacatccacaaggaggtggacaagaactggctggagggagagcaccacggccgcctgggcatcttccctgctaattatgtggaggtgctgcccgcagatgagatccctaagcccatcaagcccccgacctaccaggtgctggagtatggagaggctgtggcccagtacaccttcaagggggacctggaggtggagctgtccttccgcaagggagagcacatctgcctgatccgcaaggtgaacgagaactggtacgagggacgcatcacgggcacggggcgccaaggcatattccctgccagctacgtgcaggtgtctcgtgaaccccggctccggctctgtgacgacggcccccagctccccacgtctccccgcctgaccgctgccgcccgctcagcccgtcaccccagctccccctcagccctgcgcagcccagctgaccccatcgacttggggggacagacctccccccgtcgcactggcttctccttccccacccaggagcctagaccccagacccagaatcttggcacccctggtccagctctgtcccactctcgaggtcccagccatcccctggacctggggacctcctctcctaacacctctcagatacactggaccccgtaccgggcgatgtaccagtacaggccccagaacgaagacgagctggagctgcgcgagggggacagggtggatgtcatgcagcagtgtgacgatggctggtttgtgggtgtctcccggaggacccagaaattcggaacgttccctggaaattacgttgccccggtgtgagtggtctccatggcaacttggagccagccaggatggggtggggagcggtggcactcgtgggagggagaggacccccgcccacatcctccttccccaggacctgagctcccagcatctgcagacgacccccgcagcctttccctcggacccccctcgaagccccctggactgattcccacccacgactcacaggcattcctcccacagccctttcatttcctccccaccccactccccaaatacagaggtctgctttgaagcggagaccatttccaggccttattgagaccagaccccaagtcccccacccccatcctgctccagcgtttcctctaacagggaccagctctccgctttgcccccacggggttcctctaaccagaaccagcttcctagcctcgtagagaccaaaggccgcccccgcctgctggggttcctcccagcaccccagcttgctggctgccctctttgccttctggcctccagctgggtgtgggggggcggagcaaggcgggggacagacgcagcaccttcttagcgatctaggcctggcaagagctctggccccaaggcctcctcttcccaggggctgccaagtcctggccctggccctggcatatcaccccgcactgtggggccaggcaccactagcctggctcaaatattccccagggagactgctgtgtgctgcccgcctgcctgctggctctcccccagccccacatcccctctggaagagaatgtaaaataaacctggacacaaggga

SEQ ID NO: 20101 - DNA, 858 bp, Homo sapiens
  ENST00000521554
tcggctgccgctgggtcccggggtcgcgggccctgattgcgccgtttccccgcgcagagctcgccggcgccccgacgggccccggagcagcggcccccggccggaccctagtgcctctaacggagggggcagcccagccaggagggaagagaagaagagaaaggccgccaggctcaagtttgacttccaggcgcagtcccccaaggagctgactctgcagaagggtgacattgtctacatccacaaggaggtggacaagaactggctggagggagagcaccacggccgcctgggcatcttccctgctaattatgtggaggtgctgcccgcagatgagatccctaagcccatcaagcccccgacctaccaggtgctggagtatggagaggctgtggcccagtacaccttcaagggggacctggaggtggagctgtccttccgcaagggagagcacatctgcctgatccgcaaggtgaacgagaactggtacgagggacgcatcacgggcacggggcgccaaggcatattccctgccagctacgtgcaggtgtctcgtgaaccccggctccggctctgtgacgacggcccccagctccccacgtctccccgcctgaccgctgccgcccgctcagcccgtcaccccagctccccctcagccctgcgcagcccagctgaccccatcgacttggggggacagacctccccccgtcgcactggcttctccttccccacccaggagcctagaccccagacccagaatcttggcacccctggtccagctctgtcccactctcgaggtcccagccatcccctggacctggggacctcctctcctaacacctctcagatacactggac

SEQ ID NO: 20102 - DNA, 601 bp, Homo sapiens
  ENST00000522721
gtgtccgggagggaccgcagcgccactctctgcggggcgccgttcccgcgccaccgagggcagctaactcctagcagaggaccggggtcgcggccgccgggggcgcagcgcggttagggcggccccgccacggcccaggcactcccgctgggccctgccgggcctcacccttccccgcgcagcgactcgggaagtaggacatcctgtggagagcccaggacccgggagacgccctgggaggagcccggcctcagcctggagctccagctacccacatgcaccttacctgggttccgcccggtccctgagtccccacaaaatggctgatggaggaagccccttcctaggtcggagggactttgtctacccttcctcaacccgagaccctagtgcctctaacggagggggcagcccagccaggagggaagagaagaagagaaaggccgccaggctcaagtttgacttccaggcgcagtcccccaaggagctgactctgcagaagggtgacattgtctacatccacaaggaggtggacaagaactggctggagggagagcaccacggccgcctgggcatcttccctgctaattatgtggaggtg

SEQ ID NO: 20103 - DNA, 680 bp, Homo sapiens
  ENST00000523348
gcggtcctcgtccccacctgcagggagctgactctgcagaagggtgacattgtctacatccacaaggaggtggacaagaactggctggagggagagcaccacggccgcctgggcatcttccctgctaattatgtggaggtgctgcccgcagatgagatccctaagcccatcaagcccccgacctaccaggtgctggagtatggagaggctgtggcccagtacaccttcaagggggacctggaggtggagctgtccttccgcaagggagagcacatctgcctgatccgcaaggtgaacgagaactggtacgagggacgcatcacgggcacggggcgccaaggcatattccctgccagctacgtgcaggtgtctcgtgaaccccggctccggctctgtgacgacggcccccagctccccacgtctccccgcctgaccgctgccgcccgctcagcccgtcaccccagctccccctcagccctgcgcagcccagctgaccccatcgacttggggggacagacctccccccgtcgcactggcttctccttccccacccaggagcctagaccccagacccagaatcttggcacccctggtccagctctgtcccactctcgaggtcccagccatcccctggacctggggacctcctctcctaacacctctcagatacactggacccc

SEQ ID NO: 20104 - DNA, 885 bp, Homo sapiens
  ENST00000517962
agaactggtacgagggacgcatcacgggcacggggcgccaaggcatattccctgccagctacgtgcaggtgtctcgtgaaccccggctccggctctgtgacgacggcccccagctccccacgtctccccgcctgaccgctgccgcccgctcagcccgtcaccccagctccccctcagccctgcgcagcccagctgaccccatcgacttggggggacagacctccccccgtcgcactggcttctccttccccacccaggagcctagaccccagacccagaatcttggcacccctggtccagctctgtcccactctcgaggtcccagccatcccctggacctggggacctcctctcctaacacctctcagatacactggaccccgtaccgggcgatgtaccagtacaggccccagaacgaagacgagctggagctgcgcgagggggacagggtggatgtcatgcagcagtgtgacgatggctggtttgtgggtgtctcccggaggacccagaaattcggaacgttccctggaaattacgttgccccggtaggtctgctttgaagcggagaccatttccaggccttattgagaccagaccccaagtcccccacccccatcctgctccagcgtttcctctaacagggaccagctctccgctttgcccccacggggttcctctaaccagaaccagcttcctagcctcgtagagaccaaaggccgcccccgcctgctggggttcctcccagcaccccagcttgctggctgccctctttgccttctggcctccagctgggtgtgggggggcggagcaaggcgggggacagacgcagcaccttcttagcgatctaggcctggcaagagctctggccccaaggcctcctcttcc

SEQ ID NO: 20105 - DNA, 576 bp, Homo sapiens
  ENST00000520207
atccctttcttcctgtcaactcccagaatcttggcacccctggtccagctctgtcccactctcgaggtcccagccatcccctggacctggggacctcctctcctaacacctctcagatacactggaccccgtaccgggcgatgtaccagtacaggccccagaacgaagacgagctggagctgcgcgagggggacagggtggatgtcatgcagcagtgtgacgatggctggtttgtgggtgtctcccggaggacccagaaattcggaacgttccctggaaattacgttgccccggtgtgagtggtctccatggcaacttggagccagccaggatggggtggggagcggtggcactcgtgggagggagaggacccccgcccacatcctccttccccaggacctgagctcccagcatctgcagacgacccccgcagcctttccctcggacccccctcgaagccccctggactgattcccacccacgactcacaggcattcctcccacagccctttcatttcctccccaccccactccccaaatacagaggtctgctttgaagcggagaccatttccagg

SEQ ID NO: 20106 - DNA, 209 bp, Homo sapiens
  ENST00000519127
tatgcagacaagaagaaaaagtaccacttttgtattaggagccacaagcgctttgagaggaatgggcgagacctgtgccctttccggtgtctcccggaggacccagaaattcggaacgttccctggaaattacgttgccccggtgtgagtggtctccatggcaacttggagccagccaggatggggtggggagcggtggcactcgtggg

SEQ ID NO: 20107 - DNA, 5757 bp, Homo sapiens
  ENST00000369701
atcaccctctggacaagagaacgggcgagcgggagctaggagggaagagtggagaggaccggcgaggcgcgccagccggagccacctccttcccggccgccccctccccactccccctacacacacacgctcgctcgctcgccggcgcgcgcacaccccccgcgccggacccgcacctcggcgggcgccacacactcggcagcccgagccgcggtagccgcagcgggatggaggcggcgcgcacggagcgccccgcaggcaggccgggggcgccgcttgtccggacggggctcctactcttgtcgacgtgggtcctggccggcgccgagatcacttgggacgcgacaggcggtcccggacgcccggcggccccggcttcgcggccaccggcgttgtctccactctcgccgcgggcagtggccagccagtggccggaggagctggcgtcggcgcggagagccgccgtgctggggcgccgggccggaccagagctgctgccccagcagggcggcggcagaggcggtgagatgcaggtggaagccggagggacatcaccggcaggcgagcggcggggccggggcatcccagctcctgccaagcttggcggcgcgaggaggagtcgccgggcgcagcccccaatcacccaggaacgcggggacgcctgggccactgctccggccgatggttccagaggaagccgtccccttgctaagggttcccgggaggaggtgaaggcgccgcgggctggggggtcggcggctgaagacctccggctgcccagcacctccttcgcgctgaccggggactcggcccacaaccaagccatggtgcactggtcgggacacaacagcagcgtcatacttatcctgacgaagctgtatgacttcaacctgggcagcgtgactgagagttcactatggaggtcgacagattatggcaccacctatgaaaagctgaatgacaaagtgggtttgaagactgtcctcagttacctctatgtcaatccaaccaacaaaaggaagattatgcttctcagtgatcctgagatggagagcagcatattgatcagctcagacgaaggggcgacctatcagaagtatcggctcaccttctatatccagagcctgctctttcatcccaagcaagaggactgggtgctggcctacagtttggatcaaaagctctacagctccatggactttggaagacggtggcaactcatgcatgaacgcatcacacccaacaggttttattggtcggtggccggattggataaggaggcggacctggtgcacatggaggtgcggaccacggatggatatgctcactacctcacctgcaggatccaggaatgtgccgagacaactagaagtgggccttttgcccgctccattgacatcagttccctggttgtccaggatgaatatatcttcattcaggtaacaactagtggaagagccagctactacgtgtcttatcgaagagaggcctttgctcagataaagctgcctaagtactcgttgccaaaggacatgcacatcatcagtacagacgagaaccaagtatttgctgcggtccaagaatggaaccagaacgacacgtacaacctctacatctcagacacgcgtgggatttacttcactctggccatggagaacatcaagagcagcagaggtctaatggggaacatcattattgaattgtatgaggtagcaggtatcaaagggatatttctggcaaacaagaaggtggacgaccaggtgaagacatacatcacttacaacaaaggcagggattggcgcctgctgcaagctccggatgtggacctgagaggaagcccagtgcactgcctgctgcccttctgttccttacatctgcacctgcaactctctgaaaatccatattcctcaggaagaatctctagcaaggagacagccccaggacttgtggtggctacaggcaacattggcccggagctctcatatactgatattggtgtgttcatctcctccgatgggggcaacacatggagacagatctttgatgaagagtacaatgtctggttcctagactggggtggtgccctcgtggccatgaaacacacacctctgccagtcaggcatttgtgggtgagttttgatgagggccactcttgggacaagtatggtttcacttcggttcctctctttgttgacggggctctggtggaggcaggaatggagacccacatcatgacagtttttggccacttcagcctccgctccgaatggcaattggtgaaagtggactacaaatctatcttcagccggcattgcaccaaggaggactatcagacctggcacctgctcaatcagggagagccttgtgtcatgggagaaaggaaaatattcaagaaacgtaagccaggagctcagtgtgccctgggccgagaccactcaggatcagtggtctcagaaccctgtgtctgtgccaattgggacttcgagtgtgactatgggtatgagagacatggggagagccagtgtgtcccagctttctggtacaatccagcatccccatcaaaggactgcagccttggtcaaagctaccttaacagcactgggtatcggcggattgtgtccaacaactgcacagatgggctaagggagaagtacaccgccaaggcccagatgtgccctggaaaagcccctcggggcctccatgtggtgacgaccgatgggcggctggtggcagagcaggggcacaatgcaactttcatcatcctcatggaggagggtgatctacaaaggacaaacatccagcttgactttggggatgggattgctgtgtcctacgcaaacttcagccccatcgaggacggcatcaagcacgtgtataagagtgcggggatcttccaggtgacagcctatgcagagaacaaccttggctcagacacagctgtcctcttcctgcatgtggtttgtcctgtggagcatgttcatctccgagttccatttgttgccataagaaataaggaggtcaacatcagtgcagtcgtgtggcccagtcaactggggacccttacctatttctggtggttcggcaatagcacaaagcctctcatcactttggacagcagcatttccttcacattccttgcagaaggaaccgacaccatcacagtccaggtggctgctgggaatgccctcatccaggacacaaaagagattgcagttcatgaatatttccagtcccagcttttatcattctctcctaatctggattaccacaatcctgacattcctgagtggagaaaagatattggcaatgtcatcaagcgagctctggttaaagtaaccagtgtcccagaggaccagatcctcattgccgtgtttcctggtctccccacttcagcagagcttttcattcttccacccaagaacctgacagagaggaggaaaggcaatgaaggggacctggaacaaattgtagaaacactgtttaatgctctcaaccaaaatttggtccagtttgagctgaagccgggggtacaagtcattgtgtatgtcacacagctgacgttagctccattggtggactccagtgctgggcacagcagctcagccatgcttatgctattatcagtggtatttgttggcctggctgtgtttttgatctacaagtttaaaaggaaaatcccttggattaacatctatgctcaagtccaacacgacaaggagcaggagatgattgggtcagtgagccaaagtgaaaacgcccccaaaatcacactcagtgactttacggagcctgaggagctgctggacaaagagctggacacgcgggtcataggaggcattgccactattgcaaacagcgaaagcacaaaggagatccccaactgcactagtgtttaataccagcaagccacgtggtcaaccacctttctgactttttatttttgatgattactattactattattatggaaaaattaaaatgtcttttttaccttttgtttaccaagggccccttcataaatagcaggcaaatgcctagctttgggagaaaagggcattcttagctgattgaaatgagacaaagggaataaatggctgtatttgtgctaagagcaaaggatgcatcttcccacagcctcctcgctttactctgccattggtagcttaaagactttctttttccttgtggtctcccttttttcaaaattgaagttgggttggctctttgtgaacctctcatccccacagcagaatcaccaacactctccgcttcccccagcacacacacatacaacacagatcatttcccagttagatccgcaggaagtaggttggtgggggtggatgtagctgcagaaagcatgcacaactttgtgaaagaggccctgccttgtgcatgtccatagtgaggctacagatggcttattgtatataattacaatgtaaatagctttttatttcctaagaaataatttaatgtttagtaaaaaagaaaacagaaaaaagaaagatgcgtgtgttggcttacgcactggccctcagagctgaccaacccgccaggcctgctcaatgcattgggtttggatgctctcctgttgtctgtcacacttaactcttgcatctccttgtccatgccatagctggtttctacttatgtatataaaggggggtggggggaggggcttctctggggcaattgataaaggaaggactctagtgacatcatagaacatggcagtcgtttttgttccaagaatgatatgaaaggtgaagaagaggcccactagaggcttcatactgagacccagatgggggaaaacagcttcctctctaaaaggaaaaacttgatatttatcagtctgagaaaatatttttttctaaagaaggcagtcagtggatcttaaaatgacaatctgtttttaaattggattctatgaaaatgcataatgcttatggtgaattctcaggctattctgagctcagaaaagtcccctgggcactaggtaaagcccagtgaatgtctcttggcatgggaggagttaaagaggttggaagggaagaggcatttgtggaattatgagttcatgcaaaactctccaggccaagtaggggtctagcctttaatgatattagtcaaaggcaattttagcaaagctgtgctatttgcttgtcagatgtacacaacttccttaaagtcaaatgtctgccttcagttcccttaaggtagttcttgcctctggggtgagtggctttcaaagccttttagcttttccagcacctcagccccttcacacatttacacataccaatttttttcaatagggtcacgttaagccatgctgtaagcattgtttttattttcaggcttagcctgagcacacttatttttgaaaatgatataatgtatatatatgggaggaaaggccacattttgtacctgttaatttttgtgggatgttgttcccattcttctttgtgagacagagagaatgtgatatagagaaatctggctggctacagtgtagatcagtattaggaatatttctaaagatcctgcttttttgtttcaagggttaaatggggcagacaattgcaatacttgtactaaacactggaatacaaatgcatgactcatatctatatatacagtatatgtacatatactgttcttggttttattgttccacttgaatatttctactgtaaaaaaaagacagtggttttgaaattgttgaaaataaatgtatttttgtacatc

SEQ ID NO: 20108 - DNA, 458 bp, Homo sapiens
  ENST00000393176
gaaaatccatattcctcaggaagaatctctagcaaggagacagccccaggacttgtggtggctacaggcaacattggcccggagctctcatatactgatattggtgtgttcatctcctccgatgggggcaacacatggagacagatctttgatgaagagtacaatgtctggttcctagactggggtggtgccctcgtggccatgaaacacacacctctgccagtcaggcatttgtgggtgagttttgatgagggccactcttgggacaagtatggtttcacttcggttcctctctttgttgacggggctctggtggaggcaggaatggagacccacatcatgactgactatgggtatgagagacatggggagagccagtgtgtcccagctttctggtacaatccagcatccccatcaaaggactgcagccttggtcaaagctaccttaacagcactgg

SEQ ID NO: 20109 - DNA, 5530 bp, Homo sapiens
  ENST00000369699
atggaggcggcgcgcacggagcgccccgcaggcaggccgggggcgccgcttgtccggacggggctcctactcttgtcgacgtgggtcctggccggcgccgagatcacttgggacgcgacaggcggtcccggacgcccggcggccccggcttcgcggccaccggcgttgtctccactctcgccgcgggcagtggccagccagtggccggaggagctggcgtcggcgcggagagccgccgtgctggggcgccgggccggaccagagctgctgccccagcagggcggcggcagaggcggtgagatgcaggtggaagccggagggacatcaccggcaggcgagcggcggggccggggcatcccagctcctgccaagcttggcggcgcgaggaggagtcgccgggcgcagcccccaatcacccaggaacgcggggacgcctgggccactgctccggccgatggttccagaggaagccgtccccttgctaagggttcccgggaggaggtgaaggcgccgcgggctggggggtcggcggctgaagacctccggctgcccagcacctccttcgcgctgaccggggactcggcccacaaccaagccatggtgcactggtcgggacacaactcctctgtcatacttatcctgacgaagctgtatgacttcaacctgggcagcgtgactgagagttcactatggaggtcgacagattatggcaccacctatgaaaagctgaatgacaaagtgggtttgaagactgtcctcagttacctctatgtcaatccaaccaacaaaaggaagattatgcttctcagtgatcctgagatggagagcagcatattgatcagctcagacgaaggggcgacctatcagaagtatcggctcaccttctatatccagagcctgctctttcatcccaagcaagaggactgggtgctggcctacagtttggatcaaaagctctacagctccatggactttggaagacggtggcaactcatgcatgaacgcatcacacccaacaggttttattggtcggtggccggattggataaggaggcggacctggtgcacatggaggtgcggaccacggatggatatgctcactacctcacctgcaggatccaggaatgtgccgagacaactagaagtgggccttttgcccgctccattgacatcagttccctggttgtccaggatgaatatatcttcattcaggtaacaactagtggaagagccagctactacgtgtcttatcgaagagaggcctttgctcagataaagctgcctaagtactcgttgccaaaggacatgcacatcatcagtacagacgagaaccaagtatttgctgcggtccaagaatggaaccagaacgacacgtacaacctctacatctcagacacgcgtgggatttacttcactctggccatggagaacatcaagagcagcagaggtctaatggggaacatcattattgaattgtatgaggtagcaggtatcaaagggatatttctggcaaacaagaaggtggacgaccaggtgaagacatacatcacttacaacaaaggcagggattggcgcctgctgcaagctccggatgtggacctgagaggaagcccagtgcactgcctgctgcccttctgttccttacatctgcacctgcaactctctgaaaatccatattcctcaggaagaatctctagcaaggagacagccccaggacttgtggtggctacaggcaacattggcccggagctctcatatactgatattggtgtgttcatctcctccgatgggggcaacacatggagacagatctttgatgaagagtacaatgtctggttcctagactggggtggtgccctcgtggccatgaaacacacacctctgccagtcaggcatttgtgggtgagttttgatgagggccactcttgggacaagtatggtttcacttcggttcctctctttgttgacggggctctggtggaggcaggaatggagacccacatcatgacagtttttggccacttcagcctccgctccgaatggcaattggtgaaagtggactacaaatctatcttcagccggcattgcaccaaggaggactatcagacctggcacctgctcaatcagggagagccttgtgtcatgggagaaaggaaaatattcaagaaacgtaagccaggagctcagtgtgccctgggccgagaccactcaggatcagtggtctcagaaccctgtgtctgtgccaattgggacttcgagtgtgactatgggtatgagagacatggggagagccagtgtgtcccagctttctggtacaatccagcatccccatcaaaggactgcagccttggtcaaagctaccttaacagcactgggtatcggcggattgtgtccaacaactgcacagatgggctaagggagaagtacaccgccaaggcccagatgtgccctggaaaagcccctcggggcctccatgtggtgacgaccgatgggcggctggtggcagagcaggggcacaatgcaactttcatcatcctcatggaggagggtgatctacaaaggacaaacatccagcttgactttggggatgggattgctgtgtcctacgcaaacttcagccccatcgaggacggcatcaagcacgtgtataagagtgcggggatcttccaggtgacagcctatgcagagaacaaccttggctcagacacagctgtcctcttcctgcatgtggtttgtcctgtggagcatgttcatctccgagttccatttgttgccataagaaataaggaggtcaacatcagtgcagtcgtgtggcccagtcaactggggacccttacctatttctggtggttcggcaatagcacaaagcctctcatcactttggacagcagcatttccttcacattccttgcagaaggaaccgacaccatcacagtccaggtggctgctgggaatgccctcatccaggacacaaaagagattgcagttcatgaatatttccagtcccagcttttatcattctctcctaatctggattaccacaatcctgacattcctgagtggagaaaagatattggcaatgtcatcaagcgagctctggttaaagtaaccagtgtcccagaggaccagatcctcattgccgtgtttcctggtctccccacttcagcagagcttttcattcttccacccaagaacctgacagagaggaggaaaggcaatgaaggggacctggaacaaattgtagaaacactgtttaatgctctcaaccaaaatttggtccagtttgagctgaagccgggggtacaagtcattgtgtatgtcacacagctgacgttagctccattggtggactccagtgctgggcacagcagctcagccatgcttatgctattatcagtggtatttgttggcctggctgtgtttttgatctacaagtttaaaaggaaaatcccttggattaacatctatgctcaagtccaacacgacaaggagcaggagatgattgggtcagtgagccaaagtgaaaacgcccccaaaatcacactcagtgactttacggagcctgaggagctgctggacaaagagctggacacgcgggtcataggaggcattgccactattgcaaacagcgaaagcacaaaggagatccccaactgcactagtgtttaataccagcaagccacgtggtcaaccacctttctgactttttatttttgatgattactattactattattatggaaaaattaaaatgtcttttttaccttttgtttaccaagggccccttcataaatagcaggcaaatgcctagctttgggagaaaagggcattcttagctgattgaaatgagacaaagggaataaatggctgtatttgtgctaagagcaaaggatgcatcttcccacagcctcctcgctttactctgccattggtagcttaaagactttctttttccttgtggtctcccttttttcaaaattgaagttgggttggctctttgtgaacctctcatccccacagcagaatcaccaacactctccgcttcccccagcacacacacatacaacacagatcatttcccagttagatccgcaggaagtaggttggtgggggtggatgtagctgcagaaagcatgcacaactttgtgaaagaggccctgccttgtgcatgtccatagtgaggctacagatggcttattgtatataattacaatgtaaatagctttttatttcctaagaaataatttaatgtttagtaaaaaagaaaacagaaaaaagaaagatgcgtgtgttggcttacgcactggccctcagagctgaccaacccgccaggcctgctcaatgcattgggtttggatgctctcctgttgtctgtcacacttaactcttgcatctccttgtccatgccatagctggtttctacttatgtatataaaggggggtggggggaggggcttctctggggcaattgataaaggaaggactctagtgacatcatagaacatggcagtcgtttttgttccaagaatgatatgaaaggtgaagaagaggcccactagaggcttcatactgagacccagatgggggaaaacagcttcctctctaaaaggaaaaacttgatatttatcagtctgagaaaatatttttttctaaagaaggcagtcagtggatcttaaaatgacaatctgtttttaaattggattctatgaaaatgcataatgcttatggtgaattctcaggctattctgagctcagaaaagtcccctgggcactaggtaaagcccagtgaatgtctcttggcatgggaggagttaaagaggttggaagggaagaggcatttgtggaattatgagttcatgcaaaactctccaggccaagtaggggtctagcctttaatgatattagtcaaaggcaattttagcaaagctgtgctatttgcttgtcagatgtacacaacttccttaaagtcaaatgtctgccttcagttcccttaaggtagttcttgcctctggggtgagtggctttcaaagccttttagcttttccagcacctcagccccttcacacatttacacataccaatttttttcaatagggtcacgttaagccatgctgtaagcattgtttttattttcaggcttagcctgagcacacttatttttgaaaatgatataatgtatatatatgggaggaaaggccacattttgtacctgttaatttttgtgggatgttgttcccattcttctttgtgagacagagagaatgtgatatagagaaatctggctggctacagtgtagatcagtattaggaatatttctaaagatcctgcttttttgtttcaagggttaaatggggcagacaattgcaatacttgtactaaacactggaatacaaatgcatgactcatatctatatatacagtatatgtacatatactgttcttggttttattgttccacttgaatatttctactgtaaaaaaaagacagtggttttgaaattgttgaaaataaatgtatttttgtacatc

SEQ ID NO: 20110 - DNA, 8517 bp, Homo sapiens
  ENST00000426016
agtagcgagcaggttcagttcgctagtaggaagctccagcgctacaccgccgcccctctccccgcccagaggcgccccgggggcaccatgcaggcgcagcagctgccctacgagtttttcagcgaagagaacgcgcccaagtggcggggactactggtgcctgcgctgaaaaaggtccaggggcaagttcatcctactctcgagtctaatgatgatgctcttcagtatgttgaagaattaattttgcaattattaaatatgctatgccaagctcagccccgaagtgcttcagatgtagaggaacgtgttcaaaaaagtttccctcatccaattgataaatgggcaatagctgatgcccaatcagctattgaaaagaggaagcgaagaaaccctttatctctcccagtagaaaaaattcatcctttattaaaggaggtcctaggttataaaattgaccaccaggtttctgtttacatagtagcagtcttagaatacatttctgcagacattttaaagctggttgggaattatgtaagaaatatacggcattatgaaattacaaaacaagatattaaagtggcaatgtgtgctgacaaggtattgatggatatgtttcatcaagatgtagaagatattaatatattatctttaactgacgaagagccttccacctcaggagaacaaacttactatgatttggtaaaagcatttatggcagaaattcgacaatatataagggaactaaatctaattataaaagtttttagagagccctttgtctccaattcaaaattgttttcagctaatgatgtagaaaatatatttagtcgcatagtagatatacatgaacttagtgtaaagttactgggccatatagaagatacagtagaaatgacagatgaaggcagtccccatccactagtaggaagctgctttgaagacttagcagaggaactggcatttgatccatatgaatcgtatgctcgagatattttgcgacctggttttcatgatcgtttccttagtcagttatcaaagcctggggcagcactttatttgcagtcaataggcgaaggtttcaaagaagctgttcaatatgttttacccaggctgcttctggcccctgtttaccactgtctccattactttgaacttttgaagcagttagaagaaaaaagtgaagatcaagaagacaaggaatgtttaaaacaagcaataacagctttgcttaatgttcagagtggtatggaaaaaatatgttctaaaagtcttgcaaaacgaagactgagtgaatctgcatgtcggttttatagtcagcaaatgaaggggaaacaactagcaatcaagaagatgaacgagattcagaagaatattgatggttgggagggaaaagacattggacagtgttgtaatgaatttataatggaaggaactcttacacgtgtaggagccaaacatgagagacacatatttctctttgatggcttaatgatttgctgtaaatcaaatcatgggcagccaagacttcctggtgctagcaatgcagaatatcgtcttaaagaaaagttttttatgcgaaaggtacaaattaatgataaagatgacaccaatgaatacaagcatgcttttgaaataattttaaaagatgaaaatagtgttatattttctgccaagtcagctgaagagaaaaacaattggatggcagcattgatatctttacagtaccggagtacactggaaaggatgcttgatgtaacaatgctacaggaagagaaagaggagcagatgaggctgcctagtgctgatgtttatagatttgcagagcctgactctgaagagaatattatatttgaagagaacatgcagcccaaggctggaattccaattatcaaagcaggaactgttattaaacttatagagaggcttacgtaccatatgtacgcagatcccaattttgttcggacatttcttacaacatacagatccttttgcaaacctcaagaactactgagtcttataatagaaaggtttgaaattccagagcctgagccaacagaagctgatcgcatagctatagagaatggagatcaacccttgagtgcagaactgaaaagatttagaaaagaatatatacagcctgtgcaactgcgagtattaaatgtatgtcggcactgggtagagcaccacttctatgattttgaaagagatgcatatcttttgcaacgaatggaagaatttattggaacagtaagaggtaaagcaatgaaaaaatgggttgaatccatcactaaaataatccaaaggaaaaaaattgcaagagacaatggaccaggtcataatattacatttcagagttcacctcccacagttgagtggcatataagcagacctgggcacatagagacttttgacctgctcaccttacacccaatagaaattgctcgacaactcactttacttgaatcagatctataccgagctgtacagccatcagaattagttggaagtgtgtggacaaaagaagacaaagaaattaactctcctaatcttctgaaaatgattcgacataccaccaacctcactctgtggtttgagaaatgtattgtagaaactgaaaatttagaagaaagagtagctgtggtgagtcgaattattgagattctacaagtctttcaagagttgaacaactttaatggtgtccttgaggttgtcagtgctatgaattcatcacctgtttacagactagaccacacatttgagcaaataccaagtcgccagaagaaaattttagaagaagctcatgaattgagtgaagatcactataagaaatatttggcaaaactcaggtctattaatccaccatgtgtgcctttctttggaatttatctcactaatatcttgaaaacagaagaaggcaaccctgaggtcctaaaaagacatggaaaagagcttataaactttagcaaaaggaggaaagtagcagaaataacaggagagatccagcagtaccaaaatcagccttactgtttacgagtagaatcagatatcaaaaggttctttgaaaacttgaatccgatgggaaatagcatggagaaggaatttacagattatcttttcaacaaatccctagaaatagaaccacgaaaccctaagcctctcccaagatttccaaaaaaatatagctatcccctaaaatctcctggtgttcgtccatcaaacccaagaccaggtaccatgaggcatcccacacctctgcagcaggagccaaggaaaattagttatagtaggatccctgaaagtgaaacagaaagtacagcatctgcaccaaattctccaagaacaccgttaacacctccgcctgcttctggtgcttccagtaccacagatgtttgcagtgtatttgattccgatcattcgagcccttttcactcaagcaatgataccgtctttatccaagttactctgccccatggcccaagatctgcttctgtatcatctataagtttaaccaaaggcactgatgaagtgcctgtccctcctcctgttcctccacgaagacgaccagaatctgccccagcagaatcttcaccatctaagattatgtctaagcatttggacagtcccccagccattcctcctaggcaacccacatcaaaagcctattcaccacgatattcaatatcagaccggacctctatctcagaccctcctgaaagccctcccttattaccaccacgagaacctgtgaggacacctgatgttttctcaagctcaccactacatctccaacctccccctttgggcaaaaaaagtgaccatggcaatgccttcttcccaaacagcccttccccctttacaccacctcctcctcaaacaccttctcctcacggcacaagaaggcatctgccatcaccaccattgacacaagaagtggaccttcattccattgctgggccgcctgttcctccacgacaaagcacttctcaacatatccctaaactccctccaaaaacttacaaaagggagcacacacacccatccatgcacagagatggaccaccactgttggagaatgcccattcttcctgagttcctctgtactgggatgtatattttcctagccccaaatccattgctggcaatggatgcactgaatgtgccagcactgaggagttaaaatgagaactccaaacactaacgactcttcttcaagatgcagtataagacaatgaattttaacctagatgtaattatacaatggaaatggtattccagtttagaatatggaaagaccgacctagaggaattggacaactgattgcacctgaaaatcataaagggactttttctggccaataggcaggagtcctctttttgtgaagtgatcttttgtgaagtgatcattaaagggatggaaaacacagtctagtgtccagcaggcccacatgacagtttttgtaattcaaattatgcacttttaaaaaaaaaaacttaaacagggatcttaatatcttcctttgttttcctttgctttactcttctactttagaatattttcttaaaaatcactcaaaggactgtgaggaaaggctgtggtacctgaccttgttgaaatcaaggcccggcactgtactacaggcctgtttacagattattacggtgaactgaatgggtaccgaggcttcaccaaagaggtacttttttgttgttgttgttgttttaggaataattgtaccaattttaagagcattccccccacctgtccccacacacccaaacaaaatgtggtggtgttgccttcaaaaaagagaagttttgtgtcattaacatgacagaagaactttttaaaaaaaaataactgtcaactattctatttgcatttaggagactgttcatctatgctagattgtcattttccctccttctcccacagaagtttactggtagtccatgtcatggctcgtagctatccctctaaccataccatggaaatgcaggcacccaatgtgaaaaggagcacttgctgggcatcactgacaccgctcatgttttacacatagttgagtaatcagcatatctagaattatcttgcattgcctaaatcatatgtatatagtgaatgttatataatatacctggcaggtctgttttaatttaattgaataaagatacaaatactttgtttggctggcatatattaaattattatatgaagaaaatggttgattcttatttcttttagttgaaaaacacacaaaaacactaaacataaaagcacgttttgtggtacgccttggtttctagttctggatatatgtattaatcttaaagaatgatctaaagtcacagcttggcatataggaagatacttggttagaataggatgggtatcttttaagcagaactttgtaagtaagttttaagttcctaagcaacaagtatacagtttgttaaggtttatattgaacattctaccttgcttgaggttttctgctttatcaaaactattcataatagaacatctacctgcatcattactatcataatatggattattcataaagcgtatgtactgttcttctgagtctaacaaatactgtgactgaaatgcatgcaccttgttgaagagaaaacattttattaatctccactataatgtctgtgaaatgtgcagtattccatccttagagagtttatctggttcatcagcatctgcatgtatcctctgaataatgaagcaacatttcagcaattctgttaaccacaccattagagacatttttagaagtgctgcaacatggtgggaacctagtactttaataatttcctatgatatttattagagcataaaatgtacatcacgatagtacagtatgtagtcctttaagaccagaaggtatgttaactgcaccatcattaagcagtctatcctattttcttatttatttgttagaattgaatcctttctcaatatctgtaccattcctatgatggtagccattcttctctttataaaatatttcctctttgaaaagcgtcctaaaacattaatttcaaatcccctcttggatgcaaagtgtccctaagaccatccattcaacagtatttatgtgagccaacttactagagccgctacaactaatcatgatagacagtccagaatctccctggactttatactgggccagcctcattgtccctaagatttctctttttatgtctcatggattacttctctttttaattgccccaggcacattccaaatgagaacctggtaaaagtcacattggacccccttcagtatgtcttcggctaatgtgttagccttcaataaggtgataaccccttttcaacctatctagtctataaagaggaaaaattcagatttggagttctaatcctatttctcccaaagggaactattcttctaccccatggttctaggagaccacttcactgtgcaacagttttacatgcattgtggatggaggatatttttattctgaactgttacatttaggtaaaaatattttctgcagtggtaactgattagaaaaatgccaattggatgcccttaggtggaggtgagaaaatggcatccttgccttcttctcaatatgaaacattaactagttgacaaatttatccttgtagtaatgaaaatctatttaatcagggaccagaaatggctgaggagataaatgcatcattacaaaattctgcttttgaatcctggacattacaagggggtaaatgcagcatgactttttgttaaccacattccaaaatgtggaacatttcttttagaaatgaaaatatttcaaggctgatgtattttaagactacacattatcaggaaacatacattgagagttcgcttaattaaaggttgttgggcatcaaattatgtttagtaggttactattctctaacaactcaaggatgctttaatggatctgaatttgacaaagagcatgccacactaatactacagtcaacaacagcccagagaacaattactatgtcagctggaggctatattatgattctaaattcttaaaggtttttttccctccataaatcaaaaattaccttatgtaaaccaaaaattagttggtatttatggtcatgatcttaattctcaagtttagcttaatcttgtatttcattgtttgtcttctaatatgacagcttaaattcagatttttaagtgactcagcaaaataggaggagtgtcccaatttattagtgttgtacatattgaagaaaacctttttgttccttcagatttagaaagaaacagtttaaccatttatttcttggtattctgctgctgtgaataggtttacttattcttttaacatatattgtgtgactacgcaagtataggtcctgttgtattgcattaatctttaccagtaactaaacatcacaaggttaatattggtttggctgaaagaattatgcagtaaagttatttataagggaacatgatgactttattcaatatttttcttctttgaaacatctcattactaacttttaagattatttcataatcccttatacatgagccaatgaaatattttgagctctacttaagaagcatgaagtctatattataaatctaaacaacaaaagcacttgtaacttgtttagtaaattccatgccttattttccatttttgacaccgtaaagtgcattttctgtcgactgtgagcaaatttcccttttgcctttaatgaaaatagtgcattaagtagccaattgctgcagaattataaagcaaattagctaacagtgggtcacattggactaccactcaaagaaacaagatgcataacagatgatggaaggtacatgtggtgtggcttagggagagcgcacctgtgccagatgcatgccactttcagtagctgccaaatgtgcctttaattaagaacatctctaatttttttcttcagatcaagtcagcatttggggtcgggatttgggcagggaactttggggtgcaaatatctggtgaaaccaccagagaatttgtttgtcaaagtgacatgtataattttagttgagacgtgtttgtgtatatatgtgtatttgcctttgtttagtagcacggttatttgctaaaataattgtcaaaaaattgctctgtcggtcggtctttgatgtaagaacaaagtgtggtctatacatctaatatggcctttgtacctaaccatgttcataggtaatctttgtactctgtgtgcagcagtatttggtttgcatttaaagtgaaaataacggctgttatttttctggcattactaagataaactgaaaaataataaagaaaaatgccttacatagcccacaagtgtattatttttgcatgtatttattttagagggcagtatttttgaaatcattagtgattctcatttagctcatatatgccatatagaaatattttgcatttttattgtggtctttctttggaggcacttttttcctgtatcaagttataaaa

SEQ ID NO: 20111 - DNA, 4123 bp, Homo sapiens
  ENST00000395038
ccccgcccagaggcgccccgggggcaccatgcaggcgcagcagctgccctacgagtttttcagcgaagagaacgcgcccaagtggcggggactactggtgcctgcgctgaaaaaggtccaggggcaagttcatcctactctcgagtctaatgatgatgctcttcagtatgttgaagaattaattttgcaattattaaatatgctatgccaagctcagccccgaagtgcttcagatgtagaggaacgtgttcaaaaaagtttccctcatccaattgataaatgggcaatagctgatgcccaatcagctattgaaaagaggaagcgaagaaaccctttatctctcccagtagaaaaaattcatcctttattaaaggaggtcctaggttataaaattgaccaccaggtttctgtttacatagtagcagtcttagaatacatttctgcagacattttaaagctggttgggaattatgtaagaaatatacggcattatgaaattacaaaacaagatattaaagtggcaatgtgtgctgacaaggtattgatggatatgtttcatcaagatgtagaagatattaatatattatctttaactgacgaagagccttccacctcaggagaacaaacttactatgatttggtaaaagcatttatggcagaaattcgacaatatataagggaactaaatctaattataaaagtttttagagagccctttgtctccaattcaaaattgttttcagctaatgatgtagaaaatatatttagtcgcatagtagatatacatgaacttagtgtaaagttactgggccatatagaagatacagtagaaatgacagatgaaggcagtccccatccactagtaggaagctgctttgaagacttagcagaggaactggcatttgatccatatgaatcgtatgctcgagatattttgcgacctggttttcatgatcgtttccttagtcagttatcaaagcctggggcagcactttatttgcagtcaataggcgaaggtttcaaagaagctgttcaatatgttttacccaggctgcttctggcccctgtttaccactgtctccattactttgaacttttgaagcagttagaagaaaaaagtgaagatcaagaagacaaggaatgtttaaaacaagcaataacagctttgcttaatgttcagagtggtatggaaaaaatatgttctaaaagtcttgcaaaacgaagactgagtgaatctgcatgtcggttttatagtcagcaaatgaaggggaaacaactagcaatcaagaagatgaacgagattcagaagaatattgatggttgggagggaaaagacattggacagtgttgtaatgaatttataatggaaggaactcttacacgtgtaggagccaaacatgagagacacatatttctctttgatggcttaatgatttgctgtaaatcaaatcatgggcagccaagacttcctggtgctagcaatgcagaatatcgtcttaaagaaaagttttttatgcgaaaggtacaaattaatgataaagatgacaccaatgaatacaagcatgcttttgaaataattttaaaagatgaaaatagtgttatattttctgccaagtcagctgaagagaaaaacaattggatggcagcattgatatctttacagtaccggagtacactggaaaggatgcttgatgtaacaatgctacaggaagagaaagaggagcagatgaggctgcctagtgctgatgtttatagatttgcagagcctgactctgaagagaatattatatttgaagagaacatgcagcccaaggctggaattccaattatcaaagcaggaactgttattaaacttatagagaggcttacgtaccatatgtacgcagatcccaattttgttcggacatttcttacaacatacagatccttttgcaaacctcaagaactactgagtcttataatagaaaggtttgaaattccagagcctgagccaacagaagctgatcgcatagctatagagaatggagatcaacccttgagtgcagaactgaaaagatttagaaaagaatatatacagcctgtgcaactgcgagtattaaatgtatgtcggcactgggtagagcaccacttctatgattttgaaagagatgcatatcttttgcaacgaatggaagaatttattggaacagtaagaggtaaagcaatgaaaaaatgggttgaatccatcactaaaataatccaaaggaaaaaaattgcaagagacaatggaccaggtcataatattacatttcagagttcacctcccacagttgagtggcatataagcagacctgggcacatagagacttttgacctgctcaccttacacccaatagaaattgctcgacaactcactttacttgaatcagatctataccgagctgtacagccatcagaattagttggaagtgtgtggacaaaagaagacaaagaaattaactctcctaatcttctgaaaatgattcgacataccaccaacctcactctgtggtttgagaaatgtattgtagaaactgaaaatttagaagaaagagtagctgtggtgagtcgaattattgagattctacaagtctttcaagagttgaacaactttaatggtgtccttgaggttgtcagtgctatgaattcatcacctgtttacagactagaccacacatttgagcaaataccaagtcgccagaagaaaattttagaagaagctcatgaattgagtgaagatcactataagaaatatttggcaaaactcaggtctattaatccaccatgtgtgcctttctttggaatttatctcactaatatcttgaaaacagaagaaggcaaccctgaggtcctaaaaagacatggaaaagagcttataaactttagcaaaaggaggaaagtagcagaaataacaggagagatccagcagtaccaaaatcagccttactgtttacgagtagaatcagatatcaaaaggttctttgaaaacttgaatccgatgggaaatagcatggagaaggaatttacagattatcttttcaacaaatccctagaaatagaaccacgaaaccctaagcctctcccaagatttccaaaaaaatatagctatcccctaaaatctcctggtgttcgtccatcaaacccaagaccaggtaccatgaggcatcccacacctctgcagcaggagccaaggaaaattagttatagtaggatccctgaaagtgaaacagaaagtacagcatctgcaccaaattctccaagaacaccgttaacacctccgcctgcttctggtgcttccagtaccacagatgtttgcagtgtatttgattccgatcattcgagcccttttcactcaagatctgcttctgtatcatctataagtttaaccaaaggcactgatgaagtgcctgtccctcctcctgttcctccacgaagacgaccagaatctgccccagcagaatcttcaccatctaagattatgtctaagcatttggacagtcccccagccattcctcctaggcaacccacatcaaaagcctattcaccacgatattcaatatcagaccggacctctatctcagaccctcctgaaagccctcccttattaccaccacgagaacctgtgaggacacctgatgttttctcaagctcaccactacatctccaacctccccctttgggcaaaaaaagtgaccatggcaatgccttcttcccaaacagcccttccccctttacaccacctcctcctcaaacaccttctcctcacggcacaagaaggcatctgccatcaccaccattgacacaagaagtggaccttcattccattgctgggccgcctgttcctccacgacaaagcacttctcaacatatccctaaactccctccaaaaacttacaaaagggagcacacacacccatccatgcacagagatggaccaccactgttggagaatgcccattcttcctgagttcctctgtactgggatgtatattttcctagccccaaatccattgctggcaatggatgcactgaatgtgccagcactgaggagttaaaatgagaactccaaacactaacgactcttcttcaagatgcagtataagac

SEQ ID NO: 20112 - DNA, 523 bp, Homo sapiens
  ENST00000469581
tggtttattgaacagcttttggtatttctacacattacttttaattataagcaatttccagctaagacttttcaaggtaaataaatgaaataaaattcctgtggactttttcttaaaaatttaacatcccacaggatctgcttctgtatcatctataagtttaaccaaaggcactgatgaagtgcctgtccctcctcctgttcctccacgaagacgaccagaatctgccccagcagaatcttcaccatctaagattatgtctaagcatttggacagtcccccagccattcctcctaggcaacccacatcaaaagcctattcaccacgatattcaatatcagaccggacctctatctcagaccctcctgaaagccctcccttattaccaccacgagaacctgtgaggacacctgatgttttctcaagctcaccactacatctccaacctccccctttgggcaaaaaaagtgaccatggcaatgccttcttcccaaacagcccttccccctttacaccacctcct

SEQ ID NO: 20113 - DNA, 672 bp, Homo sapiens
  ENST00000474390
aaagacctccatacattccacaagatagtggcctcaccagttaattctgatgctaatagaggatgcaccaaatatagtaggaaaatgattgtttgactgtaccagtctagaagacgggaaagagcagtatgcctgactggaggcactgccttccttctatcagtcaccctgaatgtgtcttctctatagtagttatactatcgccacccccctactctctacattattttatttactaaattctttaagctataactttattggaaaaactctaaaacctttagttcactttttttttattcccagatgtattgtagaaactgaaaatttagaagaaagagtagctgtggtgagtcgaattattgagattctacaagtctttcaagagttgaacaactttaatggtgtccttgaggttgtcagtgctatgaattcatcacctgtttacagactagaccacacatttgagcaaataccaagtcgccagaagaaaattttagaagaagctcatgaattgagtgaagatcactataagaaatatttggcaaaactcaggtctattaatccaccatgtgtgcctttctttggaatttatctcactaatatcttgaaaacagaagaaggcaaccctgaggtcctaaaaagacatggaaaagagcttataaactttag

SEQ ID NO: 20114 - DNA, 396 bp, Homo sapiens
  ENST00000472480
cattttccttgcatactcccagacaagacctcctgagagtcaactgtgaatctgcatgtcggttttatagtcagcaaatgaaggggaaacaactagcaatcaagaagatgaacgagattcagaagaatattgatggttgggagggaaaagacattggacagtgttgtaatgaatttataatggaaggaactcttacacgtgtaggagccaaacatgagagacacatatttctctttgatggcttaatgatttgctgtaaatcaaatcatgggcagccaagacttcctggtgctagcaatgcagaatatcgtcttaaagaaaagttttttatgcgaaaggtacaaattaatgataaagatgacaccaatgaatacaagcatgcttttgaaataattt

SEQ ID NO: 20115 - DNA, 441 bp, Homo sapiens
  ENST00000461545
attggctcaaaatttgtttaatattataataatacagcctcactgaattaatgtgttttcccccaaacaggatgtagaaaatatatttagtcgcatagtagatatacatgaacttagtgtaaagttactgggccatatagaagatacagtagaaatgacagatgaaggcagtccccatccactagtaggaagctgctttgaagacttagcagaggaactggcatttgatccatatgaatcgtatgctcgagatattttgcgacctggttttcatgatcgtttccttagtcagttatcaaagcctggggcagcactttatttgcagtcaataggcgaaggtttcaaagaagctgttcaatatgttttacccaggctgcttctggcccctgtttaccactgtctccattactttgaacttttgaagcagttagaagaaaaaag

SEQ ID NO: 20116 - DNA, 579 bp, Homo sapiens
  ENST00000451331
aagaagcctctgcgcctgcgccagggcgcacccgtcggcggtaaaagctgaggggctggcgcgggggattggtgggcgacacttttacgtctacacgtgcctacccgtctgcacgtttctgagtccgcacggttgtcttctcttgctgaatggacataggtgttttgttttgtcccaagagatacaggtccaggggcaagttcatcctactctcgagtctaatgatgatgctcttcagtatgttgaagaattaattttgcaattattaaatatgctatgccaagctcagccccgaagtgcttcagatgtagaggaacgtgttcaaaaaagtttccctcatccaattgataaatgggcaatagctgatgcccaatcagctattgaaaagaggaagcgaagaaaccctttatctctcccagtagaaaaaattcatcctttattaaaggaggtcctaggttataaaattgaccaccaggtttctgtttacatagtagcagtcttagaatacatttctgcagacattttaaagctggttgggaattatgtaagaaatatacggcattatgaaattacaaaaca

SEQ ID NO: 20117 - DNA, 8314 bp, Homo sapiens
  ENST00000402219
ccgccgcccctctccccgcccagaggcgccccgggggcaccatgcaggcgcagcagctgccctacgagtttttcagcgaagagaacgcgcccaagtggcggggactactggtgcctgcgctgaaaaaggtccaggggcaagttcatcctactctcgagtctaatgatgatgctcttcagtatgttgaagaattaattttgcaattattaaatatgctatgccaagctcagccccgaagtgcttcagatgtagaggaacgtgttcaaaaaagtttccctcatccaattgataaatgggcaatagctgatgcccaatcagctattgaaaagaggaagcgaagaaaccctttatctctcccagtagaaaaaattcatcctttattaaaggaggtcctaggttataaaattgaccaccaggtttctgtttacatagtagcagtcttagaatacatttctgcagacattttaaagctggttgggaattatgtaagaaatatacggcattatgaaattacaaaacaagatattaaagtggcaatgtgtgctgacaaggtattgatggatatgtttcatcaagatgtagaagatattaatatattatctttaactgacgaagagccttccacctcaggagaacaaacttactatgatttggtaaaagcatttatggcagaaattcgacaatatataagggaactaaatctaattataaaagtttttagagagccctttgtctccaattcaaaattgttttcagctaatgatgtagaaaatatatttagtcgcatagtagatatacatgaacttagtgtaaagttactgggccatatagaagatacagtagaaatgacagatgaaggcagtccccatccactagtaggaagctgctttgaagacttagcagaggaactggcatttgatccatatgaatcgtatgctcgagatattttgcgacctggttttcatgatcgtttccttagtcagttatcaaagcctggggcagcactttatttgcagtcaataggcgaaggtttcaaagaagctgttcaatatgttttacccaggctgcttctggcccctgtttaccactgtctccattactttgaacttttgaagcagttagaagaaaaaagtgaagatcaagaagacaaggaatgtttaaaacaagcaataacagctttgcttaatgttcagagtggtatggaaaaaatatgttctaaaagtcttgcaaaacgaagactgagtgaatctgcatgtcggttttatagtcagcaaatgaaggggaaacaactagcaatcaagaagatgaacgagattcagaagaatattgatggttgggagggaaaagacattggacagtgttgtaatgaatttataatggaaggaactcttacacgtgtaggagccaaacatgagagacacatatttctctttgatggcttaatgatttgctgtaaatcaaatcatgggcagccaagacttcctggtgctagcaatgcagaatatcgtcttaaagaaaagttttttatgcgaaaggtacaaattaatgataaagatgacaccaatgaatacaagcatgcttttgaaataattttaaaagatgaaaatagtgttatattttctgccaagtcagctgaagagaaaaacaattggatggcagcattgatatctttacagtaccggagtacactggaaaggatgcttgatgtaacaatgctacaggaagagaaagaggagcagatgaggctgcctagtgctgatgtttatagatttgcagagcctgactctgaagagaatattatatttgaagagaacatgcagcccaaggctggaattccaattatcaaagcaggaactgttattaaacttatagagaggcttacgtaccatatgtacgcagatcccaattttgttcggacatttcttacaacatacagatccttttgcaaacctcaagaactactgagtcttataatagaaaggtttgaaattccagagcctgagccaacagaagctgatcgcatagctatagagaatggagatcaacccttgagtgcagaactgaaaagatttagaaaagaatatatacagcctgtgcaactgcgagtattaaatgtatgtcggcactgggtagagcaccacttctatgattttgaaagagatgcatatcttttgcaacgaatggaagaatttattggaacagtaagaggtaaagcaatgaaaaaatgggttgaatccatcactaaaataatccaaaggaaaaaaattgcaagagacaatggaccaggtcataatattacatttcagagttcacctcccacagttgagtggcatataagcagacctgggcacatagagacttttgacctgctcaccttacacccaatagaaattgctcgacaactcactttacttgaatcagatctataccgagctgtacagccatcagaattagttggaagtgtgtggacaaaagaagacaaagaaattaactctcctaatcttctgaaaatgattcgacataccaccaacctcactctgtggtttgagaaatgtattgtagaaactgaaaatttagaagaaagagtagctgtggtgagtcgaattattgagattctacaagtctttcaagagttgaacaactttaatggtgtccttgaggttgtcagtgctatgaattcatcacctgtttacagactagaccacacatttgagcaaataccaagtcgccagaagaaaattttagaagaagctcatgaattgagtgaagatcactataagaaatatttggcaaaactcaggtctattaatccaccatgtgtgcctttctttggaatttatctcactaatatcttgaaaacagaagaaggcaaccctgaggtcctaaaaagacatggaaaagagcttataaactttagcaaaaggaggaaagtagcagaaataacaggagagatccagcagtaccaaaatcagccttactgtttacgagtagaatcagatatcaaaaggttctttgaaaacttgaatccgatgggaaatagcatggagaaggaatttacagattatcttttcaacaaatccctagaaatagaaccacgaaaccctaagcctctcccaagatttccaaaaaaatatagctatcccctaaaatctcctggtgttcgtccatcaaacccaagaccaggtaccatgaggcatcccacacctctgcagcaggagccaaggaaaattagttatagtaggatccctgaaagtgaaacagaaagtacagcatctgcaccaaattctccaagaacaccgttaacacctccgcctgcttctggtgcttccagtaccacagatgtttgcagtgtatttgattccgatcattcgagcccttttcactcaagcaatgataccgtctttatccaagttactctgccccatggcccaagatctgcttctgtatcatctataagtttaaccaaaggcactgatgaagtgcctgtccctcctcctgttcctccacgaagacgaccagaatctgccccagcagaatcttcaccatctaagattatgtctaagcatttggacagtcccccagccattcctcctaggcaacccacatcaaaagcctattcaccacgatattcaatatcagaccggacctctatctcagaccctcctgaaagccctcccttattaccaccacgagaacctgtgaggacacctgatgttttctcaagctcaccactacatctccaacctccccctttgggcaaaaaaagtgaccatggcaatgccttcttcccaaacagcccttccccctttacaccacctcctcctcaaacaccttctcctcacggcacaagaaggcatctgccatcaccaccattgacacaagaagtggaccttcattccattgctgggccgcctgttcctccacgacaaagcacttctcaacatatccctaaactccctccaaaaacttacaaaagggagcacacacacccatccatgcacagagatggaccaccactgttggagaatgcccattcttcctgagttcctctgtactgggatgtatattttcctagccccaaatccattgctggcaatggatgcactgaatgtgccagcactgaggagttaaaatgagaactccaaacactaacgactcttcttcaagatgcagtataagacaatgaattttaacctagatgtaattatacaatggaaatggtattccagtttagaatatggaaagaccgacctagaggaattggacaactgattgcacctgaaaatcataaagggactttttctggccaataggcaggagtcctctttttgtgaagtgatcttttgtgaagtgatcattaaagggatggaaaacacagtctagtgtccagcaggcccacatgacagtttttgtaattcaaattatgcacttttaaaaaaaaaaacttaaacagggatcttaatatcttcctttgttttcctttgctttactcttctactttagaatattttcttaaaaatcactcaaaggactgtgaggaaaggctgtggtacctgaccttgttgaaatcaaggcccggcactgtactacaggcctgtttacagattattacggtgaactgaatgggtaccgaggcttcaccaaagaggtacttttttgttgttgttgttgttttaggaataattgtaccaattttaagagcattccccccacctgtccccacacacccaaacaaaatgtggtggtgttgccttcaaaaaagagaagttttgtgtcattaacatgacagaagaactttttaaaaaaaaataactgtcaactattctatttgcatttaggagactgttcatctatgctagattgtcattttccctccttctcccacagaagtttactggtagtccatgtcatggctcgtagctatccctctaaccataccatggaaatgcaggcacccaatgtgaaaaggagcacttgctgggcatcactgacaccgctcatgttttacacatagttgagtaatcagcatatctagaattatcttgcattgcctaaatcatatgtatatagtgaatgttatataatatacctggcaggtctgttttaatttaattgaataaagatacaaatactttgtttggctggcatatattaaattattatatgaagaaaatggttgattcttatttcttttagttgaaaaacacacaaaaacactaaacataaaagcacgttttgtggtacgccttggtttctagttctggatatatgtattaatcttaaagaatgatctaaagtcacagcttggcatataggaagatacttggttagaataggatgggtatcttttaagcagaactttgtaagtaagttttaagttcctaagcaacaagtatacagtttgttaaggtttatattgaacattctaccttgcttgaggttttctgctttatcaaaactattcataatagaacatctacctgcatcattactatcataatatggattattcataaagcgtatgtactgttcttctgagtctaacaaatactgtgactgaaatgcatgcaccttgttgaagagaaaacattttattaatctccactataatgtctgtgaaatgtgcagtattccatccttagagagtttatctggttcatcagcatctgcatgtatcctctgaataatgaagcaacatttcagcaattctgttaaccacaccattagagacatttttagaagtgctgcaacatggtgggaacctagtactttaataatttcctatgatatttattagagcataaaatgtacatcacgatagtacagtatgtagtcctttaagaccagaaggtatgttaactgcaccatcattaagcagtctatcctattttcttatttatttgttagaattgaatcctttctcaatatctgtaccattcctatgatggtagccattcttctctttataaaatatttcctctttgaaaagcgtcctaaaacattaatttcaaatcccctcttggatgcaaagtgtccctaagaccatccattcaacagtatttatgtgagccaacttactagagccgctacaactaatcatgatagacagtccagaatctccctggactttatactgggccagcctcattgtccctaagatttctctttttatgtctcatggattacttctctttttaattgccccaggcacattccaaatgagaacctggtaaaagtcacattggacccccttcagtatgtcttcggctaatgtgttagccttcaataaggtgataaccccttttcaacctatctagtctataaagaggaaaaattcagatttggagttctaatcctatttctcccaaagggaactattcttctaccccatggttctaggagaccacttcactgtgcaacagttttacatgcattgtggatggaggatatttttattctgaactgttacatttaggtaaaaatattttctgcagtggtaactgattagaaaaatgccaattggatgcccttaggtggaggtgagaaaatggcatccttgccttcttctcaatatgaaacattaactagttgacaaatttatccttgtagtaatgaaaatctatttaatcagggaccagaaatggctgaggagataaatgcatcattacaaaattctgcttttgaatcctggacattacaagggggtaaatgcagcatgactttttgttaaccacattccaaaatgtggaacatttcttttagaaatgaaaatatttcaaggctgatgtattttaagactacacattatcaggaaacatacattgagagttcgcttaattaaaggttgttgggcatcaaattatgtttagtaggttactattctctaacaactcaaggatgctttaatggatctgaatttgacaaagagcatgccacactaatactacagtcaacaacagcccagagaacaattactatgtcagctggaggctatattatgattctaaattcttaaaggtttttttccctccataaatcaaaaattaccttatgtaaaccaaaaattagttggtatttatggtcatgatcttaattctcaagtttagcttaatcttgtatttcattgtttgtcttctaatatgacagcttaaattcagatttttaagtgactcagcaaaataggaggagtgtcccaatttattagtgttgtacatattgaagaaaacctttttgttccttcagatttagaaagaaacagtttaaccatttatttcttggtattctgctgctgtgaataggtttacttattcttttaacatatattgtgtgactacgcaagtataggtcctgttgtattgcattaatctttaccagtaactaaacatcacaaggttaatattggtttggctgaaagaattatgcagtaaagttatttataagggaacatgatgactttattcaatatttttcttctttgaaacatctcattactaacttttaagattatttcataatcccttatacatgagccaatgaaatattttgagctctacttaagaagcatgaagtctatattataaatctaaacaacaaaagcacttgtaacttgtttagtaaattccatgccttattttccatttttgacaccgtaaagtgcattttctgtcgactgtgagcaaatttcccttttgcctttaatgaaaatagtgcattaagtagccaattgctgcagaattataaagcaaattagctaacagtgggtcacattggactaccactcaaagaaacaagatgcataacagatgatggaaggtacatgtggtgtggcttagggagagcgcacctgtgccagatgcatgccactttcagtagctgccaaatgtgcctttaattaagaacatctctaatttttttcttcagatcaagtcagcatttggggtcgggatttgggcagggaactttggggtgcaaatatctggtgaaaccaccagagaatttgtttgtcaaagtgacatgtataattttagttgagacgtgtttgtgtatatatgtgtatttgcctttgtttagtagcacggttatttgctaaaataattgtcaaaaaattgctctgtcggtcggtctttgatgtaagaacaaagtgtggtctatacatctaatatggcctttgtacctaaccatgttcataggtaatctttgtactctgtgtgcagcagtatttggtttgcatttaaagtgaaaataacggctgttatttttctggcattactaagataaactgaaaaataataaagaaaaatgccttacatagccc

SEQ ID NO: 20118 - DNA, 873 bp, Homo sapiens
  ENST00000427770
ccgaggaggtgagtgcgcagcctgctcctccctggcccgcccaggcctgggaccctgctgtgaggtggagagaggcgacaccccgcccttgccccccacctggctctcctctaaaccccgttggggcaggctgagggaagaaggaaaggtgggcgttggactctttgcgaggaccccggcggctggcccgggggaggcggccgaggcggcggcggcggcggccgggggcgacatggcggaggagcaggacctatcggaggtggagctgagccccgtgggctcggaggagccccgctgcctgtccccggggagcgcgccctcgctagggcccgacggcggcggcggcggatcgggcctgcgagccagcccggggccaggcgagctgggcaaggtcaagaaggagcagcaggacggcgaggcggacgatgacaagttccccgtgtgcatccgcgaggccgtcagccaggtgctcagcggctacgactggacgctggtgcccatgcccgtgcgcgtcaacggcgccagcaaaagcaagccgcacgtcaagcggcccatgaacgccttcatggtgtgggctcaggcagcgcgcaggaagctcgcggaccagtacccgcacctgcacaacgctgagctcagcaagacgctgggcaagctctggaggctgctgaacgaaagtgacaagcgccccttcatcgaggaggctgagcggctccgtatgcagcacaagaaagaccacccggactacaagtaccagcccaggcggcggaagaacgggaaggccgcccagggcgaggcggagtgccccggtggggaggccgagcaaggtgggaccgccgccatccaggcccactacaagagcgcccacttggacca

SEQ ID NO: 20119 - DNA, 124 bp, Homo sapiens
  ENST00000470555
ccgcacaccttgggacacggttttccacttcctaaggacgagccccagactggaggagaggtccgaggaggctgctgaacgaaagtgacaagcgccccttcatcgaggaggctgagcggctccg

SEQ ID NO: 20120 - DNA, 2861 bp, Homo sapiens
  ENST00000360880
ggggggtgaagggtcactgctgaccggaggcagctctgccaggcagtgtcatcagtgggcttcacgtttgactgacagcccaccagcgtcacctcccagccccgagctggaccgcacaccttgggacacggttttccacttcctaaggacgagccccagactggaggagaggtccgaggaggtgggcgttggactctttgcgaggaccccggcggctggcccgggggaggcggccgaggcggcggcggcggcggccgggggcgacatggcggaggagcaggacctatcggaggtggagctgagccccgtgggctcggaggagccccgctgcctgtccccggggagcgcgccctcgctagggcccgacggcggcggcggcggatcgggcctgcgagccagcccggggccaggcgagctgggcaaggtcaagaaggagcagcaggacggcgaggcggacgatgacaagttccccgtgtgcatccgcgaggccgtcagccaggtgctcagcggctacgactggacgctggtgcccatgcccgtgcgcgtcaacggcgccagcaaaagcaagccgcacgtcaagcggcccatgaacgccttcatggtgtgggctcaggcagcgcgcaggaagctcgcggaccagtacccgcacctgcacaacgctgagctcagcaagacgctgggcaagctctggaggctgctgaacgaaagtgacaagcgccccttcatcgaggaggctgagcggctccgtatgcagcacaagaaagaccacccggactacaagtaccagcccaggcggcggaagaacgggaaggccgcccagggcgaggcggagtgccccggtggggaggccgagcaaggtgggaccgccgccatccaggcccactacaagagcgcccacttggaccaccggcacccaggagagggctcccccatgtcagatgggaaccccgagcacccctcaggccagagccatggcccacccacccctccaaccaccccgaagacagagctgcagtcgggcaaggcagacccgaagcgggacgggcgctccatgggggagggcgggaagcctcacatcgacttcggcaacgtggacattggtgagatcagccacgaggtaatgtccaacatggagacctttgatgtggctgagttggaccagtacctgccgcccaatgggcacccaggccatgtgagcagctactcagcagccggctatgggctgggcagtgccctggccgtggccagtggacactccgcctggatctccaagccaccaggcgtggctctgcccacggtctcaccacctggtgtggatgccaaagcccaggtgaagacagagaccgcggggccccaggggcccccacactacaccgaccagccatccacctcacagatcgcctacacctccctcagcctgccccactatggctcagccttcccctccatctcccgcccccagtttgactactctgaccatcagccctcaggaccctattatggccactcgggccaggcctctggcctctactcggccttctcctatatggggccctcgcagcggcccctctacacggccatctctgaccccagcccctcagggccccagtcccacagccccacacactgggagcagccagtatatacgacactgtcccggccctaaagggggccctgtcgccaccaccccccgcccagcccctgcccccagcctgtgtgccctgttccttgcccacctcaggcctggtggtggcagtggaggaggctgaggaggctgaagaggctgacaggtcggggggctttctgtctggctcactgccctgatgacccacccgccccatccaggctccagcagcaaagccccaggagaacaggctggacagaggagaaggaggttgactgttgcacccacactgaaagatgaggggctgcaccttcccccaggaatgaccctctatcccaggacctgagaagggcctgctcaccctcctcggggaggggaagcaccagggttggtggcatcggaggccttaccactcctatgactcctgttttctctctcacagatagtgagggtctgacatgcccatgccacctatgccacagtgcctaagggctaggccacccagagactgtgcccggagctggccgtgtctcccactcaggggctgagagtagctttgaggagcctcattggggagtggggggttcgagggacttagtggagttctcatcccttcaatgccccctccctttctgaaggcaggaaggagttggcacagaggccccctgatccaattctgtgccaataacctcattctttgtctgagaaacagcccccagtcctcctccactacaacctccatgaccttgagacgcatcccaggaggtgacgaggcaggggctccaggaaaggaatcagagacaattcacagagcctccctccctgggctccttgccagctccctcttcccttactaggctctatggcccctgctcagtcagccccactccctgggcttcccagagagtgacagctgctcaggccctaacccttggctccaggagacacagggcccagcacccaggttgctgtcggcaggctgaagacactagaatcctgacctgtacattctgcccttgcctcttaccccttgcctcccagtggtatttgaataaagtatgtagctatatctgcccctattttcctgttctgcagccccccaaatccacatgtaactcattactgtctcctgttatttatctcagtagtcccctctcctagccactctagcccctattaactctgcattaagcattccacataataaaattaaaggttccggttacctgcttggtga

SEQ ID NO: 20121 - DNA, 1095 bp, Homo sapiens
  ENST00000446929
accagtacccgcacctgcacaacgctgagctcagcaagacgctgggcaagctctggaggctgctgaacgaaagtgacaagcgccccttcatcgaggaggctgagcggctccgtatgcagcacaagaaagaccacccggactacaagtaccagcccaggcggcggaagaacgggaaggccgcccagggcgaggcggagtgccccggtggggaggccgagcaaggtgggaccgccgccatccaggcccactacaagagcgcccacttggaccaccggcacccaggagagggctcccccatgtcagatgggaaccccgagcacccctcaggccagagccatggcccacccacccctccaaccaccccgaagacagagctgcagtcgggcaaggcagacccgaagcgggacgggcgctccatgggggagggcgggaagcctcacatcgacttcggcaacgtggacattggtgagatcagccacgagatggggaaactgaagtttgcgaggctgatgctaagaagtgctggtgccagaatctgaacccagctctgactccaaggcttgcatttttaaccatcatcccctccacctgcctgtggtttgcagcccctgcttctgctttgtatctggagcaatgcatcttccactgctccagactgggcatcctcagctcccttccttccatctgcggtctccagcccctagtcaggaccaggggagaggcagggcaccaagaagtagcccagtccccagggtggccaaaatccctccatctaggacctgcatcatggaagctcttcaagcaacctccccaaaactgctggttcccgtgaagctggatggtaaccgaaaccccgatcttttagacaatatccattgcaaagtcatatccaaattgtatgtatgctgtttttgttttgttttagataaaagcaggactttacactgatctttaacagatctcaccttgttgggtttgacccatttccccacctgtattaaactttttagaacttagctctcctttagagctttatgtatctgcaaacttgaatagcctcattcaagtcactaataaaggtcgaaatgaagaggg

SEQ ID NO: 20122 - DNA, 2879 bp, Homo sapiens
  ENST00000396884
gggctgtccggccagggtggttggtggtaaggattcaggctccgtcctaacgaggccgtggcctgaggctcagggccccccgcccctccctcccagcccaccagcgtcacctcccagccccgagctggaccgcacaccttgggacacggttttccacttcctaaggacgagccccagactggaggagaggtccgaggaggtgggcgttggactctttgcgaggaccccggcggctggcccgggggaggcggccgaggcggcggcggcggcggccgggggcgacatggcggaggagcaggacctatcggaggtggagctgagccccgtgggctcggaggagccccgctgcctgtccccggggagcgcgccctcgctagggcccgacggcggcggcggcggatcgggcctgcgagccagcccggggccaggcgagctgggcaaggtcaagaaggagcagcaggacggcgaggcggacgatgacaagttccccgtgtgcatccgcgaggccgtcagccaggtgctcagcggctacgactggacgctggtgcccatgcccgtgcgcgtcaacggcgccagcaaaagcaagccgcacgtcaagcggcccatgaacgccttcatggtgtgggctcaggcagcgcgcaggaagctcgcggaccagtacccgcacctgcacaacgctgagctcagcaagacgctgggcaagctctggaggctgctgaacgaaagtgacaagcgccccttcatcgaggaggctgagcggctccgtatgcagcacaagaaagaccacccggactacaagtaccagcccaggcggcggaagaacgggaaggccgcccagggcgaggcggagtgccccggtggggaggccgagcaaggtgggaccgccgccatccaggcccactacaagagcgcccacttggaccaccggcacccaggagagggctcccccatgtcagatgggaaccccgagcacccctcaggccagagccatggcccacccacccctccaaccaccccgaagacagagctgcagtcgggcaaggcagacccgaagcgggacgggcgctccatgggggagggcgggaagcctcacatcgacttcggcaacgtggacattggtgagatcagccacgaggtaatgtccaacatggagacctttgatgtggctgagttggaccagtacctgccgcccaatgggcacccaggccatgtgagcagctactcagcagccggctatgggctgggcagtgccctggccgtggccagtggacactccgcctggatctccaagccaccaggcgtggctctgcccacggtctcaccacctggtgtggatgccaaagcccaggtgaagacagagaccgcggggccccaggggcccccacactacaccgaccagccatccacctcacagatcgcctacacctccctcagcctgccccactatggctcagccttcccctccatctcccgcccccagtttgactactctgaccatcagccctcaggaccctattatggccactcgggccaggcctctggcctctactcggccttctcctatatggggccctcgcagcggcccctctacacggccatctctgaccccagcccctcagggccccagtcccacagccccacacactgggagcagccagtatatacgacactgtcccggccctaaagggggccctgtcgccaccaccccccgcccagcccctgcccccagcctgtgtgccctgttccttgcccacctcaggcctggtggtggcagtggaggaggctgaggaggctgaagaggctgacaggtcggggggctttctgtctggctcactgccctgatgacccacccgccccatccaggctccagcagcaaagccccaggagaacaggctggacagaggagaaggaggttgactgttgcacccacactgaaagatgaggggctgcaccttcccccaggaatgaccctctatcccaggacctgagaagggcctgctcaccctcctcggggaggggaagcaccagggttggtggcatcggaggccttaccactcctatgactcctgttttctctctcacagatagtgagggtctgacatgcccatgccacctatgccacagtgcctaagggctaggccacccagagactgtgcccggagctggccgtgtctcccactcaggggctgagagtagctttgaggagcctcattggggagtggggggttcgagggacttagtggagttctcatcccttcaatgccccctccctttctgaaggcaggaaggagttggcacagaggccccctgatccaattctgtgccaataacctcattctttgtctgagaaacagcccccagtcctcctccactacaacctccatgaccttgagacgcatcccaggaggtgacgaggcaggggctccaggaaaggaatcagagacaattcacagagcctccctccctgggctccttgccagctccctcttcccttactaggctctatggcccctgctcagtcagccccactccctgggcttcccagagagtgacagctgctcaggccctaacccttggctccaggagacacagggcccagcacccaggttgctgtcggcaggctgaagacactagaatcctgacctgtacattctgcccttgcctcttaccccttgcctcccagtggtatttgaataaagtatgtagctatatctgcccctattttcctgttctgcagccccccaaatccacatgtaactcattactgtctcctgttatttatctcagtagtcccctctcctagccactctagcccctattaactctgcattaagcattccacataataaaattaaaggttccggttacctgcttggtga

SEQ ID NO: 20123 - DNA, 3525 bp, Homo sapiens
  ENST00000367203
agtcgcctcgcagcagcgagccgcgagcgcccttctccagtcccggcttggaactgaactgtgtgagcacgggtcctggaacccgggcccagaaccggcgagcccaggtctgagcccagagctcagcggtcagcctcgtaggccctgactcggaatcgagccgaggcgctgaggttggagccggagagcgtgagagccgaagagcagggagggcgggccggctgcgcgtccgacgagtcgcagagcaggaccgcggaaggcagggagacggccgcaagcccagggcagagggcagagggcagagagcggcctggctcggcggagagggcgccgcccggccggaaccaagctcgccgcccgggacggcgggccccgtggggcgcggacccagggtggccgtgggtccgcagcgactccccggccgacggcggggggcgtgccccctcccagcccagcctccccaacccggcccgcccgccgcgtcgcgggggcatgtgagcgggaagcctaggctgccagccgcgaggaccgcacggaggaggagcaggagcgcggagccgcgagccccgagccccgagcccggcgcctggctgagtagatgtccatgaggagccccatctctgcccagctggccctggatggcgttggcaccatggtgaactgcaccatcaagtcagaggagaagaaagagccttgccacgaggccccccagggctcagccactgccgctgaacctcagcctggagacccagcccgggcctcccaggatagtgctgacccccaagctccagcccaggggaatttcaggggctcctgggactgtagctctccagagggtaatgggtccccagaacccaagagaccaggagtgtcggaggctgcctctggaagccaggagaagctggacttcaaccgaaatttgaaagaagtggtgccagccatagagaagctgttgtccagtgactggaaggagaggtttctaggaaggaactctatggaagccaaagatgtcaaagggacccaagagagcctagcagagaaggagctccagcttctggtcatgattcaccagctgtccaccctgcgggaccagctcctgacagcccactcggagcagaagaacatggctgccatgctgtttgagaagcagcagcagcagatggagcttgcccggcagcagcaggagcagattgcaaagcagcagcagcagctgattcagcagcagcataagatcaacctccttcagcagcagatccagcaggttaacatgccttatgtcatgatcccagccttccccccaagccaccaacctctgcctgtcacccctgactcccagctggccttacccattcagcccattccctgcaaaccaggtgagtgtgagaagggaggttccaccactgcggccagcctgtcctgaggtcagggaaagcgccctggagccactctcatccattaatttgctatgtggactttctgggcctcagttttggatctgtctggtagaagaatcatcctctttttctgaatcttgctgaatttctctgaacttcactgggagaatgaaaaaccataaagccctttccagatgtaaaatgatgtagcaatccaggtctagtctctccaactctagtacatttactgtgtcagagtattaatatctggaatattgccaggtgtggtggctcacgcatgtaatcccagcactttgggaggccgaagtgggtggatcacttgaggtcaggaattcgaggccagcctggccaacatggtgaaaccccatctttactaaaaatacaaaaattagctgggtgtggtggtgcatgcctgtagtcccagctactcagaagactgaggcaggagaatcgcttgaacctgggaggtggaggttgcagtgagctgagatcatgccactgcactccagcctaggtgacagagcgagactccatttcaaaaaaaaaaaaaaaatctggaatattaactgggttttacaaatctcccaaattcttttttgtttgtttgtgttttgtgttttgagacagagtcttacttgttctgtcacctgggctctggagtgcagtggtgtaatctcagctcactgctgcagcctccacctcccatgttcaagcgattctcctgcctcagcctcctgagtagctggaattgcaggtgcacaccaccatacctggctaatttttgtatttttagtagagacgaaatttcgccgcgttgcccaggctggtctcctgaccgcaagtgatcctcccgcctcagcctcccaaaatgctgggattacaggcgtgagccaacatctcccaaattctaacagccacgattcctaccttcacactcttgtccctgcctacaccatgtcactctggccttctaccccatcactgaaattcagcagaatggccatgtgtcagacaagggtgtgggacctgacggtacagggcagttggggagggagcatggagtctgggatttattttgtaggctgtggggtgcatgtgaacatttgagaagtgagtgtgtcgttctggctttgaggggtggggagtggaggggagactggccagaagcaggacctgctaggtgattctagcagcaggggatgatacctgaactagggcagtgacagagagttatggggacagggcagagatgctgcccataattaccccaggagtgtggacagctttaaaggcaacacgtgctagatcatcctccctgttccacaggcgagaaagagagagagaagaggaaattccctgaggcctataggccatgggcttgggtagactgctcagccccactggctctctgctcctgcctggtttgtgccgggcactgtagggtggtgtgaaggggaaacacaaaggactgagaaagccaggccccatcttcatccattcaggggctgtagaaagacaccatggaccgtgtggctcataaacaacagatgttattcctcacatacagttctgggggctgtgaattccaagatcataaagccagcatatttggtgtctggtgagggctgactttctggttcacagatggcgtctctcactgtgtcctcaggtggtgaaaggggtaaacgggctccctcaggcctctaatctcattcctgagggctccaccctcatgacccaggcacctcccaaaggtcccacctcctaagtctatcacattgggaattagatttcaacataggaattggggtgggggaggcacattcagaccatagcattctgccccagactctccccagttcattttcttgtcatatgcaaaatatattcattccatcccaataggctcccaaatcttaacttgttccagcatcagttcaaaagtttcaagtccagagcctcatctaatctcacctaggccaggcacagtggtcatgtctgtgatcccagcactttgggaggctaaggcaggaggattgcttgaggccaggagttcaagaccagcctgggcaacaaagtgagaccctgtctctacaaaaaaaaaaaaaaa

SEQ ID NO: 20124 - DNA, 723 bp, Homo sapiens
  ENST00000534185
agtcccggcttggaactgaactgtgtgagcacgggtcctggaacccgggcccagaaccggcgagcccaggtctgagcccagagctcagcggtcagcctcgtaggccctgactcggaatcgagccgaggcgctgaggttggagccggagagcgtgagagccgaagagcagggagggcgggccggctgcgcgtccgacgagtcgcagagcaggaccgcggaaggcagggagacggccgcaagcccagggcagagggcagagggcagagagcggcctggctcggcggagagggcgccgcccggccggaaccaagctcgccgcccgggacggcgggccccgtggggcgcggacccagggtggccgtgggtccgcagcgactccccggccgacggcggggggcgtgccccctcccagcccagcctccccaacccggcccgcccgccgcgtcgcgggggcatgtgagcgggaagcctaggctgccagccgcgaggaccgcacggaggaggagcaggagcgcggagccgcgagccccgagccccgagcccggcgcctggctgagtagactgtagctctccagagggtaatgggtccccagaacccaagagaccaggagtgtcggaggctgcctctggaagccaggagaagctggacttcaaccgaaatttgaaagaagtggtgccagccatagagaagctgttgtccagtgactggaaggagaggtttct

SEQ ID NO: 20125 - DNA, 769 bp, Homo sapiens
  ENST00000530882
cccggcttggaactgaactgtgtgagcacgggtcctggaacccgggcccagaaccggcgagcccaggtctgagcccagagctcagcggtcagcctcgtaggccctgactcggaatcgagccgaggcgctgaggttggagccggagagcgtgagagccgaagagcagggagggcgggccggctgcgcgtccgacgagtcgcagagcaggaccgcggaaggcagggagacggccgcaagcccagggcagagggcagagggcagagagcggcctggctcggcggagagggcgccgcccggccggaaccaagctcgccgcccgggacggcgggccccgtggggcgcggacccagggtggccgtgggtccgcagcgactccccggccgacggcggggggcgtgccccctcccagcccagcctccccaacccggcccgcccgccgcgtcgcgggggcatgtgagcgggaagcctaggctgccagccgcgaggaccgcacggaggaggagcaggagcgcggagccgcgagccccgagccccgagcccggcgcctggctgagtacagggacccaagagagcctagcagagaaggagctccagcttctggtcatgattcaccagctgtccaccctgcgggaccagctcctgacagcccactcggagcagaagaacatggctgccatgctgtttgagaagcagcagcagcagatggagcttgcccggcagcagcaggagcagattgcaaagcagcagcagcagctgattcagcagcagc

SEQ ID NO: 20126 - DNA, 3587 bp, Homo sapiens
  ENST00000367204
ggcatgtgagcgggaagcctaggctgccagccgcgaggaccgcacggaggaggagcaggagcgcggagccgcgagccccgagccccgagcccggcgcctggctgagtagatgtccatgaggagccccatctctgcccagctggccctggatggcgttggcaccatggtgaactgcaccatcaagtcagaggagaagaaagagccttgccacgaggccccccagggctcagccactgccgctgaacctcagcctggagacccagcccgggcctcccaggatagtgctgacccccaagctccagcccaggggaatttcaggggctcctgggactgtagctctccagagggtaatgggtccccagaacccaagagaccaggagtgtcggaggctgcctctggaagccaggagaagctggacttcaaccgaaatttgaaagaagtggtgccagccatagagaagctgttgtccagtgactggaaggagaggtttctaggaaggaactctatggaagccaaagatgtcaaagggacccaagagagcctagcagagaaggagctccagcttctggtcatgattcaccagctgtccaccctgcgggaccagctcctgacagcccactcggagcagaagaacatggctgccatgctgtttgagaagcagcagcagcagatggagcttgcccggcagcagcaggagcagattgcaaagcagcagcagcagctgattcagcagcagcataagatcaacctccttcagcagcagatccagcaggttaacatgccttatgtcatgatcccagccttccccccaagccaccaacctctgcctgtcacccctgactcccagctggccttacccattcagcccattccctgcaaaccagtggagtatccgctgcagctgctgcacagcccccctgccccagtggtgaagaggcctggggccatggccacccaccaccccctgcaggagccctcccagcccctgaacctcacagccaagcccaaggcccccgagctgcccaacacctccagctccccaagcctgaagatgagcagctgtgtgccccgcccccccagccatggaggccccacgcgggacctgcagtccagccccccgagcctgcctctgggcttccttggtgaaggggacgctgtcaccaaagccatccaggatgctcggcagctgctgcacagccacagtggggccttggatggctcccccaacacccccttccgtaaggacctcatcagcctggactcatccccagccaaggagcggctggaggacggctgtgtgcacccactggaggaagccatgctgagctgcgacatggatggctcccgccacttccccgagtcccgaaacagcagccacatcaagaggcccatgaacgccttcatggtgtgggccaaggatgagcggaggaagatcctgcaagccttcccagacatgcacaactccagcatcagcaagatccttggatctcgctggaagtccatgaccaaccaggagaagcagccctactatgaggaacaggcgcggctgagccggcagcacctggagaagtatcctgactacaagtacaagccgcggcccaagcgcacctgcatcgtggagggcaagcggctgcgcgtgggagagtacaaggccctgatgaggacccggcgtcaggatgcccgccagagctacgtgatccccccgcaggctggccaggtgcagatgagctcctcagatgtcctgtaccctcgggcagcaggcatgccgctggcacagccactggtggagcactatgtccctcgtagcctggaccccaacatgcctgtgatcgtcaacacctgcagcctcagagaggagggtgagggcacagatgacaggcactcggtggctgatggcgagatgtaccggtacagcgaggacgaggactcggagggcgaagagaagagcgatggggagttggtggtgctcacagactgatcccggctgggtgggcctggccccttctcctctggggaagaccttgtcccaactcgatgggcacagccagccaacctaagactatgttggtacttggacttgttcgtgccccagagatgggcaaagctgtgcacttgcagatacattcatgaggggagaggcgccctcccttcctgaggagctgttggcctgggtgggcaggaactgcagtatggccatgggctgagcaggctgagcacctcagcctttagggcttatggccaggggacactgtatgactctcctctcctgcaggtgtctatccacctggggtatggcatctaccgacctgtctccctggggtcacatgctttgtttccattcttgtcctggctggaccagccactgtgggaccaacacccctcccacactcccccagactgctcgtctatcaccaggatcgctttgtactttgtgcaaaagggtctggctgtcccttgctgttttcatctctgccaagcctattgtgcctctggctgctgtatgtgtgcgcgtgcacgtgtgtgtgtttcatctgttcattcactgcacaagatatttattgagtgcccactacgtgccaggcactgttgctgagttcctgtgggtgtgtctctcgatgccactcctgcttctctgggggcctctttctgtgcttctctttgtccccaaattgctacctctttgtcagtctgggtgtctcaggttctgtgtgtccttgtgtgcatttctgtctctctctgtcctcgtctctctgcaaggccctctatttctctctttcttggtgtctgtcctttgccccctgtgccctctggattctctgggtctatgtaggcccctggtctgccctgggctcatcagccttcctgacctcctcctgccctccccttcactccctccctggctctgccagtcggttcccacggagccatttttagctctgatcagcatgggaatgtgcctcggcctccaaggggctttgtcctggtgcccccgcccctggtcccaacctgatcccacgagggagttgggacaggaggattgatggtgctccccttcctgccagcgtcagaggccctggagaggggctgtccatggcagctggtctttattcctccctcatgagcacagggtcgggggggtccccattcttggaagaggttgagaagactcctgggcttcagcctctcccacccagccctgcccctcacctgcctgccctcccctcccccactctatactagggactggatctcagcctctgatcagtttcacaaagtttgttccctaaggaaatcaaatcccattgtcacctaactctgaagatctaaatagcccttggatcagtatgggaaccccaaatcccacagggccagatgtggagtctgtgtctgcccccgtcttctctccatcctcaaagcccccacttctctccaggctgtttctttttttatgactgtaaacatagatagtgctttattttgttaataataagataatgatgagtaacttaaccagcacatttctcctgtttacactcgggggatttttttgttttctgatgacataataaagacagatcatttcagaa

SEQ ID NO: 20127 - DNA, 538 bp, Homo sapiens
  ENST00000525442
acgcgggtcgagcttagggtgcacccccaacccgctcctcgccgaccgcagaggactaggtctttctcatcagcccgactatgcgcctagtttaaggatttctcagcgggaagccgaagcgacctgcgcgcgtcctgcgtggggctcaggtgcctgcgacgaggcgcagagctcctccaccatggttgcgtggggtgctgggggacagacgcgctccccttgccacggtttcagggtcgttccccagcggaccagaccagcgcggcatcctgtttgttttctgctccggctgctcctgtcccacccccacccccaccgcaggctgcttcttgctacccccacctcccgccctgggatatcgtaggatgtccatgaggagccccatctctgcccagctggccctggatggcgttggcaccatggtgaactgcaccatcaagtcagaggagaagaaagagccttgccacgaggccccccagggctcagccactgccgctgaacctcagcctggagacccagcccgggcctcccaggatag

SEQ ID NO: 20128 - DNA, 597 bp, Homo sapiens
  ENST00000528591
agaactgttgggaggctaatggctgatgatgtctgcggcagcagtgctccatgaatggatgtccatgaggagccccatctctgcccagctggccctggatggcgttggcaccatggtgaactgcaccatcaagtcagaggagaagaaagagccttgccacgaggccccccagggctcagccactgccgctgaacctcagcctggagacccagcccgggcctcccaggatagtgctgacccccaagctccagcccaggggaatttcaggggctcctgggactgtagctctccagagggtaatgggtccccagaacccaagagaccaggagtgtcggaggctgcctctggaagccaggagaagctggacttcaaccgaaatttgaaagaagtggtgccagccatagagaagctgttgtccagtgactggaaggagaggtttctaggaaggaactctatggaagccaaagatgtcaaagggacccaagagagcctagcagagaaggagctccagcttctggtcatgattcaccagctgtccaccctgcgggaccagctcctgacagcccactcggagcagaagaacatggctgccatgct

SEQ ID NO: 20129 - DNA, 1754 bp, Homo sapiens
  ENST00000272193
aacttgcctaacagctcacagacaggatgggttgaaatgggaatttgaccccagacctgtcttgcttcaaagcctgagtgtgtcccactggatccctccgatgggatggttgtccaccctgaccctgtgtggcgctgagcactcgaggacattgaagaggcctggggctctggggctgacatgtcccactgtcagcattttcagggggcctggaattcatggctaataggggagaacttctaggctagtagttgccaggtagcaacatgaagagcccccttcaagggacccaagagagcctagcagagaaggagctccagcttctggtcatgattcaccagctgtccaccctgcgggaccagctcctgacagcccactcggagcagaagaacatggctgccatgctgtttgagaagcagcagcagcagatggagcttgcccggcagcagcaggagcagattgcaaagcagcagcagcagctgattcagcagcagcataagatcaacctccttcagcagcagatccagcaggttaacatgccttatgtcatgatcccagccttccccccaagccaccaacctctgcctgtcacccctgactcccagctggccttacccattcagcccattccctgcaaaccagtggagtatccgctgcagctgctgcacagcccccctgccccagtggtgaagaggcctggggccatggccacccaccaccccctgcaggagccctcccagcccctgaacctcacagccaagcccaaggcccccgagctgcccaacacctccagctccccaagcctgaagatgagcagctgtgtgccccgcccccccagccatggaggccccacgcgggacctgcagtccagccccccgagcctgcctctgggcttccttggtgaaggggacgctgtcaccaaagccatccaggatgctcggcagctgctgcacagccacagtggggccttggatggctcccccaacacccccttccgtaaggacctcatcagcctggactcatccccagccaaggagcggctggaggacggctgtgtgcacccactggaggaagccatgctgagctgcgacatggatggctcccgccacttccccgagtcccgaaacagcagccacatcaagaggcccatgaacgccttcatggtgtgggccaaggatgagcggaggaagatcctgcaagccttcccagacatgcacaactccagcatcagcaagatccttggatctcgctggaagtccatgaccaaccaggagaagcagccctactatgaggaacaggcgcggctgagccggcagcacctggagaagtatcctgactacaagtacaagccgcggcccaagcgcacctgcatcgtggagggcaagcggctgcgcgtgggagagtacaaggccctgatgaggacccggcgtcaggatgcccgccagagctacgtgatccccccgcaggctggccaggtgcagatgagctcctcagatgtcctgtaccctcgggcagcaggcatgccgctggcacagccactggtggagcactatgtccctcgtagcctggaccccaacatgcctgtgatcgtcaacacctgcagcctcagagaggagggtgagggcacagatgacaggcactcggtggctgatggcgagatgtaccggtacagcgaggacgaggactcggagggcgaagagaagagcgatggggagttggtggtgctcacagactgatcccggctgggtgggcct

SEQ ID NO: 20130 - DNA, 699 bp, Homo sapiens
  ENST00000480326
ggacccaagagagcctagcagagaaggagctccagcttctggtcatgattcaccagctgtccaccctgcgggaccagctcctgacagcccactcggagcagaagaacatggctgccatgctgtttgagaagcagcagcagcagatggagcttgcccggcagcagcaggagcagattgcaaagcagcagcagcagctgattcagcagcagcataagatcaacctccttcagcagcagatccagcaggttaacatgccttatgtcatgatcccagccttccccccaagccaccaacctctgcctgtcacccctgactcccagctggccttacccattcagcccattccctgcaaaccaggacttttctccttgctgccttttccatagtggagtatccgctgcagctgctgcacagcccccctgccccagtggtgaagaggcctggggccatggccacccaccaccccctgcaggagccctcccagcccctgaacctcacagccaagcccaaggcccccgagctgcccaacacctccagctccccaagcctgaagatgagcagctgtgtgccccgcccccccagccatggaggccccacgcgggacctgcagtccagccccccgagcctgcctctgggcttccttggtgaaggggacgctgtcaccaaagccatccaggatgctcggcagctgctgcacag

SEQ ID NO: 20131 - DNA, 744 bp, Homo sapiens
  ENST00000525258
gagcctgcctctgggtaagcctcctgctgcctgcacttgtccctcagccctcttaggggagagccggcggcatgatgcgaccttgagcaggtcccttctcctccctgggttccagattttatcaaatgaggggttagacttgctcttagcagaagatccccttcttcctctccctcatcatatctgtctgggcattccaagcatcagggattcaggccagagtcacatagttccagggggtactgttgtcatttctagtctattgacatgcacaataactagccagtgtaagtggcatatccctgaggacatgcaatgcagccgccctgtggaagaacaggagggaacactaactcaggtgcctcatgggagtggcatggcgggaagctgatggagtttgggctcatgctgggctgatgccctcagcttctctcgcttctcttccctctcttctgccctctcccacaggcttccttggtgaaggggacgctgtcaccaaagccatccaggatgctcggcagctgctgcacagccacagtggggccttggatggctcccccaacacccccttccgtaaggacctcatcagcctggactcatccccagccaaggagcggctggaggacggctgtgtgcacccactggaggaagccatgctgagctgcgacatggatggctcccgccacttccccgagtcccgaaacagcagccacatcaagaggcccatgaacgccttcatggtgt

SEQ ID NO: 20132 - DNA, 3476 bp, Homo sapiens
  ENST00000618875
atgtccatgaggagccccatctctgcccagctggccctggatggcgttggcaccatggtgaactgcaccatcaagtcagaggagaagaaagagccttgccacgaggccccccagggctcagccactgccgctgaacctcagcctggagacccagcccgggcctcccaggatagtgctgacccccaagctccagcccaggggaatttcaggggctcctgggactgtagctctccagagggtaatgggtccccagaacccaagagaccaggagtgtcggaggctgcctctggaagccaggagaagctggacttcaaccgaaatttgaaagaagtggtgccagccatagagaagctgttgtccagtgactggaaggagaggtttctaggaaggaactctatggaagccaaagatgtcaaagggacccaagagagcctagcagagaaggagctccagcttctggtcatgattcaccagctgtccaccctgcgggaccagctcctgacagcccactcggagcagaagaacatggctgccatgctgtttgagaagcagcagcagcagatggagcttgcccggcagcagcaggagcagattgcaaagcagcagcagcagctgattcagcagcagcataagatcaacctccttcagcagcagatccagcaggttaacatgccttatgtcatgatcccagccttccccccaagccaccaacctctgcctgtcacccctgactcccagctggccttacccattcagcccattccctgcaaaccagtggagtatccgctgcagctgctgcacagcccccctgccccagtggtgaagaggcctggggccatggccacccaccaccccctgcaggagccctcccagcccctgaacctcacagccaagcccaaggcccccgagctgcccaacacctccagctccccaagcctgaagatgagcagctgtgtgccccgcccccccagccatggaggccccacgcgggacctgcagtccagccccccgagcctgcctctgggcttccttggtgaaggggacgctgtcaccaaagccatccaggatgctcggcagctgctgcacagccacagtggggccttggatggctcccccaacacccccttccgtaaggacctcatcagcctggactcatccccagccaaggagcggctggaggacggctgtgtgcacccactggaggaagccatgctgagctgcgacatggatggctcccgccacttccccgagtcccgaaacagcagccacatcaagaggcccatgaacgccttcatggtgtgggccaaggatgagcggaggaagatcctgcaagccttcccagacatgcacaactccagcatcagcaagatccttggatctcgctggaagtccatgaccaaccaggagaagcagccctactatgaggaacaggcgcggctgagccggcagcacctggagaagtatcctgactacaagtacaagccgcggcccaagcgcacctgcatcgtggagggcaagcggctgcgcgtgggagagtacaaggccctgatgaggacccggcgtcaggatgcccgccagagctacgtgatccccccgcaggctggccaggtgcagatgagctcctcagatgtcctgtaccctcgggcagcaggcatgccgctggcacagccactggtggagcactatgtccctcgtagcctggaccccaacatgcctgtgatcgtcaacacctgcagcctcagagaggagggtgagggcacagatgacaggcactcggtggctgatggcgagatgtaccggtacagcgaggacgaggactcggagggcgaagagaagagcgatggggagttggtggtgctcacagactgatcccggctgggtgggcctggccccttctcctctggggaagaccttgtcccaactcgatgggcacagccagccaacctaagactatgttggtacttggacttgttcgtgccccagagatgggcaaagctgtgcacttgcagatacattcatgaggggagaggcgccctcccttcctgaggagctgttggcctgggtgggcaggaactgcagtatggccatgggctgagcaggctgagcacctcagcctttagggcttatggccaggggacactgtatgactctcctctcctgcaggtgtctatccacctggggtatggcatctaccgacctgtctccctggggtcacatgctttgtttccattcttgtcctggctggaccagccactgtgggaccaacacccctcccacactcccccagactgctcgtctatcaccaggatcgctttgtactttgtgcaaaagggtctggctgtcccttgctgttttcatctctgccaagcctattgtgcctctggctgctgtatgtgtgcgcgtgcacgtgtgtgtgtttcatctgttcattcactgcacaagatatttattgagtgcccactacgtgccaggcactgttgctgagttcctgtgggtgtgtctctcgatgccactcctgcttctctgggggcctctttctgtgcttctctttgtccccaaattgctacctctttgtcagtctgggtgtctcaggttctgtgtgtccttgtgtgcatttctgtctctctctgtcctcgtctctctgcaaggccctctatttctctctttcttggtgtctgtcctttgccccctgtgccctctggattctctgggtctatgtaggcccctggtctgccctgggctcatcagccttcctgacctcctcctgccctccccttcactccctccctggctctgccagtcggttcccacggagccatttttagctctgatcagcatgggaatgtgcctcggcctccaaggggctttgtcctggtgcccccgcccctggtcccaacctgatcccacgagggagttgggacaggaggattgatggtgctccccttcctgccagcgtcagaggccctggagaggggctgtccatggcagctggtctttattcctccctcatgagcacagggtcgggggggtccccattcttggaagaggttgagaagactcctgggcttcagcctctcccacccagccctgcccctcacctgcctgccctcccctcccccactctatactagggactggatctcagcctctgatcagtttcacaaagtttgttccctaaggaaatcaaatcccattgtcacctaactctgaagatctaaatagcccttggatcagtatgggaaccccaaatcccacagggccagatgtggagtctgtgtctgcccccgtcttctctccatcctcaaagcccccacttctctccaggctgtttctttttttatgactgtaaacatagatagtgctttattttgttaataataagataatgatgagtaacttaaccagcacatttctcctgtttacactcgggggatttttttgttttctgatgacataataaagacagatcatttcag

SEQ ID NO: 20133 - DNA, 2513 bp, Homo sapiens
  ENST00000325404
ggatggttgtctattaacttgttcaaaaaagtatcaggagttgtcaaggcagagaagagagtgtttgcaaaagggggaaagtagtttgctgcctctttaagactaggactgagagaaagaagaggagagagaaagaaagggagagaagtttgagccccaggcttaagcctttccaaaaaataataataacaatcatcggcggcggcaggatcggccagaggaggagggaagcgctttttttgatcctgattccagtttgcctctctctttttttcccccaaattattcttcgcctgattttcctcgcggagccctgcgctcccgacacccccgcccgcctcccctcctcctctccccccgcccgcgggccccccaaagtcccggccgggccgagggtcggcggccgccggcgggccgggcccgcgcacagcgcccgcatgtacaacatgatggagacggagctgaagccgccgggcccgcagcaaacttcggggggcggcggcggcaactccaccgcggcggcggccggcggcaaccagaaaaacagcccggaccgcgtcaagcggcccatgaatgccttcatggtgtggtcccgcgggcagcggcgcaagatggcccaggagaaccccaagatgcacaactcggagatcagcaagcgcctgggcgccgagtggaaacttttgtcggagacggagaagcggccgttcatcgacgaggctaagcggctgcgagcgctgcacatgaaggagcacccggattataaataccggccccggcggaaaaccaagacgctcatgaagaaggataagtacacgctgcccggcgggctgctggcccccggcggcaatagcatggcgagcggggtcggggtgggcgccggcctgggcgcgggcgtgaaccagcgcatggacagttacgcgcacatgaacggctggagcaacggcagctacagcatgatgcaggaccagctgggctacccgcagcacccgggcctcaatgcgcacggcgcagcgcagatgcagcccatgcaccgctacgacgtgagcgccctgcagtacaactccatgaccagctcgcagacctacatgaacggctcgcccacctacagcatgtcctactcgcagcagggcacccctggcatggctcttggctccatgggttcggtggtcaagtccgaggccagctccagcccccctgtggttacctcttcctcccactccagggcgccctgccaggccggggacctccgggacatgatcagcatgtatctccccggcgccgaggtgccggaacccgccgcccccagcagacttcacatgtcccagcactaccagagcggcccggtgcccggcacggccattaacggcacactgcccctctcacacatgtgagggccggacagcgaactggaggggggagaaattttcaaagaaaaacgagggaaatgggaggggtgcaaaagaggagagtaagaaacagcatggagaaaacccggtacgctcaaaaagaaaaaggaaaaaaaaaaatcccatcacccacagcaaatgacagctgcaaaagagaacaccaatcccatccacactcacgcaaaaaccgcgatgccgacaagaaaacttttatgagagagatcctggacttctttttgggggactatttttgtacagagaaaacctggggagggtggggagggcgggggaatggaccttgtatagatctggaggaaagaaagctacgaaaaactttttaaaagttctagtggtacggtaggagctttgcaggaagtttgcaaaagtctttaccaataatatttagagctagtctccaagcgacgaaaaaaatgttttaatatttgcaagcaacttttgtacagtatttatcgagataaacatggcaatcaaaatgtccattgtttataagctgagaatttgccaatatttttcaaggagaggcttcttgctgaattttgattctgcagctgaaatttaggacagttgcaaacgtgaaaagaagaaaattattcaaatttggacattttaattgtttaaaaattgtacaaaaggaaaaaattagaataagtactggcgaaccatctctgtggtcttgtttaaaaagggcaaaagttttagactgtactaaattttataacttactgttaaaagcaaaaatggccatgcaggttgacaccgttggtaatttataatagcttttgttcgatcccaactttccattttgttcagataaaaaaaaccatgaaattactgtgtttgaaatattttcttatggtttgtaatatttctgtaaatttattgtgatattttaaggttttcccccctttattttccgtagttgtattttaaaagattcggctctgtattatttgaatcagtctgccgagaatccatgtatatatttgaactaatatcatccttataacaggtacattttcaacttaagtttttactccattatgcacagtttgagataaataaatttttgaaatatggacactgaaa

SEQ ID NO: 20134 - DNA, 8808 bp, Homo sapiens
  ENST00000316399
ctgttttttttctgcagaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatggaatcagagaataataagttatgttccctatattccttccgaaatacctctacctcaccacataagcctgacgaagggagtcgggaccgtgagataatgaccagtgttacttttggaaccccagagcgccgcaaagggagtcttgccgatgtggtggacacactgaaacagaagaagcttgaggaaatgactcggactgaacaagaggattcctcctgcatggaaaaactactttcaaaagattggaaggaaaaaatggaaagactaaataccagtgaacttcttggagaaattaaaggtacacctgagagcctggcagaaaaagaacggcagctctccaccatgattacccagctgatcagtttacgggagcagctactggcagcgcatgatgaacagaaaaaactggcagcgtcacaaattgagaaacaacggcagcaaatggaccttgctcgccaacagcaagaacagattgcgagacaacagcagcaacttctgcaacagcagcacaaaattaatctcctgcagcaacagatccaggttcagggtcacatgcctccgctcatgatcccaatttttccacatgaccagcggactctggcagcagctgctgctgcccaacagggattcctcttcccccctggaataacatacaaaccaggtgataactaccccgtacagttcattccatcaacaatggcagctgctgctgcttctggactcagccctttacagctccagaagggtcatgtctcccacccacaaattaaccaaaggctaaagggcctaagtgaccgttttggcaggaatttggacacctttgaacatggtggtggccactcttacaaccacaaacagattgagcagctctatgccgctcagctggccagcatgcaggtgtcacctggagcaaagatgccatcaactccacagccaccaaacacagcagggacggtctcacctactgggataaaaaatgaaaagagagggaccagccctgtaactcaagttaaggatgaagcagcagcacagcctctgaatctctcatcccgacccaagacagcagagcctgtaaagtccccaacgtctcccacccagaacctcttcccagccagcaaaaccagccctgtcaatctgccaaacaaaagcagcatccctagccccattggaggaagcctgggaagaggatcctctttagatatcctatctagtctcaactcccctgccctttttggggatcaggatacagtgatgaaagccattcaggaggcgcggaagatgcgagagcagatccagcgggagcaacagcagcaacagccacatggtgttgacgggaaactgtcctccataaataatatggggctgaacagctgcaggaatgaaaaggaaagaacgcgctttgagaatttggggccccagttaacgggaaagtcaaatgaagatggaaaactgggcccaggtgtcatcgaccttactcggccagaagatgcagagggaggtgccactgtggctgaagcacgagtctacagggacgcccgcggccgtgccagcagcgagccacacattaagcgaccaatgaatgcattcatggtttgggcaaaggatgagaggagaaaaatccttcaggccttccccgacatgcataactccaacattagcaaaatcttaggatctcgctggaaatcaatgtccaaccaggagaagcaaccttattatgaagagcaggcccggctaagcaagatccacttagagaagtacccaaactataaatacaaaccccgaccgaaacgcacctgcattgttgatggcaaaaagcttcggattggggagtataagcaactgatgaggtctcggagacaggagatgaggcagttctttactgtggggcaacagcctcagattccaatcaccacaggaacaggtgttgtgtatcctggtgctatcactatggcaactaccacaccatcgcctcagatgacatctgactgctctagcacctcggccagcccggagcccagcctcccggtcatccagagcacttatggtatgaagacagatggcggaagcctagctggaaatgaaatgatcaatggagaggatgaaatggaaatgtatgatgactatgaagatgaccccaaatcagactatagcagtgaaaatgaagccccggaggctgtcagtgccaactgaggagtttttgtttgctgaattaaagtactctgacatttcacccccctccccaacaaagagttattaaagagcccgcatgcatttgtggctccacaattacatcagcagaatggtcttaattgtttcgtaaagtgtgagacagattaagttttccctgatttttcatgaacttgagttttttgttgttattgttattgttgttgttgttgtttttttaatttaggtgaagacatattaaatatgagacaccaggacttgaaacttatctcaacccgtagatgtcttacaagtcttatatttttgtcttactttttttttcttttggatgttgataaaggtttaagttactgttttagatggggttaaacattctcactcaggtatgctgtgccggcctacaggttgtgaatgtgtttttattctgaattattttagaaaacaactgaggatttcatattgtgaaacagaacaagtccacggcgtgtgcagctgcatgtagagcatattcaaaaggcctcggaattccaattttccatttgtagagttaaactttgaatgtgccaaactttttcgtaacttttgaatcttaatattttgaaagtcttaaaggagacactgcaaagtcttagacaatctttggcatcttaaaataaaatagcaaaccaacatttttttttccagaaaatggtaaggtactcaggaatctggagacaagatattgtaaggaatgaacaaggttgccacagtgcatggacccaattgtgtttgcctgttgacgtgccatcagtgcgtgatgtggtatgacatacacacaccagagcaaccgccacaccagatatcgacagagtggtcttctctgcctgagaccacctctcactacatccattatccctttgcctttaaccctgacattcagtcttaacacattttatcttaaataatttattcattccagaatgtcaagggtccacttgctatttattttttttcaattgttggtggcattaatttaataattcttgtttttcaccttccttccccgaagaacttttccgtccttttcacctccttctcctgtgtacatagtgattttatgtccccagaacgcctggaagcatttctgaaaccaagatattattaaaaacctattattgtttttaatcatgagtatgtatctggctgcagggctgtgtattgggatataggtatatagtcttacacttaaacaggtatgcccctgaggttcactgtgacctcaagtcttttgccagaattttcccctaattcagttcacaagtggtagggtctgcatcagtggcatttccccctgaattccattcagcagcaaggttcaacagtggtgactgccaggcaggagagtcctgcggccaaacctgaagcccaaggctcgtgggccatgcaggaatctcagtgaagctgtcatgggctggcacctttacactgagttgccttgtcccagctggcacatctagggagttcattgcaaaatccccaggatgcaaaaagccacatgacagcctcagagcaaagatggtggcaaatagtcatgatacatctagagaatgaaagaaaactgtaagggaggagaaggaggggaatacattccctatatgggatgttcctactgttaactctggggaacagatagctccgggggcagcagatgagttcctctggctgactctatctgtagccacatggggacctgcctacgtgtgaacaaaatgaactgcacttatcacacaaggatttctttgaagacatgctactggggtgggaagcagtgaggttttattccccatctcctaactacagggagctctgccatgtcattttggccttcctgaaactaggacaggttgtctatcggggggcttcccccagagaggtttagtgggagaatgtcagtgaatgggatagttcacctcatgggacaacccagaatctgatcaccaggacataggaatggccccatcagatttcttgagccattttgtcacttggaagaaaatagtgtacctttgtatttatttaagagtgctcaaggcctaatagcaataaacaggtctagccaagaaattacaagctattctgttagctgggagtgctctctataagctgattaaggtactgataggaactctttgttattcatgttggttggggattagaaatttgtttttgtacatttatttcaaatgaggaggaggtcattttttctctcaaaaaatgagtatttattattgtcttactgatttctttgattatatacctctcctcctcagttcactcttgttttttttctttctctttggcttttgcttttgctctctctcacttctttcttattttgttgcattggtagagtgttgtatggctagcattgtattgtatgtaattaattttgcacaaaagcaaacatttagcatagtaggttaattttgtttgtttttatgaccatgccaaaataatattctgggctggtggagaacaaaggactgttctttaggactgaaacttgattttgctcatagtaagtaaaaaaaaacaaaaaacacacacactcacagatgttgtttcgtaagtgttataagcactggatataaatggtattttttatcacttctgactaatgtgaaactgttgtacgaaaactacatgaacaaaagtcatctgtttcgactcgtgtgggcttgcctcacagttgccggatttgagtcatttttatgtcttgttatttcatttatttatgcaaaatacatgtgtgtatgaacactttgttttagctccagctctgcctcagtactggggttcatttacttttagccatgttcttaaaaatgaaaggctattcaggaatgatctgattgtaaacgtctttttcattggatcaaacagtaatgctgtatttgaatctaaattttgtgtataagcagtttatttattagccaagtttggctctaaatatccatggaaattaagaatgacaatcatagggatcaattcattttattttcagtggggcttaaacaaagtttatatgactttaccatctcattttagatttttctaattgtgtaaatataacatagaaatagaatttatttttggttcatgaatacttagtgagatataagttatgtatttcctttttgttctctatccatagatgttggtccaaactgaaagttgatgagtcactgtgcctctcggggtagtgagttatcagctacagtgagagagcagtgtttggcctgcagctgggacagcaaaacgtttcaccagggttctcatgcagttcagaacccactgtccacagatccagacatttcccttttttcttacagaaagttgatgattggacatactaaatttccactacagttaggagacagtcagtttgctttgggagtctacataaatcttctaagatagttctgtgaccatttaatagcaagaagcatgaatgccactacaaaggcaaaaatccacctctgagatcggccgttaataaacgtcccgtcatgtcagtttagattcaagaatgttaagcaactttgtttttgcggtgctccctatttcatagtatcttcaaatcaaaaataaaaattatctccattttgttaaagaacttacagggtcagggttctccttgtcacttagaattgggacactgccaggcaatcctctcccaaaaaaaaaaaaaaaaaaaaatagccatatggaatggaaggaaaaggagaaaagaaggaagaaaggaaaaaagtaggaagggagagagaaaaaaaaggtcgctttgcggatacgagccgctaggctgacaacttttctatttcattggcagatatgaagcagtgtcttttccagtaaggtacggaagctttgttgttttcatgtgtacccagctcagccttttagaagcacctcggtttgcttcattaggtatttgatactctccagccttgtcctcaggcctgatttgatttgccagggtcctgacaccaaagcccaggccaagttctaaattcaggtgtgggctcacagtgctattgagcttgtcgaattctggcctcccctgaacattagccccacgggagcctgagggtgtttgaaaagggcgtgatcactctagggctgaaattaaaggctgctttcttttccttctgaagccaggctgcttcttcggagtacaccctcctgagccaggagcacaagcactagcagaaagcagggattgtttcaggaaagcccatttaccctcagtaggaaggcagcctggtcacttgaacagcacagctgaggctgcttctctcaatttactcattttgcaaagaattgacctctaccaactcattagggagaggaaaaagaatcacttagtaattttaaatcatatgagaagtcctgtaccaagtgccaacaactgcaaagaaatgcagctagaggaatgtattgaaattactactgggtcttcctttttaatgagaaaatgacaaaaatggttgctgtagccctgcctgattttgtacacgtttgtctaagaattgagttggcacttaagctcacttctcaaagtataataatattgtatgacctcatttgtcctttcacaaaagcacttgcatcatttccttaagtcatctgctccctgacatgttttcttccctaataaacaacttctgtctgttattcctgccaatgatgttctgtttctgatgccatatcctattgagcgtgcccctgtactaatatcattgaaaatattgatatgcaaacacatttccttttcatccccattctatctttccctttggggacagattgctttccaaaagctcatgaacaaatatttggaatgctggtacctttggggcagaggtaagggtgggcggggtgggggcagaaaggtaatgcttaatgcagataactcttctaatcagtgtccatggcaatatgaacgcttgaagaaaactcagtgacatatcttgctcagtagtttcttattcctgaagaaccacaagcataaagtgaggcctcagtgctggtgctcttggagtatggggaatgtgcaaatatttaactgttttgtatgctgcacattgcaggtctgctcatgtgcattctccctttgtcttcctttgtcatatgtgtttttgcttttttgaaagtgcagtctttattgtaccctcctccagcttgtagcaaattagaatgcttagcatttatgttcattcattattgtatttgccatgtaaaatttttattaccttagacaagcttataagctgttactacataacttatcttactgtaactcttttatttcccccgacgttgtaatttgtttgtgatgtatattgtgaaattgtattctatgttaatttaatcagcacaattcactgacatgctggactgacatgctggctgctgtttcaaagtgtaaagtttgtgtagggctgttgggacaactgcaactctgttgtcaaggtactgtgctttggttcctatagcaacactgggtgtggcccttgaattgctaagggcatttaatacatcctggagcaaattttaactgcagattttctttgtagaaattctatgtataatgcaggtacctacttggcccatggctggtaactatttgggcaattagaaaaaaagaaaaaaacataaaaactagtgtctattgctgctttgaatatgtttgaaagtctgaaaatgtaaatagtttatcaaaaaaaaatcttgtacagtccagtgtaaagtttttaaatgaccttaagggttgccatcacatctttctcacactctcctcttgataataataataataaaaagtttgctaaggattaaagaaatgggaaaaataaaaaaaatctcttcaaatttacaggaatgaatcattgttcttagctttgttgcatacacaaacttcttggattttgttgtgcagtattgacgtgagataaagctcaacattgaataatctttcagtggtacttttcaaagtcttcccctcctctgcctcataattaagggaaaagacaaaattgaaagacacactgtctttatctatcctggtgtatgttggcaccttagctactttttttttttcctttttgcacaaggtgctttcctgatatgttcaacatgccatctttgggtgataatgtatatgccgtgatggggctcaggccccttaggggagtgtctataagaactgcctatttatgctcatttacctcaagactgtcctctctaccctaatctagttgtcatcactccatcttttgtactgctgttgacacttacaaattaaagataaattttgttttatga

SEQ ID NO: 20135 - DNA, 2707 bp, Homo sapiens
  ENST00000528252
ccttggggttagttttagtcatatttttatctctataaaacatcaggctgggaggtggtgtgtgcctgtagtctcaactgctagggagcctgaggcaggaagactccttgagcacaggagttcaaggccagcctgtgcaacatagtgagaccctatcactctggaaaaaaaaaaaaaatctgcggagaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatggaatcagagaataataagttatgttccctatattccttccgaaatacctctacctcaccacataagcctgacgaagggagtcgggaccgtgagataatgaccagtgttacttttggaaccccagagcgccgcaaagggagtcttgccgatgtggtggacacactgaaacagaagaagcttgaggaaatgactcggactgaacaagaggattcctcctgcatggaaaaactactttcaaaagattggaaggaaaaaatggaaagactaaataccagtgaacttcttggagaaattaaaggtacacctgagagcctggcagaaaaagaacggcagctctccaccatgattacccagctgatcagtttacgggagcagctactggcagcgcatgatgaacagaaaaaactggcagcgtcacaaattgagaaacaacggcagcaaatggaccttgctcgccaacagcaagaacagattgcgagacaacagcagcaacttctgcaacagcagcacaaaattaatctcctgcagcaacagatccaggttcagggtcacatgcctccgctcatgatcccaatttttccacatgaccagcggactctggcagcagctgctgctgcccaacagggattcctcttcccccctggaataacatacaaaccaggtgataactaccccgtacagttcattccatcaacaatggcagctgctgctgcttctggactcagccctttacagctccagcagctctatgccgctcagctggccagcatgcaggtgtcacctggagcaaagatgccatcaactccacagccaccaaacacagcagggacggtctcacctactgggataaaaaatgaaaagagagggaccagccctgtaactcaagttaaggatgaagcagcagcacagcctctgaatctctcatcccgacccaagacagcagagcctgtaaagtccccaacgtctcccacccagaacctcttcccagccagcaaaaccagccctgtcaatctgccaaacaaaagcagcatccctagccccattggaggaagcctgggaagaggatcctctttaggtaaatggaaaagtcaacaccaggaagagacttacgaattagatatcctatctagtctcaactcccctgccctttttggggatcaggatacagtgatgaaagccattcaggaggcgcggaagatgcgagagcagatccagcgggagcaacagcagcaacagccacatggtgttgacgggaaactgtcctccataaataatatggggctgaacagctgcaggaatgaaaaggaaagaacgcgctttgagaatttggggccccagttaacgggaaagtcaaatgaagatggaaaactgggcccaggtgtcatcgaccttactcggccagaagatgcagagggaagtaaagcaatgaatggctctgcagctaaactacagcagtattattgttggccaacaggaggtgccactgtggctgaagcacgagtctacagggacgcccgcggccgtgccagcagcgagccacacattaagcgaccaatgaatgcattcatggtttgggcaaaggatgagaggagaaaaatccttcaggccttccccgacatgcataactccaacattagcaaaatcttaggatctcgctggaaatcaatgtccaaccaggagaagcaaccttattatgaagagcaggcccggctaagcaagatccacttagagaagtacccaaactataaatacaaaccccgaccgaaacgcacctgcattgttgatggcaaaaagcttcggattggggagtataagcaactgatgaggtctcggagacaggagatgaggcagttctttactgtggggcaacagcctcagattccaatcaccacaggaacaggtgttgtgtatcctggtgctatcactatggcaactaccacaccatcgcctcagatgacatctgactgctctagcacctcggccagcccggagcccagcctcccggtcatccagagcacttatggtatgaagacagatggcggaagcctagctggaaatgaaatgatcaatggagaggatgaaatggaaatgtatgatgactatgaagatgaccccaaatcagactatagcagtgaaaatgaagccccggaggctgtcagtgccaactgaggagtttttgtttgctgaattaaagtactctgacatttcacccccctccccaacaaagagttattaaagagcccgcatgcatttgtggctccacaattacatcagcagaa

SEQ ID NO: 20136 - DNA, 2699 bp, Homo sapiens
  ENST00000527619
gggataggaaagatgaaaggtcatggtgagcttcaaggacatgaaaggttgttgtctcatgtaacaatagtagattgttttttttcctaatatttctagccagcccctaagtcaggtgatggaacaaatacctacagtttagtcaggtgaaacaggagtgggtggaggaaggaaagaagaaaaatgggaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatggaatcagagaataataagttatgttccctatattccttccgaaatacctctacctcaccacataagcctgacgaagggagtcgggaccgtgagataatgaccagtgttacttttggaaccccagagcgccgcaaagggagtcttgccgatgtggtggacacactgaaacagaagaagcttgaggaaatgactcggactgaacaagaggattcctcctgcatggaaaaactactttcaaaagattggaaggaaaaaatggaaagactaaataccagtgaacttcttggagaaattaaaggtacacctgagagcctggcagaaaaagaacggcagctctccaccatgattacccagctgatcagtttacgggagcagctactggcagcgcatgatgaacagaaaaaactggcagcgtcacaaattgagaaacaacggcagcaaatggaccttgctcgccaacagcaagaacagattgcgagacaacagcagcaacttctgcaacagcagcacaaaattaatctcctgcagcaacagatccaggttcagggtcacatgcctccgctcatgatcccaatttttccacatgaccagcggactctggcagcagctgctgctgcccaacagggattcctcttcccccctggaataacatacaaaccaggtgataactaccccgtacagttcattccatcaacaatggcagctgctgctgcttctggactcagccctttacagctccagcagctctatgccgctcagctggccagcatgcaggtgtcacctggagcaaagatgccatcaactccacagccaccaaacacagcagggacggtctcacctactgggataaaaaatgaaaagagagggaccagccctgtaactcaagttaaggatgaagcagcagcacagcctctgaatctctcatcccgacccaagacagcagagcctgtaaagtccccaacgtctcccacccagaacctcttcccagccagcaaaaccagccctgtcaatctgccaaacaaaagcagcatccctagccccattggaggaagcctgggaagaggatcctctttaggtaaatggaaaagtcaacaccaggaagagacttacgaattagatatcctatctagtctcaactcccctgccctttttggggatcaggatacagtgatgaaagccattcaggaggcgcggaagatgcgagagcagatccagcgggagcaacagcagcaacagccacatggtgttgacgggaaactgtcctccataaataatatggggctgaacagctgcaggaatgaaaaggaaagaacgcgctttgagaatttggggccccagttaacgggaaagtcaaatgaagatggaaaactgggcccaggtgtcatcgaccttactcggccagaagatgcagagggaagtaaagcaatgaatggctctgcagctaaactacagcagtattattgttggccaacaggaggtgccactgtggctgaagcacgagtctacagggacgcccgcggccgtgccagcagcgagccacacattaagcgaccaatgaatgcattcatggtttgggcaaaggatgagaggagaaaaatccttcaggccttccccgacatgcataactccaacattagcaaaatcttaggatctcgctggaaatcaatgtccaaccaggagaagcaaccttattatgaagagcaggcccggctaagcaagatccacttagagaagtacccaaactataaatacaaaccccgaccgaaacgcacctgcattgttgatggcaaaaagcttcggattggggagtataagcaactgatgaggtctcggagacaggagatgaggcagttctttactgtggggcaacagcctcagattccaatcaccacaggaacaggtgttgtgtatcctggtgctatcactatggcaactaccacaccatcgcctcagatgacatctgactgctctagcacctcggccagcccggagcccagcctcccggtcatccagagcacttatggtatgaagacagatggcggaagcctagctggaaatgaaatgatcaatggagaggatgaaatggaaatgtatgatgactatgaagatgaccccaaatcagactatagcagtgaaaatgaagccccggaggctgtcagtgccaactgaggagtttttgtttgctgaattaaagtactctgacatttcacccccctccccaacaaagagttattaaagagcccgcatgcatttgtggctccacaattaca

SEQ ID NO: 20137 - DNA, 2656 bp, Homo sapiens
  ENST00000528429
gttaggagagaccattggggataggaaagatgaaaggtcatggtgagcttcaaggacatgaaagaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatggaatcagagaataataagttatgttccctatattccttccgaaatacctctacctcaccacataagcctgacgaagggagtcgggaccgtgagataatgaccagtgttacttttggaaccccagagcgccgcaaagggagtcttgccgatgtggtggacacactgaaacagaagaagcttgaggaaatgactcggactgaacaagaggattcctcctgcatggaaaaactactttcaaaagattggaaggaaaaaatggaaagactaaataccagtgaacttcttggagaaattaaaggtacacctgagagcctggcagaaaaagaacggcagctctccaccatgattacccagctgatcagtttacgggagcagctactggcagcgcatgatgaacagaaaaaactggcagcgtcacaaattgagaaacaacggcagcaaatggaccttgctcgccaacagcaagaacagattgcgagacaacagcagcaacttctgcaacagcagcacaaaattaatctcctgcagcaacagatccaggttcagggtcacatgcctccgctcatgatcccaatttttccacatgaccagcggactctggcagcagctgctgctgcccaacagggattcctcttcccccctggaataacatacaaaccaggtgataactaccccgtacagttcattccatcaacaatggcagctgctgctgcttctggactcagccctttacagctccagaagggtcatgtctcccacccacaaattaaccaaaggctaaagggcctaagtgaccgttttggcaggaatttggacacctttgaacatggtggtggccactcttacaaccacaaacagattgagcagctctatgccgctcagctggccagcatgcaggtgtcacctggagcaaagatgccatcaactccacagccaccaaacacagcagggacggtctcacctactgggataaaaaatgaaaagagagggaccagccctgtaactcaagttaaggatgaagcagcagcacagcctctgaatctctcatcccgacccaagacagcagagcctgtaaagtccccaacgtctcccacccagaacctcttcccagccagcaaaaccagccctgtcaatctgccaaacaaaagcagcatccctagccccattggaggaagcctgggaagaggatcctctttagatatcctatctagtctcaactcccctgccctttttggggatcaggatacagtgatgaaagccattcaggaggcgcggaagatgcgagagcagatccagcgggagcaacagcagcaacagccacatggtgttgacgggaaactgtcctccataaataatatggggctgaacagctgcaggaatgaaaaggaaagaacgcgctttgagaatttggggccccagttaacgggaaagtcaaatgaagatggaaaactgggcccaggtgtcatcgaccttactcggccagaagatgcagagggaagtaaagcaatgaatggctctgcagctaaactacagcagtattattgttggccaacaggaggtgccactgtggctgaagcacgagtctacagggacgcccgcggccgtgccagcagcgagccacacattaagcgaccaatgaatgcattcatggtttgggcaaaggatgagaggagaaaaatccttcaggccttccccgacatgcataactccaacattagcaaaatcttaggatctcgctggaaatcaatgtccaaccaggagaagcaaccttattatgaagagcaggcccggctaagcaagatccacttagagaagtacccaaactataaatacaaaccccgaccgaaacgcacctgcattgttgatggcaaaaagcttcggattggggagtataagcaactgatgaggtctcggagacaggagatgaggcagttctttactgtggggcaacagcctcagattccaatcaccacaggaacaggtgttgtgtatcctggtgctatcactatggcaactaccacaccatcgcctcagatgacatctgactgctctagcacctcggccagcccggagcccagcctcccggtcatccagagcacttatggtatgaagacagatggcggaagcctagctggaaatgaaatgatcaatggagaggatgaaatggaaatgtatgatgactatgaagatgaccccaaatcagactatagcagtgaaaatgaagccccggaggctgtcagtgccaactgaggagtttttgtttgctgaattaaagtactctgacatttcacccccctccccaacaaagagttattaaagagcccgcatgcatttgtggctccacaattaca

SEQ ID NO: 20138 - DNA, 574 bp, Homo sapiens
  ENST00000527840
gagcaaatccgacagagagaagatatgcatagaagctctggcaggttccctgtcacagctttcctttccctacaggaaagaacgcgctttgagaatttggggccccagttaacgggaaagtcaaatgaagatggaaaactgggcccaggtgtcatcgaccttactcggccagaagatgcagagggaagtaaagcaatgaatggctctgcagctaaactacagcagtattattgttggccaacaggaggtgccactgtggctgaagcacgagtctacagggacgcccgcggccgtgccagcagcgagccacacattaagcgaccaatgaatgcattcatggtttgggcaaaggatgagaggagaaaaatccttcaggccttccccgacatgcataactccaacattagcaaaatcttaggatctcgctggaaatcaatgtccaaccaggagaagcaaccttattatgaagagcaggcccggctaagcaagatccacttagagaagtacccaaactataaatacaaaccccgaccgaaacgcacctgcattgttgatggcaaaaagcttcggattg

SEQ ID NO: 20139 - DNA, 534 bp, Homo sapiens
  ENST00000524650
actctggcagcagctgctgctgcccaacagggattcctcttcccccctggaataacatacaaaccagtgaagtggttcagtcttcctgtgatctctgtaagtcattctaaactacttcttcattttgactttctttggaacattgaagtgataactaccccgtacagttcattccatcaacaatggcagctgctgctgcttctggactcagccctttacagctccagcagctctatgccgctcagctggccagcatgcaggtgtcacctggagcaaagatgccatcaactccacagccaccaaacacagcagggacggtctcacctactgggataaaaaatgaaaagagagggaccagccctgtaactcaagttaaggatgaagcagcagcacagcctctgaatctctcatcccgacccaagacagcagagcctgtaaagtccccaacgtctcccacccagaacctcttcccagccagcaaaaccagccctgtcaatctgccaaacaaaagcagcatccctagccccattggag

SEQ ID NO: 20140 - DNA, 429 bp, Homo sapiens
  ENST00000531297
aaaactccccaaagtgtggccatccccttttgactgggtatccttggagttcttaactctgagagttgtgcaccctgagcatccagcagttcgtagatcacagttccaaagttcctaccgacactggttcctgtggaggtttctgttcctgggtttctcctctgattcctcctgcatggaaaaactactttcaaaagattggaaggaaaaaatggaaagactaaataccagtgaacttcttggagaaattaaaggtacacctgagagcctggcagaaaaagaacggcagctctccaccatgattacccagctgatcagtttacgggagcagctactggcagcgcatgatgaacagaaaaaactggcagcgtcacaaattgagaaacaacggcagcaaatggaccttgctcgccaacagcaagaacaggt

SEQ ID NO: 20141 - DNA, 586 bp, Homo sapiens
  ENST00000533411
gattattaatccagctagagaagaaatatgcttttacttagcaagaatgagtatccaaagagctgataatattgttaaggcagcggggtggaatggcagagcttgaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatggaatcagagaataataagttatgttccctatattccttccgaaatacctctacctcaccacataagcctgacgaagggagtcgggaccgtgagataatgaccagtgttacttttggaaccccagagcgccgcaaagggagtcttgccgatgtggtggacacactgaaacagaagaagcttgaggaaatgactcggactgaacaagaggattcctcctgcatggaaaaactactttcaaaa

SEQ ID NO: 20142 - DNA, 1818 bp, Homo sapiens
  ENST00000530378
acagtcgtcaccgttgcggcccctcgccgccccggggcactttgggagttgtagttttctgattcattgcatactggcccgaataaaaaagatgtgtccgtgactaaaactacaattcccaggaagccccgaggctcaattcgcgctgtgtggcgggagtgccctcagaggccccgccttcggctggtggaggaagcgttcccgcggatgtgtatggcgaattgttggcacctggatggtaaatcttcaagttactgtgaaacaagatcacaaacgaaaaagtaacataggaaatactaaagactgggacattttatcagattttactcagtttcatatacagaaggctataggactgttttgccggattctaaatgacaacttttaaatcagagccttgaaatctacagaagtccaatatatactgaggaacaaagggaatgtggaaatgaaagagagagggagagagaggctggcagatgtaatgagacgcggtgaaggtgtacgcagactggcactcccactcctcccttctgctctcactgcagccctgggtaactcgcaggctaacacaaacagcttttctcccgcagcctgccctctgtcactgtcactttcatgaattcaaaggcaatttaccagtgatttctgggtgctggggctgatattttttgtgcatatttaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatggaatcagagaataataagttatgttccctatattccttccgaaatacctctacctcaccacataagcctgacgaagggagtcgggaccgtgagataatgaccagtgttacttttggaaccccagagcgccgcaaagggagtcttgccgatgtggtggacacactgaaacagaagaagcttgaggaaatgactcggactgaacaagaggcaagtctttctttcaagatttctggagtaccttagttattttaaaccataactgctgaaaggagaataacatgaatctagagaactttttaaaaagtaactgaaattatcgaacattagcagcattgaatagagtttcctctctgacataacaagaaaatatggacaaaatactctagttctaaagtgtacaacttacatatgaagaaatgctacaggaatttcccttaagatcaggaacaaggccaagctgcccactgtcaccactatattcaacatttttctgaaggagggtaaattcagcctccgtcttggctagaagtgggtaatccaagtaatgcaaattaaaactatattgagatgacaattctagctcattgaattgttgaaaattaaagatgtgaaacacattcttctgtcaaggttgtgaagaaacaggtattctattttggagggcatggaagttattataagtctttcagaaacaaatttcacagcatctgtcaaaacaacatatacactttcttttgatccagtagtcctcttcttggaatttaccctgaagatacaccttcagtgatatgaaaaaagatatgcaaaaagctgtttgttgacttattatttgtaattgcaaacaacctacatatgcatataggagagtgattaaataaattatgctgcagtccc

SEQ ID NO: 20143 - DNA, 7224 bp, Homo sapiens
  ENST00000533870
ctgttttttttctgcagaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatggaatcagagaataataagttatgttccctatattccttccgaaatacctctacctcaccacataagcctgacgaagggagtcgggaccgtgagataatgaccagtgttacttttggaaccccagagcgccgcaaagggagtcttgccgatgtggtggacacactgaaacagaagaagcttgaggaaatgactcggactgaacaagaggaatggagagttagagggcttcaaacattgttaaaactgaaagtatatgagtgacttctttgatacatgacatctcttgcaacatcccacatctaccttctctactctgtacaagagttcactcaggttcgtgtacatcctagaaaacaaatgaaagaagactctccaataatatttttaaacaaagtaaatcaagtctaagtgatggttatactatgttgcacttttggtttttatgtacagattttaggccttaaaatgtagagtaattaatagttctggatttattactagcattgcaagttaaattgagacttttgttttttactatagacaaattgggatttgatattagggaatttttcatgtaacttaattttattcctttgagggctcaaaaacttaaaagattccaattaattttcgtagaagtctttctaaaatatattgcatgcttccctgttttactaatcaggtaatatgacacaaaatgtatatattttttgatgacctagggtcataatacagtagactaggaacttcagtacccttcaaacaattatgtcaccctgggtaaattcttcaatctactcgagccacaaaatttaaaatttggttactgagtttgcaacttaaacattttgaggattaataataataatgaatatgtcttgaattaactgtaaactatatgaatattaactataaacttatacatttggcttattgtattatattatatataacatatataactgatatattataaatgtcaattattttactgtgctataataatgcccctagtgatcattgagattattagcactttgattttatggttatttttcaattatgaaacttaagagtttttgtgtctgcttgatatatatatctttttgtatatatgtatttttttggtgtgtgtgttggtttctccttcaatatcaggttgcaggctattatttcttgcttagttgcaaataatttctaattttctcctatttacctatagattataaaattagataatcaggaaattctggactgtatttgaaatatgaacaagtatgttctggaggtgttgctgagagattctgggaaatacatatgatctttagtgcatgaactacatgctgacacttttggcttctgaggctttgttgtccacatttttggctatgttctgaataatggggattgccagataattatctactgaataagtaagatcactagattacttttaattgtgatccaccaaaagatggtttcagttctataagtaagtggttttcaaaatactttggaggagtctttaatgtaaaaataaaggcattgattgatgatgatttttttcctgaactactagggaattttaaatcattttttccttgcaagtaatggttaattttctcttcgtcctctttgttaccatgtgttacagttgattttgtataagagagacacttacagaatgagacagtagtcctttaagagtcatttattactgtatttctactagtaatgaatgttttcatactctacagatttttttttgcaatatgtatgttttagacatcagaaattcaggcatctttagtatatattaatgtatataatataaatatattaaatgcagatattaaatgaccaaaaacatgctcatcaaatttacctatctcacaaatctggaacagtgaatataacggattaaagaaacaaaacttaaaatgttttgacaaactgaaactatgaacttaaaaataacctaccaagataaaatttaatagatcttattatcaagttcagaagttgtgacccaaatcccagctgcacaagtaattactgaagaaaattcaaataacagccagatgaatgattaaaaaaaaaaacctatgagttttaagtgacagaaaatgcaatggggtcagcatagtgaatattgccaaaaaaattgccagtgctatttcagtcagcatcactagaagtacagtatgatgcattcaagagttggtagtcccactaaactcactgctcaatagaatgtttgtgaagtattgtgttgagttcagaattaccacactttaagaggaactcaaaggcattgggatattctcagagaacaattggtataatcgcagagatgaaattatataagaagaagaatggttgaaggaattagtaatactaaccccagagaaaagcaaatcaaggatgacatgatggtgtctttaaagattcaagtcacatggaggagggattgggtttatactgtctagcttcctggggatagaatacagatcagtgacaagaagttatgaggaacctgattatggctgataagaccaactagctaacagctgtagctgtctatatggaatattctcccttggaagatagtaactgatctatccttagagatatgcagcaatctctattgtcattttaatagaggtgttgtagaggacagaagtttgatcttttttccaatgccaagactatgaatttttatgaacattcttataaaatattctacagtttatggtatatctttttttttacagcacttttcaaggactacatagtattgtgattatttttctacatattcttcttctgtgaaatgcattttattaaaactcaaggattcttaatttttctttctgtgaatccctttgatagtctagtgaagcctacagatctttttttaaaaattattttaaatgcataaggtaaaatacacagattacagagaaaatgaatcatattaaaacagtaaataggccaggcacggtggctcactttgggaggctgaggcgggcagctcacgaggtcaggagatcaagaccatcctggccaacatggtgaaacctcatctctactaaaaatacaaaaattagccaggcatggtggcaagtacctatagtcccagctacttgggaggctgaggcagaagaattgcttgaacccgggaggcagaggctgcagtgagctgagatcatgccactgcacttcagcctgggtgacagagcgagactctgtctcaaaacaaacaaacaaacaaacaaccagtaaataatttaaaacatttgtgatatggtagaatatgctattccactaatgcattaagaaaacaagatcttatagagggcctaacagtataataattttgaaatagtgataagcgtaaaagatattttgagatatctccaagtataatgtaatataaaatatcaattgtgatactattggtgacaatgtcataggaaccacaaatacagtatggtttgttacttgcatccataatttaaggaaatgtaaattttcaatacagtctagtgaaaaataatttttccacaaaagtttacagaccccttgaattctatctatgtctgctggagtctgtggaccaccagttaagaatccctatgctagatgatatggtacacccataatgaataaaacaatggtctctaacttttaataattcatattccagtaagagatataaggcatataaaaatgaactctaattcagtttctagtatataataaattccatagagctatatagataaaatattatgggaatttactagatagaaaaattacttctgccttggaagccattggaaggttctgtagggaaatgggtcttagttggtcttggagaatgaaaggatttatatagacagaaattgagaggagaaacatttcaggcagaaagaataggcagaggactttaaaacggccaatagttcaggttctaaattaaaaaaagaagatgcatatgggatataagactgaaaaagtaggttgtgttcagatcatggaggccctttgactcttgcctaaggagtttgaactttatattgaaggcaatggaggaaccactgactgttttttagcacaataagttggtggattagagctttctttcaggaaagttaatctggctgcactgtttaggatgaatgggagcagggagagacattaaggaaattgtttcaagctagagataatgagggtctgctgaacgaaggcagcagaaatgaggaaggaagggggatgcatatggaaaagatattaagagatagaattgttaagagttaatgtttaagtgtagagaccaagacagaagaatggttcaaagagtgctcagaatttttaaactctgggcaaataggaacgtggtaatacaattaaaaaaaaaaaaaaaggaggaacatgttttggacatgggagcaatgagaatttttttattctgagtttggtatcttgagtttgaatcctaattttgattatctacttggagcatagtatagaatagcataatgggagaacagaaataattatagaaagggtcattaaaaagtttaggatagatttctgcttctcaaataattatattctaggtctaaggaggtataacagctccaccaatatttgcctgacattgatcctttaaagttccaggtccatctcctcatttgggatgtattatctcattggacacctaaaagtcttcaaatgcattacccacctctccctcacatctacttcatggtttgagggccatatttcatgattagctgagagacaagcctgtgtgattgacatgataaatgattacctttcttgcattattcttgttctggagaatatttttactctttatcagactaaatacctctccctcatttgccctcatctacaagaactgatctgtaaaaagttcattatggtccttttaaaaactatatttgcatgatgaaacaaaaactctccaggcagatgctttgatcaaccaaattgtccagtgtttaatctgctattccttcaagaaatgccctctcctgagcagtgatttgaccagattgtaaaacattgttgaacaagggtgctacatctgaagtgccccctctgaaactgagacttatgggaagataggcaaagtttctgtcttttgtaaatttaactttgatttagtattatagattggtaaattggtatgtaggtaggtagacagatccatagatggattgaatgattgaatgtcagaaaccaccttttaaaacattggtagatagagtgtacaggaaagctttgattaatagattcaggttaagatgcttccaaggctaaaattcttcagctataataaaatgatgaattttagttatccttgtatcacccgtcttgttgccaatatagctgggctctaacataagcgacagaaaatgaatactttaaaaaggacttctatatctaaatacatatatttaatcagagagtcctttggcttctgaaaataagttgtctaatgagaatttcacttgagcagctgtgactgaggaggtcaacaggcactgcctaggagaatatggcccagctggttaaatctggttgttgtcgtgatttaaatggtcaagtgctgcttgtaatccaggaccgtctgtttgtaaagggaagagtgagtgcttcagcataatgtacagctgttttaatctctctttaataatagtgcttcagccactatcatgtcttgtgtatcatactactaagtatatgatcctaggccgagggccctggtttgagtcaggttctggagtcatgtgagattgcaggaaaagggatacaatgataaaactctcaactgtctgacaaaataaaactaaattcctgactctatggctctttttaaaaacttattctttaggtaataattattgtgattaggagagagtgacaaagcttgtagttaggtagaaatattagaataaatgaactctctttgttagagccataaatgtaatggaaagtatgcaggctttgatacaattccataggacatacattggtcagaaattagagtatttgcccagtggaattgtgtgctttctgctatcatggtaataaaagtatgtggattcattttactgtgcatgtaagaagggacagcagcatttgagctttgaattcctggtgggacaggctttccaatggattatgcagctgtttcccagcacaagaatgagcatgtgtttatgtgtatatttgatggattattatcattgttcacatctctaaacaatcatttgtatttctacatatattttcactgaaatatatttactttgcttataagttgtgttttgctcctctgatagactttgctctactaaaagagatatatggtatagtttaaacaatgaggaaattcatttttaaaagtcatgtctttgagctagatctgagtttgaatctaagttttaatatttagagagacagtatagcctactgagtgtagactctggagctaggttgcctgtgtttgaatttcacttcagcatttcctagatggatgacatagagcatgttacttgatctctctgcttcagtttctcaaccaaaaaatgagtatctttacagtgttataaggatcaaggttttcatgaagatgaataattagttaaggcaactaaagcatttagaacattgccagctcaaagtaggtgctcaataaatgtagccagcattatttcctggttgtgtgactttggacaaattaatctctttgtgcttcagttccctcatctgtaaatctgtatgaatgatacctgccttgcagggttattgtgaggatttgacatattaatatatacaatatttagcttctgtaattataactattactagtattgctattataactactattgctgttattatttgaagaaacttttaaaaaagaaa

SEQ ID NO: 20144 - DNA, 1202 bp, Homo sapiens
  ENST00000533658
atacgtagacaatatccaacctggacaaaacgggcttcccttgcgagccgacctaaaccgcatcccccaaagaatagagactaaatgcaaagtgagaagaaacagttgaaggactaggaagaggatcctctagggatgagctggtcactttcatgaattcaaaggcaatttaccagtgatttctgggtgctggggctgatattttttgtgcatatttctcacacagtttgatataaacttaagtgaatgaattcattaataaaagcagattttctatttttatttcacctctgggctattttatacctttggagcacacaagcacaacaaaagaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatggaatcagagaataataagttatgttccctatattccttccgaaatacctctacctcaccacataagcctgacgaagggagtcgggaccgtgagataatgaccagtgttacttttggaaccccagagcgccgcaaagggagtcttgccgatgtggtggacacactgaaacagaagaagcttgaggaaatgactcggactgaacaagagggtatgtgtggacttcactgttgggctctgttttttttcttctaaagattccaggccttaaaaaaaaaaaaaaagtgggatttcaagggtcagagaagtgcataattgtcactagctaggaaaaagttattcagaggttactatggtgatggcagattttgatccattaggagtgttaaacagatagctccgtttttctaaaactttgtgcattttatttggttcttaagataacaaattaggattttaaactgaccataatcctactctggaaaaaggtaacaagagaattttcctaactgcaactttatttttcattttttctcccctatttccttttggtggatagtatttctttataaaaatgtcaactgtttaaaaagcaaaattaaaaatatttctcttcatttttataaatata

SEQ ID NO: 20145 - DNA, 534 bp, Homo sapiens
  ENST00000526673
gtggaggtagaggatgatttcaattagaaataatgacagcaatagacgcttccaatgaagatatcgtggccaccaaaggacaaaggcaagaagttaattcctgaagtcgagaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatggaatcagagaataataagttatgttccctatattccttccgaaatacctctacctcaccacataagcctgacgaagggagtcgggaccgtgagataatgaccagtgttacttttggaaccccagagcgccgcaaagggagtcttgccgatgtggtggacacactgaaacagaagaagcttga

SEQ ID NO: 20146 - DNA, 549 bp, Homo sapiens
  ENST00000529469
aaagaaagagcaagccccataatggcagcatctttatcttgcacactagtctgtctcttgtgcctgtaacaatgccaggaactttagtaactatttttttttgaattttgacaatcttggtcgacaagggtaaaaaaggacattccagaagcagaaaaacatgagcaaaagtatggagacatcaaaggtcatggcatatgttcgtttatcatggctggaatgaggggtatgaggaagatgactgagagtgtgtactttggagtcagtcagagcagagttgacttcattttatgctacctttatgattaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatgg

SEQ ID NO: 20147 - DNA, 660 bp, Homo sapiens
  ENST00000525835
gaatacttacgacatggccgctcacactgattgccaagattgacagcactaaccatcgccttcacttgttccagggtgaagcccctagtcaccccgctccgcgcgcacctcctggaaccccggcggcaaacttctgccgctctgcgctgcccccacccggggcgggacacccccgcagacttgagttaacgggctacgccggccgcggcgctggggggttctgttcccttgctccccggactgtgacaattgacctagcaccgactccccttccttttaattttttttatttgtatctttccctttttctttaatgccatttactcctgcggcgcagcgcacaaggagccctcccgcgcggtaccatcctggagcccgcccaggtaaccgggacggagcgagcgatctcgagagcgagggaggcagagccagggcgcgcggcccgctgtgagctacctgttggggcgccggagggggcagggggcaggagcccagggccgggccgccgtcccccggcgtcttccgctcctgcccttccgggcactccagggtcactttcatgaattcaaaggcaatttaccagtgatttctgggtgctggggctgatattttttgtgcatatttctcacacagtttgatataaacttaagtgaatgaatt

SEQ ID NO: 20148 - DNA, 709 bp, Homo sapiens
  ENST00000524520
acagtcgtcaccgttgcggcccctcgccgccccggggcactttgggagttgtagttttctgattcattgcatactggcccgaataaaaaagatgtgtccgtgactaaaactacaattcccaggaagccccgaggctcaattcgcgctgtgtggcgggagtgccctcagaggccccgccttcggctggtggaggaagcgttcccgcggatgtgtatggcgaattgttggcacctggatggtaaatcttcaagttactgtgaaacaagatcacaaacgaaaaagtaacataggaaatactaaagactgggacattttatcagattttactcagtttcatatacagaaggctataggactgttttgccggattctaaatgacaacttttaaatcagagccttgaaatctacagaagtccaatatatactgaggaacaaagggaatgtggaaatgaaagagagagggagagagaggctggcagatgtaatgagacgcggtgaaggtgtacgcagactggcactcccactcctcccttctgctctcactgcagccctgggtaactcgcaggctaacacaaacagcttttctcccgcagcctgccctctgtcactgtcactttcatgaattcaaaggcaatttaccagtgatttctgggtgctggggctgatattttttgtgcatatttctcacacagtttgatataaacttaag

SEQ ID NO: 20149 - DNA, 574 bp, Homo sapiens
  ENST00000525259
atttctctccgaattcccaacacccggcagtgcagtaaatatttaacgggttactttaagggataaaccgtttgctattaaaacctatgaggtgagggctgaggaagggaacggcatttgatggggagacgagaattgttggcacctggatggtaaatcttcaagttactgtgaaacaagatcacaaacgaaaaagtaacataggaaatactaaagactgggacattttatcagattttactcagtttcatatacagaaggctataggactgttttgccggattctaaatgacaacttttaaatcagagccttgaaatctacagaagtccaatatatactgaggaacaaagggaatgtggaaatgaaagagagagggagagagaggctggcagatgtaatgagacgcggtgaaggtgtacgcagactggcactcccactcctcccttctgctctcactgcagccctgggtaactcgcaggctaacacaaacagcttttctcccgcagcctgccctctgtcactgtcactttcatgaattcaaaggcaatttaccagtgatttctgggtgctggg

SEQ ID NO: 20150 - DNA, 8865 bp, Homo sapiens
  ENST00000396356
gtcactttcatgaattcaaaggcaatttaccagtgatttctgggtgctggggctgatattttttgtgcatatttaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatggaatcagagaataataagttatgttccctatattccttccgaaatacctctacctcaccacataagcctgacgaagggagtcgggaccgtgagataatgaccagtgttacttttggaaccccagagcgccgcaaagggagtcttgccgatgtggtggacacactgaaacagaagaagcttgaggaaatgactcggactgaacaagaggattcctcctgcatggaaaaactactttcaaaagattggaaggaaaaaatggaaagactaaataccagtgaacttcttggagaaattaaaggtacacctgagagcctggcagaaaaagaacggcagctctccaccatgattacccagctgatcagtttacgggagcagctactggcagcgcatgatgaacagaaaaaactggcagcgtcacaaattgagaaacaacggcagcaaatggaccttgctcgccaacagcaagaacagattgcgagacaacagcagcaacttctgcaacagcagcacaaaattaatctcctgcagcaacagatccaggttcagggtcacatgcctccgctcatgatcccaatttttccacatgaccagcggactctggcagcagctgctgctgcccaacagggattcctcttcccccctggaataacatacaaaccaggtgataactaccccgtacagttcattccatcaacaatggcagctgctgctgcttctggactcagccctttacagctccagaagggtcatgtctcccacccacaaattaaccaaaggctaaagggcctaagtgaccgttttggcaggaatttggacacctttgaacatggtggtggccactcttacaaccacaaacagattgagcagctctatgccgctcagctggccagcatgcaggtgtcacctggagcaaagatgccatcaactccacagccaccaaacacagcagggacggtctcacctactgggataaaaaatgaaaagagagggaccagccctgtaactcaagttaaggatgaagcagcagcacagcctctgaatctctcatcccgacccaagacagcagagcctgtaaagtccccaacgtctcccacccagaacctcttcccagccagcaaaaccagccctgtcaatctgccaaacaaaagcagcatccctagccccattggaggaagcctgggaagaggatcctctttagatatcctatctagtctcaactcccctgccctttttggggatcaggatacagtgatgaaagccattcaggaggcgcggaagatgcgagagcagatccagcgggagcaacagcagcaacagccacatggtgttgacgggaaactgtcctccataaataatatggggctgaacagctgcaggaatgaaaaggaaagaacgcgctttgagaatttggggccccagttaacgggaaagtcaaatgaagatggaaaactgggcccaggtgtcatcgaccttactcggccagaagatgcagagggaggtgccactgtggctgaagcacgagtctacagggacgcccgcggccgtgccagcagcgagccacacattaagcgaccaatgaatgcattcatggtttgggcaaaggatgagaggagaaaaatccttcaggccttccccgacatgcataactccaacattagcaaaatcttaggatctcgctggaaatcaatgtccaaccaggagaagcaaccttattatgaagagcaggcccggctaagcaagatccacttagagaagtacccaaactataaatacaaaccccgaccgaaacgcacctgcattgttgatggcaaaaagcttcggattggggagtataagcaactgatgaggtctcggagacaggagatgaggcagttctttactgtggggcaacagcctcagattccaatcaccacaggaacaggtgttgtgtatcctggtgctatcactatggcaactaccacaccatcgcctcagatgacatctgactgctctagcacctcggccagcccggagcccagcctcccggtcatccagagcacttatggtatgaagacagatggcggaagcctagctggaaatgaaatgatcaatggagaggatgaaatggaaatgtatgatgactatgaagatgaccccaaatcagactatagcagtgaaaatgaagccccggaggctgtcagtgccaactgaggagtttttgtttgctgaattaaagtactctgacatttcacccccctccccaacaaagagttattaaagagcccgcatgcatttgtggctccacaattacatcagcagaatggtcttaattgtttcgtaaagtgtgagacagattaagttttccctgatttttcatgaacttgagttttttgttgttattgttattgttgttgttgttgtttttttaatttaggtgaagacatattaaatatgagacaccaggacttgaaacttatctcaacccgtagatgtcttacaagtcttatatttttgtcttactttttttttcttttggatgttgataaaggtttaagttactgttttagatggggttaaacattctcactcaggtatgctgtgccggcctacaggttgtgaatgtgtttttattctgaattattttagaaaacaactgaggatttcatattgtgaaacagaacaagtccacggcgtgtgcagctgcatgtagagcatattcaaaaggcctcggaattccaattttccatttgtagagttaaactttgaatgtgccaaactttttcgtaacttttgaatcttaatattttgaaagtcttaaaggagacactgcaaagtcttagacaatctttggcatcttaaaataaaatagcaaaccaacatttttttttccagaaaatggtaaggtactcaggaatctggagacaagatattgtaaggaatgaacaaggttgccacagtgcatggacccaattgtgtttgcctgttgacgtgccatcagtgcgtgatgtggtatgacatacacacaccagagcaaccgccacaccagatatcgacagagtggtcttctctgcctgagaccacctctcactacatccattatccctttgcctttaaccctgacattcagtcttaacacattttatcttaaataatttattcattccagaatgtcaagggtccacttgctatttattttttttcaattgttggtggcattaatttaataattcttgtttttcaccttccttccccgaagaacttttccgtccttttcacctccttctcctgtgtacatagtgattttatgtccccagaacgcctggaagcatttctgaaaccaagatattattaaaaacctattattgtttttaatcatgagtatgtatctggctgcagggctgtgtattgggatataggtatatagtcttacacttaaacaggtatgcccctgaggttcactgtgacctcaagtcttttgccagaattttcccctaattcagttcacaagtggtagggtctgcatcagtggcatttccccctgaattccattcagcagcaaggttcaacagtggtgactgccaggcaggagagtcctgcggccaaacctgaagcccaaggctcgtgggccatgcaggaatctcagtgaagctgtcatgggctggcacctttacactgagttgccttgtcccagctggcacatctagggagttcattgcaaaatccccaggatgcaaaaagccacatgacagcctcagagcaaagatggtggcaaatagtcatgatacatctagagaatgaaagaaaactgtaagggaggagaaggaggggaatacattccctatatgggatgttcctactgttaactctggggaacagatagctccgggggcagcagatgagttcctctggctgactctatctgtagccacatggggacctgcctacgtgtgaacaaaatgaactgcacttatcacacaaggatttctttgaagacatgctactggggtgggaagcagtgaggttttattccccatctcctaactacagggagctctgccatgtcattttggccttcctgaaactaggacaggttgtctatcggggggcttcccccagagaggtttagtgggagaatgtcagtgaatgggatagttcacctcatgggacaacccagaatctgatcaccaggacataggaatggccccatcagatttcttgagccattttgtcacttggaagaaaatagtgtacctttgtatttatttaagagtgctcaaggcctaatagcaataaacaggtctagccaagaaattacaagctattctgttagctgggagtgctctctataagctgattaaggtactgataggaactctttgttattcatgttggttggggattagaaatttgtttttgtacatttatttcaaatgaggaggaggtcattttttctctcaaaaaatgagtatttattattgtcttactgatttctttgattatatacctctcctcctcagttcactcttgttttttttctttctctttggcttttgcttttgctctctctcacttctttcttattttgttgcattggtagagtgttgtatggctagcattgtattgtatgtaattaattttgcacaaaagcaaacatttagcatagtaggttaattttgtttgtttttatgaccatgccaaaataatattctgggctggtggagaacaaaggactgttctttaggactgaaacttgattttgctcatagtaagtaaaaaaaaacaaaaaacacacacactcacagatgttgtttcgtaagtgttataagcactggatataaatggtattttttatcacttctgactaatgtgaaactgttgtacgaaaactacatgaacaaaagtcatctgtttcgactcgtgtgggcttgcctcacagttgccggatttgagtcatttttatgtcttgttatttcatttatttatgcaaaatacatgtgtgtatgaacactttgttttagctccagctctgcctcagtactggggttcatttacttttagccatgttcttaaaaatgaaaggctattcaggaatgatctgattgtaaacgtctttttcattggatcaaacagtaatgctgtatttgaatctaaattttgtgtataagcagtttatttattagccaagtttggctctaaatatccatggaaattaagaatgacaatcatagggatcaattcattttattttcagtggggcttaaacaaagtttatatgactttaccatctcattttagatttttctaattgtgtaaatataacatagaaatagaatttatttttggttcatgaatacttagtgagatataagttatgtatttcctttttgttctctatccatagatgttggtccaaactgaaagttgatgagtcactgtgcctctcggggtagtgagttatcagctacagtgagagagcagtgtttggcctgcagctgggacagcaaaacgtttcaccagggttctcatgcagttcagaacccactgtccacagatccagacatttcccttttttcttacagaaagttgatgattggacatactaaatttccactacagttaggagacagtcagtttgctttgggagtctacataaatcttctaagatagttctgtgaccatttaatagcaagaagcatgaatgccactacaaaggcaaaaatccacctctgagatcggccgttaataaacgtcccgtcatgtcagtttagattcaagaatgttaagcaactttgtttttgcggtgctccctatttcatagtatcttcaaatcaaaaataaaaattatctccattttgttaaagaacttacagggtcagggttctccttgtcacttagaattgggacactgccaggcaatcctctcccaaaaaaaaaaaaaaaaaaaaatagccatatggaatggaaggaaaaggagaaaagaaggaagaaaggaaaaaagtaggaagggagagagaaaaaaaaggtcgctttgcggatacgagccgctaggctgacaacttttctatttcattggcagatatgaagcagtgtcttttccagtaaggtacggaagctttgttgttttcatgtgtacccagctcagccttttagaagcacctcggtttgcttcattaggtatttgatactctccagccttgtcctcaggcctgatttgatttgccagggtcctgacaccaaagcccaggccaagttctaaattcaggtgtgggctcacagtgctattgagcttgtcgaattctggcctcccctgaacattagccccacgggagcctgagggtgtttgaaaagggcgtgatcactctagggctgaaattaaaggctgctttcttttccttctgaagccaggctgcttcttcggagtacaccctcctgagccaggagcacaagcactagcagaaagcagggattgtttcaggaaagcccatttaccctcagtaggaaggcagcctggtcacttgaacagcacagctgaggctgcttctctcaatttactcattttgcaaagaattgacctctaccaactcattagggagaggaaaaagaatcacttagtaattttaaatcatatgagaagtcctgtaccaagtgccaacaactgcaaagaaatgcagctagaggaatgtattgaaattactactgggtcttcctttttaatgagaaaatgacaaaaatggttgctgtagccctgcctgattttgtacacgtttgtctaagaattgagttggcacttaagctcacttctcaaagtataataatattgtatgacctcatttgtcctttcacaaaagcacttgcatcatttccttaagtcatctgctccctgacatgttttcttccctaataaacaacttctgtctgttattcctgccaatgatgttctgtttctgatgccatatcctattgagcgtgcccctgtactaatatcattgaaaatattgatatgcaaacacatttccttttcatccccattctatctttccctttggggacagattgctttccaaaagctcatgaacaaatatttggaatgctggtacctttggggcagaggtaagggtgggcggggtgggggcagaaaggtaatgcttaatgcagataactcttctaatcagtgtccatggcaatatgaacgcttgaagaaaactcagtgacatatcttgctcagtagtttcttattcctgaagaaccacaagcataaagtgaggcctcagtgctggtgctcttggagtatggggaatgtgcaaatatttaactgttttgtatgctgcacattgcaggtctgctcatgtgcattctccctttgtcttcctttgtcatatgtgtttttgcttttttgaaagtgcagtctttattgtaccctcctccagcttgtagcaaattagaatgcttagcatttatgttcattcattattgtatttgccatgtaaaatttttattaccttagacaagcttataagctgttactacataacttatcttactgtaactcttttatttcccccgacgttgtaatttgtttgtgatgtatattgtgaaattgtattctatgttaatttaatcagcacaattcactgacatgctggactgacatgctggctgctgtttcaaagtgtaaagtttgtgtagggctgttgggacaactgcaactctgttgtcaaggtactgtgctttggttcctatagcaacactgggtgtggcccttgaattgctaagggcatttaatacatcctggagcaaattttaactgcagattttctttgtagaaattctatgtataatgcaggtacctacttggcccatggctggtaactatttgggcaattagaaaaaaagaaaaaaacataaaaactagtgtctattgctgctttgaatatgtttgaaagtctgaaaatgtaaatagtttatcaaaaaaaaatcttgtacagtccagtgtaaagtttttaaatgaccttaagggttgccatcacatctttctcacactctcctcttgataataataataataaaaagtttgctaaggattaaagaaatgggaaaaataaaaaaaatctcttcaaatttacaggaatgaatcattgttcttagctttgttgcatacacaaacttcttggattttgttgtgcagtattgacgtgagataaagctcaacattgaataatctttcagtggtacttttcaaagtcttcccctcctctgcctcataattaagggaaaagacaaaattgaaagacacactgtctttatctatcctggtgtatgttggcaccttagctactttttttttttcctttttgcacaaggtgctttcctgatatgttcaacatgccatctttgggtgataatgtatatgccgtgatggggctcaggccccttaggggagtgtctataagaactgcctatttatgctcatttacctcaagactgtcctctctaccctaatctagttgtcatcactccatcttttgtactgctgttgacacttacaaattaaagataaattttgttttatga

SEQ ID NO: 20151 - DNA, 3049 bp, Homo sapiens
  ENST00000293894
ggcgagggtcggggccaccgcgcggcgacctcgggtcccggagcgaccgcagggcagccccgggcgccggccccggtgcgcgtctcctgtgcgcgcccctccgcgcgcggccccgatgctggacatgagcgaggcccgctcccagccgccctgcagcccgtccggcaccgccagctccatgtcgcacgtggaggactcggactcggacgcgccgccgtctcccgccggctccgagggcctgggccgcgcgggggtcgcggtggggggcgcccggggcgacccggcggaggcggcggacgagcgcttcccggcctgcatccgcgacgccgtgtcgcaggtgctcaagggctacgactggagtctggtgcccatgccggtgcgcggcggcggcggcggcgcgctcaaagccaagccgcatgtgaagcggcccatgaacgcattcatggtgtgggcgcaggcggcgcgccgcaagctggccgaccagtacccgcacctgcacaacgccgagctcagcaagacgctgggcaagctgtggcgcttgctgagcgagagcgagaagcggcccttcgtggaggaggcagagcgccttcgcgtgcagcacaagaaggaccaccccgactacaagtaccagccacggcgcaggaagagcgccaaagccggccacagcgactccgactcgggcgcggagctgggaccccaccctggcggcggtgccgtgtacaaggctgaagcagggcttggagatgggcaccaccatggcgaccacacagggcagacccacgggccgcccaccccgcccaccacccccaagacggagctgcagcaggcgggcgccaagccggagctgaagctggagggacgccggccggtggacagcgggcgccagaacatcgacttcagcaacgtggacatctcggagctcagcagcgaggtcatgggcaccatggacgccttcgacgtccacgagttcgaccagtacctgcccctgggcggccccgccccacccgagccgggccaggcctatgggggcgcctacttccacgccggggcgtcccccgtgtgggcccacaagagtgccccgtcggcctccgcgtcgcccaccgagacgggtcccccacggccgcacatcaagacggagcagccgagccccggccactacggcgaccagccccgaggctcgcccgactacggttcctgcagcggccagtccagcgccaccccggccgcccccgccggccccttcgccggctcacagggcgactatggcgacctgcaggcctccagctactatggtgcctaccctggctacgcacccggcctctaccagtacccctgcttccactcgccgcgccggccctacgcctcacccctgctcaacggcctggccctgccgcccgcccacagccccaccagtcactgggaccagccggtgtacaccaccctgaccaggccctgagggcccagccgcggggagggactcgcaggcgtcagggggcagccttgtcccggcccagtgtgtgtgaccagggcgggaggggccccagtggctgagctccaagtgcctgctgaagtctgcagggaaacacgcttgctgcccgtggccctcggcctccagatggccacacctctgccgacgacggaccagctccctctcccttctatctttctttttgaggtggtgggattattccacaaagaagggctgccgtttggtccctcttccgtgaggactggcggcaccagcaccttcgctttgcatctcggtagaggagaaacggcagcacagcccaaggaccaaaggagggggtggcaggggccttgcagggcgctgtgaggtccaggccggtcttggcgccgagagcccctgcactcaaggccacattccctcgacaacggctgcacgggctgtccgggatccggggtgtctgtccgcagactgggatgagtctactcgagcatctccgggacctgcctgtcagatctgaggtgtctccttgctggcagagtgcgctcacgcgagggctggctgtgatgaacacatctctcttttatttttatgtttttgataatttttatttttgaagcttaaatgtgtttcttctgaaagctgttaaagatgtatttatgttctgtgttattttatctttaattaatgaggtaattcgggcaaagagtagaatttaagacaaaacggaagctgggaagcttcccttgagggcaggcaggaggtggagttgcagctgttggccggcatcacgttgctcgttgctcggcttatgggaggccgccctggagggcccggaggtcccaaggtccctgggaggactgggcccctcatgcctcgagcttggcaaccgaaaacccgagggaggagaagggacctgccttgtgacatctctgatcaggttggggtgccccagcacccagtaccagtttggggtttgggaagcaggactccgtccctgtccccgactgtgccacgtggtaggacacataggacacaggaattcctgggtccttgcccatgactgtgccatgtggtaggacacaggacacaggaattcctggaaagtggtggcttcagaagtgatcttggctcgcaggcaccagtgccacctaccaagctgtgaaactaaaccttctccactaaacgtcgttagggcctcagttctagacgagtcatacctgattcacctgcactgcttcccctgtgtgctgagcatagagcatacaatagcgcctacttcacggaaacttgtgcctttaaactttgtaaacttaaacacagccgagaagttgcttctttgtactttttctacttttcctacttttttgtagaaaaaaaagataatgcctctgcttctatttctctgggggtgggggtgggggccgggagccgtcgcagacccgtttcatgcagcgtctcccttggcaccgcgttcggaggacgcaccctcactcccctgctgccttcactcctttctgaccaagcaacgctaacttttgtacagatcgatttgataaaattaaacaaagtgctttttatgga

SEQ ID NO: 20152 - DNA, 4153 bp, Homo sapiens
  ENST00000566034
acccggcggaggcggcggacgagcgcttcccggcctgcatccgcgacgccgtgtcgcaggtgctcaagggctacgactggagtctggtgcccatgccggtgcgcggcggcggcggcggcgcgctcaaagccaagccgcatgtgaagcggcccatgaacgcattcatggtgtgggcgcaggcggcgcgccgcaagctggccgaccagtacccgcacctgcacaacgccgagctcagcaagacgctgggcaagctgtggcggtgagtgccggcgccccgggggcggggttcgggaccttggccgcccctggtctcggactgcgagcgggggcctggagggcgcagagctcgcggaggtggtggccacacgcaggctccgggctctgcaccccgggcgggtgtcagggcgggtcccagtggaaaaacatcctctggccagccggggtccggcgccagctatgggagtcgggatccgcggagggcagcgcctggggtgtgcaccctcgtggcgggtgcgctctggagccagttctcctggcggggaacaccctgcggagggccatggctggcaccccgacgtgccctccagccgttgcgagtggccccagccccgggaggcacgcccggcacgacagcaagttgcatgcggctctctggaggtgctccctccttagaaagggctcagctcctctagctcctggaccacccatggggagggagtgcggcaggcggatgggtgggcagcaggtttgcctgcgagtaccctccccgcagtttctccctctcctggacaccctcggtccgaagcagggagggcaggagtggagatgacggggtgcgccgtgtgcacgccttggcgtggtggggccggtcagttttccagaaattaggactgcagagtgaagaacttgttgctcaggacaggccgcccccaccgagtgtcctctggttgggtttcaaatggttctcttggtttggggctctggttcccgtatcctgctcctcacctggaagaagggagcttggagcttgcgtatttgcacctcctgccttctgtctggatctagggcgcagccacggggcgctgtggacggcaggcccctgctcccccaagtcctgccgcacaggcggttggaggtgagcctcgggaagagtcccaaggagtgtgtcctgtggctcagtgaggacgggcgcctgggccctgccagggcttctgggtgtctgggaatggagggacagcagcccagctgcccgccgaaggccggcaccgttcccgggaagcctcgcttttgtccaccgccggctgggtcctgcccgcctcccccgcctcccttagaaagccccagagggagggaacagcaggcccggaatagggggaaatagaaggaggaagatgggaggcgtggggcttgttcttctttggctgtcgtaagcataccaaccttcccaaacaggcgccggccggttctcccagaggagtgtactgcctggtgccacgggaggctccggagcgcacggcaggcgggtttccctggtcagagcctcctggccccggcctctgctgccggttccccctgtggtgtgtgcctgcgccgagggcacagtgggcgccctggccatccctgcctctgccctgtgctgcagcttgctgagcgagagcgagaagcggcccttcgtggaggaggcagagcgccttcgcgtgcagcacaagaaggaccaccccgactacaagtaccagccacggcgcaggaagagcgccaaagccggccacagcgactccgactcgggcgcggagctgggaccccaccctggcggcggtgccgtgtacaaggctgaagcagggcttggagatgggcaccaccatggcgaccacacagggcagacccacgggccgcccaccccgcccaccacccccaagacggagctgcagcaggcgggcgccaagccggagctgaagctggagggacgccggccggtggacagcgggcgccagaacatcgacttcagcaacgtggacatctcggagctcagcagcgaggtcatgggcaccatggacgccttcgacgtccacgagttcgaccagtacctgcccctgggcggccccgccccacccgagccgggccaggcctatgggggcgcctacttccacgccggggcgtcccccgtgtgggcccacaagagtgccccgtcggcctccgcgtcgcccaccgagacgggtcccccacggccgcacatcaagacggagcagccgagccccggccactacggcgaccagccccgaggctcgcccgactacggttcctgcagcggccagtccagcgccaccccggccgcccccgccggccccttcgccggctcacagggcgactatggcgacctgcaggcctccagctactatggtgcctaccctggctacgcacccggcctctaccagtacccctgcttccactcgccgcgccggccctacgcctcacccctgctcaacggcctggccctgccgcccgcccacagccccaccagtcactgggaccagccggtgtacaccaccctgaccaggccctgagggcccagccgcggggagggactcgcaggcgtcagggggcagccttgtcccggcccagtgtgtgtgaccagggcgggaggggccccagtggctgagctccaagtgcctgctgaagtctgcagggaaacacgcttgctgcccgtggccctcggcctccagatggccacacctctgccgacgacggaccagctccctctcccttctatctttctttttgaggtggtgggattattccacaaagaagggctgccgtttggtccctcttccgtgaggactggcggcaccagcaccttcgctttgcatctcggtagaggagaaacggcagcacagcccaaggaccaaaggagggggtggcaggggccttgcagggcgctgtgaggtccaggccggtcttggcgccgagagcccctgcactcaaggccacattccctcgacaacggctgcacgggctgtccgggatccggggtgtctgtccgcagactgggatgagtctactcgagcatctccgggacctgcctgtcagatctgaggtgtctccttgctggcagagtgcgctcacgcgagggctggctgtgatgaacacatctctcttttatttttatgtttttgataatttttatttttgaagcttaaatgtgtttcttctgaaagctgttaaagatgtatttatgttctgtgttattttatctttaattaatgaggtaattcgggcaaagagtagaatttaagacaaaacggaagctgggaagcttcccttgagggcaggcaggaggtggagttgcagctgttggccggcatcacgttgctcgttgctcggcttatgggaggccgccctggagggcccggaggtcccaaggtccctgggaggactgggcccctcatgcctcgagcttggcaaccgaaaacccgagggaggagaagggacctgccttgtgacatctctgatcaggttggggtgccccagcacccagtaccagtttggggtttgggaagcaggactccgtccctgtccccgactgtgccacgtggtaggacacataggacacaggaattcctgggtccttgcccatgactgtgccatgtggtaggacacaggacacaggaattcctggaaagtggtggcttcagaagtgatcttggctcgcaggcaccagtgccacctaccaagctgtgaaactaaaccttctccactaaacgtcgttagggcctcagttctagacgagtcatacctgattcacctgcactgcttcccctgtgtgctgagcatagagcatacaatagcgcctacttcacggaaacttgtgcctttaaactttgtaaacttaaacacagccgagaagttgcttctttgtactttttctacttttcctacttttttgtagaaaaaaaagataatgcctctgcttctatttctctgggggtgggggtgggggccgggagccgtcgcagacccgtttcatgcagcgtctcccttggcaccgcgttcggaggacgcaccctcactcccctgctgccttcactcctttctgaccaagcaacgctaacttttgtacagatcgatttgataaaattaaacaaagtgctttttatgg

SEQ ID NO: 20153 - DNA, 3935 bp, Homo sapiens
  ENST00000245479
ggagagccgaaagcggagctcgaaactgactggaaacttcagtggcgcggagactcgccagtttcaaccccggaaacttttctttgcaggaggagaagagaaggggtgcaagcgcccccacttttgctctttttcctcccctcctcctcctctccaattcgcctccccccacttggagcgggcagctgtgaactggccaccccgcgccttcctaagtgctcgccgcggtagccggccgacgcgccagcttccccgggagccgcttgctccgcatccgggcagccgaggggagaggagcccgcgcctcgagtccccgagccgccgcggcttctcgcctttcccggccaccagccccctgccccgggcccgcgtatgaatctcctggaccccttcatgaagatgaccgacgagcaggagaagggcctgtccggcgcccccagccccaccatgtccgaggactccgcgggctcgccctgcccgtcgggctccggctcggacaccgagaacacgcggccccaggagaacacgttccccaagggcgagcccgatctgaagaaggagagcgaggaggacaagttccccgtgtgcatccgcgaggcggtcagccaggtgctcaaaggctacgactggacgctggtgcccatgccggtgcgcgtcaacggctccagcaagaacaagccgcacgtcaagcggcccatgaacgccttcatggtgtgggcgcaggcggcgcgcaggaagctcgcggaccagtacccgcacttgcacaacgccgagctcagcaagacgctgggcaagctctggagacttctgaacgagagcgagaagcggcccttcgtggaggaggcggagcggctgcgcgtgcagcacaagaaggaccacccggattacaagtaccagccgcggcggaggaagtcggtgaagaacgggcaggcggaggcagaggaggccacggagcagacgcacatctcccccaacgccatcttcaaggcgctgcaggccgactcgccacactcctcctccggcatgagcgaggtgcactcccccggcgagcactcggggcaatcccagggcccaccgaccccacccaccacccccaaaaccgacgtgcagccgggcaaggctgacctgaagcgagaggggcgccccttgccagaggggggcagacagccccctatcgacttccgcgacgtggacatcggcgagctgagcagcgacgtcatctccaacatcgagaccttcgatgtcaacgagtttgaccagtacctgccgcccaacggccacccgggggtgccggccacgcacggccaggtcacctacacgggcagctacggcatcagcagcaccgcggccaccccggcgagcgcgggccacgtgtggatgtccaagcagcaggcgccgccgccacccccgcagcagcccccacaggccccgccggccccgcaggcgcccccgcagccgcaggcggcgcccccacagcagccggcggcacccccgcagcagccacaggcgcacacgctgaccacgctgagcagcgagccgggccagtcccagcgaacgcacatcaagacggagcagctgagccccagccactacagcgagcagcagcagcactcgccccaacagatcgcctacagccccttcaacctcccacactacagcccctcctacccgcccatcacccgctcacagtacgactacaccgaccaccagaactccagctcctactacagccacgcggcaggccagggcaccggcctctactccaccttcacctacatgaaccccgctcagcgccccatgtacacccccatcgccgacacctctggggtcccttccatcccgcagacccacagcccccagcactgggaacaacccgtctacacacagctcactcgaccttgaggaggcctcccacgaagggcgaagatggccgagatgatcctaaaaataaccgaagaaagagaggaccaaccagaattccctttggacatttgtgtttttttgtttttttattttgttttgttttttcttcttcttcttcttccttaaagacatttaagctaaaggcaactcgtacccaaatttccaagacacaaacatgacctatccaagcgcattacccacttgtggccaatcagtggccaggccaaccttggctaaatggagcagcgaaatcaacgagaaactggactttttaaaccctcttcagagcaagcgtggaggatgatggagaatcgtgtgatcagtgtgctaaatctctctgcctgtttggactttgtaattatttttttagcagtaattaaagaaaaaagtcctctgtgaggaatattctctattttaaatatttttagtatgtactgtgtatgattcattaccattttgaggggatttatacatatttttagataaaattaaatgctcttatttttccaacagctaaactactcttagttgaacagtgtgccctagcttttcttgcaaccagagtatttttgtacagatttgctttctcttacaaaaagaaaaaaaaaatcctgttgtattaacatttaaaaacagaattgtgttatgtgatcagttttgggggttaactttgcttaattcctcaggctttgcgatttaaggaggagctgccttaaaaaaaaataaaggccttattttgcaattatgggagtaaacaatagtctagagaagcatttggtaagctttatcatatatatattttttaaagaagagaaaaacaccttgagccttaaaacggtgctgctgggaaacatttgcactcttttagtgcatttcctcctgcctttgcttgttcactgcagtcttaagaaagaggtaaaaggcaagcaaaggagatgaaatctgttctgggaatgtttcagcagccaataagtgcccgagcacactgcccccggttgcctgcctgggccccatgtggaaggcagatgcctgctcgctctgtcacctgtgcctctcagaacaccagcagttaaccttcaagacattccacttgctaaaattatttattttgtaaggagaggttttaattaaaacaaaaaaaaattcttttttttttttttttccaattttaccttctttaaaataggttgttggagctttcctcaaagggtatggtcatctgttgttaaattatgttcttaactgtaaccagtttttttttatttatctctttaatctttttttattattaaaagcaagtttctttgtattcctcaccctagatttgtataaatgcctttttgtccatcccttttttctttgttgtttttgttgaaaacaaactggaaacttgtttctttttttgtataaatgagagattgcaaatgtagtgtatcactgagtcatttgcagtgttttctgccacagacctttgggctgccttatattgtgtgtgtgtgtgggtgtgtgtgtgttttgacacaaaaacaatgcaagcatgtgtcatccatatttctctgcatcttctcttggagtgagggaggctacctggaggggatcagcccactgacagaccttaatcttaattactgctgtggctagagagtttgaggattgctttttaaaaaagacagcaaacttttttttttatttaaaaaaagatatattaacagttttagaagtcagtagaataaaatcttaaagcactcataatatggcatccttcaatttctgtataaaagcagatctttttaaaaagatacttctgtaacttaagaaacctggcatttaaatcatattttgtctttaggtaaaagctttggtttgtgttcgtgttttgtttgtttcacttgtttccctcccagccccaaaccttttgttctctccgtgaaacttacctttccctttttctttctcttttttttttttgtatattattgtttacaataaatatacattgcattaaaaagaaa

SEQ ID NO: 20154 - DNA, 2033 bp, Homo sapiens
  ENST00000375281
gcgagcgagcggggcgcggcgaggggcaagggcggggagggccccggcgctcagagcaggcgccagggaggcaggctgggcggcccttcgtcctcgccttcgggtgtccatgcctcggcggcggcgtcccgctccgcagccaggggcctgcaagccgtagccatggccgcggtggccgtcctccggaacgactcgctgcaggcctttctccaggaccgcacccccagcgcctccccggacctgggcaagcactcgcccctggcattgctggccgccacctgtagccgcatcggccagccgggcgcggcggcgcccccggacttcctgcaggtgccctacgaccccgcgctgggctcaccctccaggctcttccacccgtggaccgccgacatgccggcgcactcgccaggcgcactgccgcccccgcatcccagcttggggctgacgccgcagaagacgcacctgcagccgtccttcggggctgcgcacgagcttccccttacaccccccgccgacccctcgtacccctacgagttctcgccggtcaagatgctgccctcgagcatggcggctctgcccgccagctgcgcgcccgcctacgtgccctacgcggcgcaggccgcgctgccgccaggctactccaacctgctgcctccgccgccgccaccgcccccgccgcccacctgccgccagttgtcacccaacccggcccccgacgacctcccgtggtggagcatcccgcaggcgggcgccgggccgggggcctccggggttccgggaagcggcctctccggcgcctgtgccggggccccccacgcgccccgcttccccgcctctgcggccgctgctgctgcggccgccgccgccctacaaagaggcctggtgttgggcccgtcggactttgcgcagtaccagagccagatcgccgcgctgctgcagaccaaggcccccctggcggccacggccaggaggtgccgccgctgccgctgtcccaactgccaggcggcgggcggcgcccccgaggcggagccggggaagaagaagcagcacgtgtgccacgtgccgggctgcggcaaggtgtacgggaagacgtcgcacctgaaggcgcacctgcgctggcacacgggcgagcgacccttcgtgtgcaactggctcttctgcgggaagagcttcacgcgctcggacgagctgcagcggcacctgcggactcacacgggcgagaagcgctttgcctgtcccgagtgcggcaagcgcttcatgcgcagcgaccacctcgcgaagcacgtcaagactcaccagaataagaagctcaaagtcgctgaggccggggttaagcgggaggacgcgcgggacctgtgagccctcccggaggtggacccccttcccagcacctctgcgagagatccggggacctgtgggcagctggcggaggggagactcagcagacggaccctctccgttgcctgcctcccaaaatggagccaggcttccaacttccgctgccttcggacatagggacccagttcccaggagcggggaggtagggttggggctggggcatttggattgtaattgggagctctgccgtacgccagggcggttccaaactctaaaccgttcccaccgtcagggagacctacagtttcgggggaccaccctggtctggccttgtatataggaaatgctgctgaactgaatagaaaggaacttgggagatttgaaacagtgctcgggttttcgctaggaccggtttgggctttgtacaggttatttaatagctttgttaaagataattataataattataacattaataaaaatgttgcttttgtcttcagctccatgcagagctacagcatgatatgtctctgtaaagtgatcagcagttgcagcgtgaaaataaatactttaactcaggggtcactacaggaagaccccgttgagccggtctcatttgatcttttcttcttctgggtggctgtactaagcggtcgggtttccccgggaatttgatggttcctatagtctgcctg

SEQ ID NO: 20155 - DNA, 257 bp, Homo sapiens
  ENST00000487037
agaagcgctcgcgggccccacgttcaggaccgcacccccagcgcctccccggacctgggcaagcactcgcccctggcattgctggccgccacctgtagccgcatcggccagccgggcgcggcggcgcccccggacttcctgcaggtgccctacgaccccgcgctgggctcaccctccaggctcttccacccgtggaccgccgacatgccggcgcactcgccaggcgcactgccgcccccgcatcccagcttggggct

SEQ ID NO: 20156 - DNA, 547 bp, Homo sapiens
  ENST00000580377
caactgccagcctatggccaccaattggatccaggagaaagtgtggctctctcaggaggtggacaaactgagagtgatgttcctggagatgaaaaatgagaaggaaaaactcatgatcaagttccagagccatgtaagaatgtccatgccattccagggccatttcctaccatcgttaacaaatgccccgccatgtttcccctgtcctaccaagtttgctcttttatgcataggacttataaaatctgtttgctttctagagaaatatcctagaggagaaccttcggcgctctgacaaggagttagaaaaactagatgacattgttcagcatatttataagaccctgctctctattccagaggtggtgaggggatgcaaagaactacagggattgctggaatttctgagctaagaaactgaaagccagaatctgcttcacctctttttacctgcaatacccccttaccccaataccaagaccaactggcatagagccaactgagataaatgctatttaaataaagtgtatttaatgaatttctccaa

SEQ ID NO: 20157 - DNA, 657 bp, Homo sapiens
  ENST00000582175
ggaagtgatacagcagcagaatgagaagatcctagaacagatagacaagagtggcgagctcataagccttagagaggaggtgacccaccttacccgctcacttcggcgtgcggagacagagaccaaagtgctccaggaggccctggcaggccagctggactccaactgccagcctatggccaccaattggatccaggagaaagtgtggctctctcaggaggtgactcagagttaacagaggagctggacagcaggtggggaccccaggctgtacccctgttgatctggacatatttctaggtggacaaactgagagtgatgttcctggagatgaaaaatgagaaggaaaaactcatgatcaagttccagagccatagaaatatcctagaggagaaccttcggcgctctgacaaggagttagaaaaactagatgacattgttcagcatatttataagaccctgctctctattccagaggtggtgaggggatgcaaagaactacagggattgctggaatttctgagctaagaaactgaaagccagaatctgcttcacctctttttacctgcaatacccccttaccccaataccaagaccaactggcatagagccaactgagataaatgctatttaaataaagtgtatttaatgaatttc

SEQ ID NO: 20158 - DNA, 4040 bp, Homo sapiens
  ENST00000321765
caggagggatggactcctggactctccagctacctgcgtggtcctccccggtgtgaggacagaagaccggtcctgggccgggcccgcatccagccctaccgccggtgtctgaggtgagggctccgtcagcggaaaacgctcgacaacggaggggcaggcagggccgggggcgtggtcaacgcgggccccgccccccgggctctacccccgagcgtacgcgcgcgcctgaagcagccaaccaggaagcgcagagcaggttcaaacacagacggcgggtgaacatggcgtcctcgacttggtctgagacgtgataggcctgccttctggttgaagatgtggcgagtgaaaaaactgagcctcagcctgtcgccttcgccccagacgggaaaaccatctatgagaactcctctccgtgaacttaccctgcagcccggtgccctcaccaactctggaaaaagatcccccgcttgctcctcgctgaccccatcactgtgcaagctggggctgcaggaaggcagcaacaactcatctccagtggattttgtaaataacaagaggacagacttatcttcagaacatttcagtcattcctcaaagtggctagaaacttgtcagcatgaatcagatgagcagcctctagatccaattccccaaattagctctactcctaaaacgtctgaggaagcagtagacccactgggcaattatatggttaaaaccatcgtccttgtaccatctccactggggcagcaacaagacatgatatttgaggcccgtttagataccatggcagagacaaacagcatatctttaaatggacctttgagaacagacgatctggtgagagaggaggtggcaccctgcatgggagacaggttttcagaagttgctgctgtatctgagaaacctatctttcaggaatctccgtcccatctcttagaggagtctccaccaaatccctgttctgaacaactacattgctccaaggaaagcctgagcagtagaactgaggctgtgcgtgaggacttagtaccttctgaaagtaacgccttcttgccttcctctgttctctggctttccccttcaactgccttggcagcagatttccgtgtcaatcatgtggacccagaggaggaaattgtagagcatggagctatggaggaaagagaaatgaggtttcccacacatcctaaggagtctgaaacagaagatcaagcacttgtctcaagtgtggaagatattctgtccacatgcctgacaccaaatctagtagaaatggaatcccaagaagctccaggcccagcagtagaagatgttggtaggattcttggctctgatacagagtcttggatgtccccactggcctggctggaaaaaggtgtaaatacctccgtcatgctggaaaatctccgccaaagcttatcccttccctcgatgcttcgggatgctgcaattggcactacccctttctctacttgctcggtggggacttggtttactccttcagcaccacaggaaaagagtacaaacacatcccagacaggcctggttggcaccaagcacagtacttctgagacagagcagctcctgtgtggccggcctccagatctgactgccttgtctcgacatgacttggaagataacctgctgagctctcttgtcattctggaggttctctcccgccagcttcgggactggaagagccagctggctgtccctcacccagaaacccaggacagtagcacacagactgacacatctcacagtgggataactaataaacttcagcatcttaaggagagccatgagatgggacaggccctacagcaggccagaaatgtcatgcaatcatgggtgcttatctctaaagagctgatatccttgcttcacctatccctgttgcatttagaagaagataagactactgtgagtcaggagtctcggcgtgcagaaacattggtctgttgctgttttgatttgctgaagaaattgagggcaaagctccagagcctcaaagcagaaagggaggaggcaaggcacagagaggaaatggctctcagaggcaaggatgcggcagagatagtgttggaggctttctgtgcacacgccagccagcgcatcagccagctggaacaggacctagcatccatgcgggaattcagaggccttctgaaggatgcccagacccaactggtagggcttcatgccaagcaagaagagctggttcagcagacagtgagtcttacttctaccttgcaacaagactggaggtccatgcaactggattatacaacatggacagctttgctgagtcggtcccgacaactcacagagaaactcacagtcaagagccagcaagccctgcaggaacgtgatgtggcaattgaggaaaagcaggaggtttctagggtgctggaacaagtctctgcccagttagaggagtgcaaaggccaaacagaacaactggagttggaaaacagtcgtctagcaacagatctccgggctcagttgcagattctggccaacatggacagccagctaaaagagctacagagtcagcatacccattgtgcccaggacctggctatgaaggatgagttactctgccagcttacccagagcaatgaggagcaggctgctcaatggcaaaaggaagagatggcactaaaacacatgcaggcagaactgcagcagcaacaagctgtcctggccaaagaggtgcgggacctgaaagagaccttggagtttgcagaccaggagaatcaggttgctcacctggagctgggtcaggttgagtgtcaattgaaaaccacactggaagtgctccgggagcgcagcttgcagtgtgagaacctcaaggacactgtagagaacctaacggctaaactggccagcaccatagcagataaccaggagcaagatctggagaaaacacggcagtactctcaaaagctagggctgctgactgagcaactacagagcctgactctctttctacagacaaaactaaaggagaagactgaacaagagacccttctgctgagtacagcctgtcctcccacccaggaacaccctctgcctaatgacaggaccttcctgggaagcatcttgacagcagtggcagatgaagagccagaatcaactcctgtgcccttgcttggaagtgacaagagtgctttcacccgagtagcatcaatggtttcccttcagcccgcagagaccccaggcatggaggagagcctggcagaaatgagtattatgactactgagcttcagagtctttgttccctgctacaagagtctaaagaagaagccatcaggactctgcagcgaaaaatttgtgagctgcaagctaggctgcaggcccaggaagaacagcatcaggaagtccagaaggcaaaagaagcagacatagagaagctgaaccaggccttgtgcttgcgctacaagaatgaaaaggagctccaggaagtgatacagcagcagaatgagaagatcctagaacagatagacaagagtggcgagctcataagccttagagaggaggtgacccaccttacccgctcacttcggcgtgcggagacagagaccaaagtgctccaggaggccctggcaggccagctggactccaactgccagcctatggccaccaattggatccaggagaaagtgtggctctctcaggaggtggacaaactgagagtgatgttcctggagatgaaaaatgagaaggaaaaactcatgatcaagttccagagccatagaaatatcctagaggagaaccttcggcgctctgacaaggagttagaaaaactagatgacattgttcagcatatttataagaccctgctctctattccagaggtggtgaggggatgcaaagaactacagggattgctggaatttctgagctaagaaactgaaagccagaatctgcttcacctctttttacctgcaatacccccttaccccaataccaagaccaactggcatagagccaactgagataaatgctatttaaataaagtgtatttaatgaa

SEQ ID NO: 20159 - DNA, 719 bp, Homo sapiens
  ENST00000582076
agagtctaaagaagaagccatcaggactctgcagcgaaaaatttgtgagctgcaagctaggctgcaggcccaggaagaacagcatcaggaagtccagaaggcaaaagaagcagacatagagaagctgaaccaggccttgtgcttgcgctacaagaatgaaaaggagctccaggaagtgatacagcagcagaatgagaagatcctagaacagatagacaagagtggcgagctcataagccttagagaggaggtgacccaccttacccgctcacttcggcgtgcggagacagagaccaaagtgctccaggaggccctggcaggccagctggactccaactgccagcctatggccaccaattggatccaggagaaagtgtggctctctcaggaggtggacaaactgagagtgatgttcctggagatgaaaaatgagaaggaaaaactcatgatcaagttccagagccatagaaatatcctagaggagaaccttcggcgctctgacaaggagttagaaaaactagatgacattgttcagcatatttataagaggtggtgaggggatgcaaagaactacagggattgctggaatttctgagctaagaaactgaaagccagaatctgcttcacctctttttacctgcaatacccccttaccccaataccaagaccaactggcatagagccaactgagataaatgctatttaaataaagtgtattt

SEQ ID NO: 20160 - DNA, 1023 bp, Homo sapiens
  ENST00000580676
ttgtgagctgcaagctaggctgcaggcccaggaagaacagcatcaggaagtccagaaggcaaaagaagcagacatagagaagctgaaccaggccttgtgcttgcgctacaagaatgaaaaggagctccaggaagtgatacagcagcagaatgagaagatcctagaacagatagacaagagtggcgagctcatagtatgttcaccatcatgcccaggcctttgccttctgtgttactggtcagccaggatcccaagtatgagaaatggtttgcttttgttcaccacatgttgtctatccttatgtcctattggacacctctccattctcattcccagagccttagagaggaggtgacccaccttacccgctcacttcggcgtgcggagacagagaccaaagtgctccaggaggccctggcaggccagctggactccaactgccagcctatggccaccaattggatccaggagaaagtgtggctctctcaggaggtgactcagagttaacagaggagctggacagcaggtggggaccccaggctgtacccctgttgatctggacatatttctaggtggacaaactgagagtgatgttcctggagatgaaaaatgagaaggaaaaactcatgatcaagttccagagccatgtaagaatgtccatgccattccagggccatttcctaccatcgttaacaaatgccccgccatgtttcccctgtcctaccaagtttgctcttttatgcataggacttataaaatctgtttgctttctagagaaatatcctagaggagaaccttcggcgctctgacaaggagttagaaaaactagatgacattgttcagcatatttataagaccctgctctctattccagaggtggtgaggggatgcaaagaactacagggattgctggaatttctgagctaagaaactgaaagccagaatctgcttcacctctttttacctgcaatacccccttaccccaataccaagaccaactggcatagagccaactgagataaa

SEQ ID NO: 20161 - DNA, 743 bp, Homo sapiens
  ENST00000581133
gtcctcccacccaggaacaccctctgcctaatgacaggaccttcctgggaagcatcttgacagcagtggcagatgaagagccagaatcaactcctgtgcccttgcttggaagtgacaagagtgctttcacccgagtagcatcaatggtttcccttcagcccgcagagaccccaggcatggaggagagcctggcagaaatgagtattatgactactgagcttcagagtctttgttccctgctacaagagtctaaagaagaagccatcaggactctgcagcgaaaaatgtgagtgggatgcagttttggtgacagagggacagtgagacatcctcttatgccaagggtccaactgatccctgagaggacaggaatgttgctaaattcttccttccttcagttgtgagctgcaagctaggctgcaggcccaggaagaacagcatcaggaagtccagaaggcaaaagaagcagacatagagaagctgaaccaggccttgtgcttgcgctacaagaatgaaaaggagctccaggaagtgatacagcagcagaatgagaagatcctagaacagatagacaagagtggcgagctcataagccttagagaggaggtgacccaccttacccgctcacttcggcgtgcggagacagagaccaaagtgctccaggaggccctggcaggccagctggactccaactgccagcctatggccaccaattggatccaggagaaagtgtggctctctca

SEQ ID NO: 20162 - DNA, 635 bp, Homo sapiens
  ENST00000580682
caggagttcactagacctgaacagcagctattttttcttctttgcccttagactgaacaagagacccttctgctgagtacagcctgtcctcccacccaggaacaccctctgcctaatgacaggaccttcctgggaagcatcttgacagcagtggcagatgaaggttaaaggccctgggatttgggggtgggaaagttgtgacgctgctcctgatatcttctgctgttgaagatgtccaccagcgggcttgtctatcttaccctggcttccattatggtagacccctgcctggatcatcagaggggccctctcccattattggtttttctcttagagccagaatcaactcctgtgcccttgcttggaagtgacaagagtgctttcacccgagtagcatcaatggtttcccttcagcccgcagagaccccaggcatggaggagagcctggcagaaatgagtattatgactactgagcttcagagtctttgttccctgctacaagagtctaaagaagaagccatcaggactctgcagcgaaaaatttgtgagctgcaagctaggctgcaggcccaggaagaacagcatcaggaagtccagaaggcaaaagaagcagacatagagaagctgaaccaggc

SEQ ID NO: 20163 - DNA, 651 bp, Homo sapiens
  ENST00000577259
cagataaccaggagcaagatctggagaaaacacggcagtactctcaaaagctagggctgctgactgagcaactacagagcctgactctctttctacagacaaaactaaaggagaagactgaacaagagacccttctgctgagtacagcctgtcctcccacccaggaacaccctctgcctaatgacaggaccttcctgggaagcatcttgacagcagtggcagatgaaggttaaaggccctgggatttgggggtgggaaagttgtgacgctgctcctgatatcttctgctgttgaagatgtccaccagcgggcttgtctatcttaccctggcttccattatggtagacccctgcctggatcatcagaggggccctctcccattattggtttttctcttagagccagaatcaactcctgtgcccttgcttggaagtgacaagagtgctttcacccgagtagcatcaatggtttcccttcagcccgcagagaccccaggcatggaggagagcctggcagaaatgagtattatgactactgagcttcagagtctttgttccctgctacaagagtctaaagaagaagccatcaggactctgcagcgaaaaatttgtgagctgcaagctaggctgcaggcccaggaagaacagcatc

SEQ ID NO: 20164 - DNA, 937 bp, Homo sapiens
  ENST00000580406
ttagagtaaatttagggccaaggacttaacccagaggatccagcagttaaggaaggacctgtgaatagagaagaaataaccagaaaggtgtggggcctgcctttaaaggagagagactcatgtcctggaagctaagaaaaggaagtttctaaaagaacaatgtggtcatcaatatcaaataggtcaggtaaaacaagagctgaaatatatgcattgcatttgaaagtaaggctgccattggtgaaccaaatgacaagaatttaggtggaatgacaggggagaagcctgagtgtagtgggctggggagtcaatagatggtgagagttataaacaagaagtataggctctttttttctttcttttttctttctttcctttctttctagaaaaggcagtagctaaaaggggatttaaggtaagaagaagggttttgttttgttttgtttaggtttgtttttaaaatactgctgtttttgttggagaggcttaagaatataaacatgttcagagaaaggcactaatggagaagttgaagatagagaattgagataataggtggaacagcattttggaggagatggctgggagttacctggaagcccaggagttcactagacctgaacagcagctattttttcttctttgcccttagactgaacaagagacccttctgctgagtacagcctgtcctcccacccaggaacaccctctgcctaatgacaggaccttcctgggaagcatcttgacagcagtggcagatgaagagccagaatcaactcctgtgcccttgcttggaagtgacaagagtgctttcacccgagtagcatcaatggtttcccttcagcccgcagagaccccaggcatggaggagagcctggcagaaatgagtattatgactactgagcttcagagtctttgttccctgctacaagagtct

SEQ ID NO: 20165 - DNA, 755 bp, Homo sapiens
  ENST00000378976
tctagcaacagatctccgggctcagttgcagattctggccaacatggacagccagctaaaagagctacagagtcagcatacccattgtgcccaggacctggctatgaaggatgagttactctgccagcttacccagagcaatgaggagcaggctgctcaatggcaaaaggaagagatggcactaaaacacatgcaggcagaactgcagcagcaacaagctgtcctggccaaagaggtgcgggacctgaaagagaccttggagtttgcagaccaggagaatcaggttgctcacctggagctgggtcaggttgagtgtcaattgaaaaccacactggaagtgctccgggagcgcagcttgcagtgtgagaacctcaaggacactgtagagaacctaacggctaaactggccagcaccatagcagataaccaggagcaagatctggagaaaacacggcagtactctcaaaagctagggctgctgactgagcaactacagagcctgactctctttctacagacaaaactaaaggagaagctattttttcttctttgcccttagactgaacaagagacccttctgctgagtacagcctgtcctcccacccaggaacaccctctgcctaatgacaggaccttcctgggaagcatcttgacagcagtggcagatgaagagccagaatcaactcctgtgcccttgcttggaagtgacaagagtgctttcacccgagtagcatcaatggtttcccttcagcccg

SEQ ID NO: 20166 - DNA, 335 bp, Homo sapiens
  ENST00000578230
caggagcaagatctggagaaaacacggcagtactctcaaaagctagggctgctgactgagcaactacagagcctgactctctttctacagacaaaactaaaggagaagactatgtttcaagaaagcagaaatatagccttctttggcctccctgcagtgtgcactaaacaataaatggttgacatcattcagaatacaaagactgaacaagagacccttctgctgagtacagcctgtcctcccacccaggaacaccctctgcctaatgacaggaccttcctgggaagcatcttgacagcagtggcagatgaagagccagaatcaactcctgtgcc

SEQ ID NO: 20167 - DNA, 978 bp, Homo sapiens
  ENST00000580083
tctcggcgtgcagaaacattggtctgttgctgttttgatttgctgaagaaattgagggcaaagctccagagcctcaaagcagaaagggaggaggcaaggcacagagaggaaatggctctcagaggcaaggatgcggtagggcttcatgccaagcaagaagagctggttcagcagacagtgagtcttacttctaccttgcaacaagactggaggtccatgcaactggattatacaacatggacagctttgctgagtcggtcccgacaactcacagagaaactcacagtcaagagccagcaagccctgcaggaacgtgatgtggcaattgaggaaaagcaggagatctccgggctcagttgcagattctggccaacatggacagccagctaaaagagctacagagtcagcatacccattgtgcccaggacctggctatgaaggatgagttactctgccagcttacccagagcaatgaggagcaggctgctcaatggcaaaaggaagagatggcactaaaacacatgcaggcagaactgcagcagcaacaagctgtcctggccaaagaggtgcgggacctgaaagagaccttggagtttgcagaccaggagaatcaggttgctcacctggagctgggtcaggttgagtgtcaattgaaaaccacactggaagtgctccgggagcgcagcttgcagtgtgagaacctcaaggacactgtagagaacctaacggctaaactggccagcaccatagcagataaccaggagcaagatctggagaaaacacggcagtactctcaaaagctagggctgctgactgagcaactacagagcctgactctctttctacagacaaaactaaaggagaagactgaacaagagacccttctgctgagtacagcctgtcctcccacccaggaacaccctctgcctaatgacaggaccttcctgggaagcatcttgacagcagtggcagatgaag

SEQ ID NO: 20168 - DNA, 715 bp, Homo sapiens
  ENST00000584206
tccctcacccagaaacccaggacagtagcacacagactgacacatctcacagtgggataactaataaacttcagcatcttaaggagagccatgagatgggacaggccctacagcaggccagaaatgtcatgcaatcatgggtgcttatctctaaagagctgatatccttgcttcacctatccctgttgcatttagaagaagataagactactgtgagtcaggagtctcggcgtgcagaaacattggtctgttgctgttttgatttgctgaagaaattgagggcaaagctccagagcctcaaagcagaaagggaggaggcaaggcacagagaggaaatggctctcagaggcaaggatgcggtagggcttcatgccaagcaagaagagctggttcagcagacagtgagtcttacttctaccttgcaacaagactggaggtccatgcaactggattatacaacatggacagctttgctgagtcggtcccgacaactcacagagaaactcacagtcaagagccagcaagccctgcaggaacgtgatgtggcaattgaggaaaagcaggaggtttctagggtgctggaacaagtctctgcccagttagaggagtgcaaaggccaaacagaacaactggagttggaaaacagtcgtctagcaacagatctccgggctcagttgcagattctggccaacatggacagccagctaaaagagct

SEQ ID NO: 20169 - DNA, 899 bp, Homo sapiens
  ENST00000580567
tggcgtcctcgacttggtctgagacgtgataggcctgccttctggttgaagatgtggcgagtgaaaaaactgagcctcagcctgtcgccttcgccccagacgggaaaaccatctatgagaactcctctccgtgaacttaccctgcagcccggtgccctcaccaactctggaaaaagatcccccgcttgctcctcgctgaccccatcactgtgcaagctggggctgcagcagatttccgtgtcaatcatgtggacccagaggaggaaattgtagagcatggagctatggaggaaagagaaatgaggtttcccacacatcctaaggagtctgaaacagaagatcaagcacttgtctcaagtgtggaagatattctgtccacatgcctgacaccaaatctagtagaaatggaatcccaagaagctccaggcccagcagtagaagatgttggtaggattcttggctctgatacagagtcttggatgtccccactggcctggctggaaaaaggtgtaaatacctccgtcatgctggaaaatctccgccaaagcttatcccttccctcgatgcttcgggatgctgcaattggcactacccctttctctacttgctcggtggggacttggtttactccttcagcaccacaggaaaagagtacaaacacatcccagacaggcctggttggcaccaagcacagtacttctgagacagagcagctcctgtgtggccggcctccagatctgactgccttgtctcgacatgacttggaagataacctgctgagctctcttgtcattctggaggttctctcccgccagcttcgggactggaagagccagctggctgtccctcacccagaaacccaggacagtagcacacagactgacacatctcacagtggg

SEQ ID NO: 20170 - DNA, 904 bp, Homo sapiens
  ENST00000578479
ggtgaacatggcgtcctcgacttggtctgagacgtgataggcctgccttctggttgaagatgtggcgagtgaaaaaactgagcctcagcctgtcgccttcgccccagacgggaaaaccatctatgagaactcctctccgtgaacttaccctgcagcccggtgccctcaccaactctggaaaaagatcccccgcttgctcctcgctgaccccatcactgtgcaagctggggctgcagatttccgtgtcaatcatgtggacccagaggaggaaattgtagagcatggagctatggaggaaagagaaatgaggtttcccacacatcctaaggagtctgaaacagaagatcaagcacttgtctcaagtgtggaagatattctgtccacatgcctgacaccaaatctagtagaaatggaatcccaagaagctccaggcccagcagtagaagatgttggtaggattcttggctctgatacagagtcttggatgtccccactggcctggctggaaaaaggtgtaaatacctccgtcatgctggaaaatctccgccaaagcttatcccttccctcgatgcttcgggatgctgcaattggcactacccctttctctacttgctcggtggggacttggtttactccttcagcaccacaggaaaagagtacaaacacatcccagacaggcctggttggcaccaagcacagtacttctgagacagagcagctcctgtgtggccggcctccagatctgactgccttgtctcgacatgacttggaagataacctgctgagctctcttgtcattctggaggttctctcccgccagcttcgggactggaagagccagctggctgtccctcacccagaaacccaggacagtagcacacagactgacacatctcacagtggg

SEQ ID NO: 20171 - DNA, 870 bp, Homo sapiens
  ENST00000536674
catggcgtcctcgacttggtctgagacgtgataggcctgccttctggttgaagatgtggcgagtgaaaaaactgagcctcagcctgtcgccttcgccccagacgggaaaaccatctatgagaactcctctccgtgaacttaccctgcagcccggtgccctcaccaactctggaaaaagatcccccgcttgctcctcgctgaccccatcactgtgcaagctggggctgcaggtgagattcgcctggacagcttctcgactgggctgtttgcccagggaaggcagcaacaactcatctccagtggattttgtaaataacaagaggacagacttatcttcagaacatttcagtcattcctcaaagtggctagaaacttgtcagcatgaatcagatgagcagcctctagatccaattccccaaattagctctactcctaaaacgtctgaggaagcagtagacccactgggcaattatatggttaaaaccatcgtccttgtaccatctccactggggcagcaacaagacatgatatttgaggcccgtttagataccatggcagagacaaacagcatatctttaaatggacctttgagaacagacgatctggtgagagaggaggtggcaccctgcatgggagacaggttttcagaagttgctgctgtatctgagaaacctatctttcaggaatctccgtcccatctcttagaggagtctccaccaaatccctgttctgaacaactacattgctccaaggaaagcctgagcagtagaactgaggctgtgcgtgaggacttagtaccttctgaaagtaacgccttcttgccttcctctgttctctggctttccccttcaactgccttggcagcagatt

SEQ ID NO: 20172 - DNA, 8273 bp, Homo sapiens
  ENST00000262013
agttggtgcagcggcggttggggtgagagcgcctacgccacccctcccctcctccggccccggcccccaccccgccgggcccagccccagccccggcccgggctccagccctagtacccgtcccagcccgagtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggagaaattcattgaatttgaagactctcaagaacaggaaaaaaaggacttacagacccgagtggaatctttagaatctcaaacaagacaacttgagctgaaagcgaaaaactatgctgaccagattagcagacttgaagaaagagaagcagaactgaagaaggaatataatgcattacatcaaagacacactgagatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggtcagcaatagtcctgaacctcagaaggctgtagaacaggaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttagtagccctggctgacggcacccttgcaatctttcacagaggagtggatgggcagtgggatttgtcaaactatcacctcttagaccttggacggcctcatcattccatccgttgcatgactgtggtacatgacaaagtctggtgtggctataggaacaaaatctatgtggtgcagccaaaggccatgaaaatagagaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaacaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataaacgtttcctgtttctgacttattagagctctaaagtttatgaggcctacttctctgaatattctgatgggttttttttgagaccagtctcattttcatactgacatgtctgaaagatttattatttataaagcttaggacatactctgggaagcttagaagatacttcagcactgggaggattttttaaaggaaatgtgttttgtatttcttgtaccagagaatggtgatgttgattgagttttttccatgtaaaaaatgtacttgtttgccaaatgttcctagattgctcttaacctgttaatacaagtaaaactgtagtggggatggagtctggcctaagtacagaatgagggatttaattagaaaagttattttcttttgttctgtatcaaactgcagaacagctatatacttggtattttgtacgtgaataacgttttagcttttgtgcccttttgagcttgaagggttatcctcaaaggggaaaactatgaaggggaagaagacaaacctaagataccataaagtaaaggttgacattacatattttcattcacaatgcccattaaaaaaaaaaaataggttgggcatggtggctcacgcctgtaatcccaacactttaggaggctgaggcagatggattgcttgagcccaggagttcaagaccagcctgggcaacatggcgaaaccctgtctctaccaaaaaaaaaaaacaaaataaattaaccgggtgtggtggcacatgcctgtagtcccagctacttgggaggctgaggtgggaggatgacctgggcccaggaggtggaggttgcagtgagccttgatagcaccactgcactccagcctgggtgacggagcaagaccctgtctcaaaacagacaaacaagcaaaaaatagattaaagtctggatttcactgattttcttgcttaataagttttttaaaaccacgatgctgcaattttttccctctcaagcttcttgaaaatgtgtgatttacccttttttatctattactctaggcaaagctaaatatgatttttttttttttttttgagacggagtctggctctgttgcccaggctggaatgcagtggtgcgatctcagctcactgcaacctccacctctcaggttcaagtagttctcctgcctcagcctcccaagtagctgggattacaggtgtgtgccaccctgcccagctaatttttgtatttttagtagagacagggtttcaccacattggccaggctggtctcaaactcctgacctcagatgatctacccgccttggcctcccgaagtgcttgaattacaggcgtgagcccccgcgccggtccgaagcaaagctaaatgtaattttatgtactgttttaacagtataaacctatgggataaaggcccccaatcatcagaaggactactgaaaagaaaagaaagcaaacgtagatgtcaaattgtctaaacattcttaagtaccactgattttttttttctggactattatacaaagatgtctgtaaaaagtataccagtggcttttatgcatatacacgattaggctagattgtgaagtacatgggatttcatgagccagaggaggcatttggatccattgggccacatgtgactataagcacattgtgtacacaataaaattgtagccactcatgtattaaaactgttttggtaaaagctgtattaaaagaataattttttgcttgagctacttagtcacttttttgcagggcaccaaaatgtaggctacttttccatagcttgtttgctatgtttttatttcatcttaaatctgagccatttttggcaatatcttttaaaaaatcattattaaacatttattggaaatgttgtatagattcacaagaaagagacaccaaagtgtttgggaattttaatcccaagaagtaaacatcccagagtcagatcccatttgctgttgttcagccatgtttgtatgactgaatgtaatttaggaaatcaggagttagagatgaaaaatacaaacatgtcaaatggttgtaattgctttttttgaacttactggctttaacttaagtaatataggtgtgtagttgttttatctaaagatgtcagattatctgtggccctgttaattaactgcagggaccagagagaggacaaaaatgcctgtataatttgctttaaaggcttgtccttatgtttgtaatttcagttaaatattttctacagattgcttcacttcccctttcccccaataacaagttcatattcttgtaatgtttactttggtcaacgtggtaatttttggaagaaaatgccaaaatgtaagcttctcacaagcagcaaaggaatgtaactgcctgtagctaccacatcaagggagagaagaggcttgcgtactttgggttgatctcactgtacaaaaaaagtgtacccctattggaagaaataaggaatacttgaaggtttctcctttttttacacttgagtcatgtgcaaggttgaaccatatgaaattgccagtgttcaaccattgctgatctgcaaaagcgacaatatcatatgcctcaacctaacacttactcttaaatgcaggttaaaatctctgtgaggcaaagggataatattctctaggaactcacttttgagagtatttttctctaacccatgtggatctaaattttaaaaataggaatgaatctcttaattgcagcttgtggagagtataaaacattttgagcacaatatgcagcacataacttttcagattgtgtttgcatagaaaaggttaaaatcaattctttcagttactgtattgttcatttcttgtaaaggtcttcctacatttgagacgagaccctttaacataggctgccttagtaacaaaataaaacagatgtgtcataatattaactgtcctaaagaacatgtgtcttgcaaatgccatggaactgaatatttatttccttgtgagtattatgaccgttaccaaaggactcaaccagatttagggctcttcttaattgatcatgttcagaaagggactcatttggtcccactttgtaacatgggaagagtagaagagaaaattaaatgtggaaatcataaatgcttttctaacagggttatgctattctgtaacactaaatgtctgtcttttctcttaaaagattaagttttattaattttgtcatacatttctctatttgaatatatcttaaccattttatgttccaaattcgttttttgtccaagacattctatcagaattttacttgcctctataatctgaaaaatgggttctagaatgtcccacttgctgtctcttagaggctgagcttcatttctatgagcaaagagctcatttagcaatgtagttatttcagtatttatttctattatggaatccctggggttcagaatgtaactttgtacatgagatatatataaatatgtatatgaacatgta

SEQ ID NO: 20173 - DNA, 681 bp, Homo sapiens
  ENST00000509724
gaagcttagaagatacttcagcactgggaggattttttaaaggaaatgtgttttgtatttcttgtaccagagaatggtgatgttgattgagttttttccatgtaaaaaatgtacttgtttgccaaatgttcctagattgctcttaacctgttaatacaagtaaaactgtagtggggatggagtctggcctaagtacagaatgagggatttaattagaaaagttattttcttttgttctgtatcaaactgcagaacagctatatacttggtattttgtacgtgaataacgttttagcttttgtgcccttttgagcttgaagggttatcctcaaaggggaaaactatgaaggggaagaagacaaacctaagataccataaagtaaaggttgacattacatattttcattcacaatgcccattaaaaaaaaaaaataggctggtctcaaactcctgacctcagatgatctacccgccttggcctcccgaagtgcttgaattacaggcgtgagcccccgcgccggtccgaagcaaagctaaatgtaattttatgtactgttttaacagtataaacctatgggataaaggcccccaatcatcagaaggactactgaaaagaaaagaaagcaaacgtagatgtcaaattgtctaaacattcttaagtaccactgattttttttttct

SEQ ID NO: 20174 - DNA, 4949 bp, Homo sapiens
  ENST00000510283
gcataaatgctaggagcagcagctctatggttatgaggtggggagaacggaatgacgtcatcgcttgggagctgctgcaggatggagtggaaagctgctgctgatggcattgtttttgtggcagcaagctgaatgacagatcctcactacaaagatacccctttggcccccgtgtaggcctccttggttcgggtgtttcaccatgccagcacagcgccatgagtcctggatgcatgctgctgtttgtgtttggctttgttggcggggcggtggtcattaattctgctatcttagtatctctctctgttttgctgcttgtgcacttttctatttctaccggtgtgccagctctgacgcagaacctaccaaggatactcagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttagtagccctggctgacggcacccttgcaatctttcacagaggagtggatgggcagtgggatttgtcaaactatcacctcttagaccttggacggcctcatcattccatccgttgcatgactgtggtacatgacaaagtctggtgtggctataggaacaaaatctatgtggtgcagccaaaggccatgaaaatagagaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaaccgtaatcctccaccagggacgtttactggggctgagggcaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataaacgtttcctgtttctgacttattagagctctaaagtttatgaggcctacttctctgaatattctgatgggttttttttgagaccagtctcattttcatactgacatgtctgaaagatttattatttataaagcttaggacatactctgggaagcttagaagatacttcagcactgggaggattttttaaaggaaatgtgttttgtatttcttgtaccagagaatggtgatgttgattgagttttttccatgtaaaaaatgtacttgtttgccaaatgttcctagattgctcttaacctgttaatacaagtaaaactgtagtggggatggagtctggcctaagtacagaatgagggatttaattagaaaagttattttcttttgttctgtatcaaactgcagaacagctatatacttggtattttgtacgtgaataacgttttagcttttgtgcccttttgagcttgaagggttatcctcaaaggggaaaactatgaaggggaagaagacaaacctaagataccataaagtaaaggttgacattacatattttcattcacaatgcccatt

SEQ ID NO: 20175 - DNA, 4659 bp, Homo sapiens
  ENST00000505279
gtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggagaaattcattgaatttgaagactctcaagaacaggaaaaaaaggacttacagacccgagtggaatctttagaatctcaaacaagacaacttgagctgaaagcgaaaaactatgctgaccagattagcagacttgaagaaagagaagcagaactgaagaaggaatataatgcattacatcaaagacacactgagatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttgtgccaactcgtttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttagtagccctggctgacggcacccttgcaatctttcacagaggagtggatgggcagtgggatttgtcaaactatcacctcttagaccttggacggcctcatcattccatccgttgcatgactgtggtacatgacaaagtctggtgtggctataggaacaaaatctatgtggtgcagccaaaggccatgaaaatagagaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaacaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataaacgtttcctgtttctga

SEQ ID NO: 20176 - DNA, 4761 bp, Homo sapiens
  ENST00000357122
agttggtgcagcggcggttggggtgagagcgcctacgccacccctcccctcctccggccccggcccccaccccgccgggcccagccccagccccggcccgggctccagccctagtacccgtcccagcccgagtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggagaaattcattgaatttgaagactctcaagaacaggaaaaaaaggacttacagacccgagtggaatctttagaatctcaaacaagacaacttgagctgaaagcgaaaaactatgctgaccagattagcagacttgaagaaagagaagcagaactgaagaaggaatataatgcattacatcaaagacacactgagatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttagtagccctggctgacggcacccttgcaatctttcacagaggagtggatgggcagtgggatttgtcaaactatcacctcttagaccttggacggcctcatcattccatccgttgcatgactgtggtacatgacaaagtctggtgtggctataggaacaaaatctatgtggtgcagccaaaggccatgaaaatagagaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaacaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataa

SEQ ID NO: 20177 - DNA, 828 bp, Homo sapiens
  ENST00000506500
gaagataaactataaagaaagactttatttgcaaatatacccatttactttaaactgtataatggttagttttctaacatgtgcattaaaaacaaaacaagaaacaactaagattcaaatttgttttttttttaactaaaattattttttaaatgaatagatgtgtttaaaaaataagcttacttattgctagactggcaaaatcccctactccatttactgaggtacttaaaaataactagcatgctgtatctctttttttcccagctttgtcttgaattggcattgccatccttgttttatctcaactggctgtagcttttagataatatcataaggattaaccagtaacctcttacattcattactgttttctaggggaaaatatttggtatttggtttttctgttgcagcaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagt

SEQ ID NO: 20178 - DNA, 822 bp, Homo sapiens
  ENST00000513746
acaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaacaaataaaacctcaggtgtaccaggaaatcgtcctggaagtgtaatccgtgtatatggtgatgaaaacagtgataaag

SEQ ID NO: 20179 - DNA, 943 bp, Homo sapiens
  ENST00000511312
atgggcagtgggatttgtcaaactatcacctcttagaccttggacggcctcatcattccatccgttgcatgactgtggtacatgacaaagtctggtgtggctataggaacaaaatctatgtggtgcagccaaaggccatgaaaatagagaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaagtaagtatatttttagataactgccatggaacaaataggagaattataggaaatagttatgtctgaaattcaaatctgtgttagctcagaaaatcagtgatggcaaagatctagctatagttacttcactcaatgaaacttataaattctaggaaaataagttttcatgtatcaagaccaatactcataattaaaagtttttcgttgtcaaaacattttcacagttcaggaatcacagtcctatttcatcttttgaaataaaagttaaagtccatttttcttaagccttattataccattatccaaaaacactacctagcattcatcttagtttttcatatctccttagcagatagtttagtatattccatttgtcttatttgaggtttaaaaaaagttgtggaagaagtttctcaggagttcagcaagcctttccatctatcttctattttaaaagaatgtgatttattgtttttatgaataaaatatacctcgtgtgtttctcata

SEQ ID NO: 20180 - DNA, 750 bp, Homo sapiens
  ENST00000513906
aggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattg

SEQ ID NO: 20181 - DNA, 2523 bp, Homo sapiens
  ENST00000514613
gacaacttgagctgaaagcgaaaaactatgctgaccagattagcagacttgaagaaagagaagcagaactgaagaaggaatataatgcattacatcaaagacacactgagatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgaggtataataatgggtcatcaacttaggcaactgggtgaagtgcacaaataaaaggaaccaaaataatctcaaacagtcaaaagatttccactaattagtgtcactgtggtggattaaaagatacctattcttgtgata

SEQ ID NO: 20182 - DNA, 2369 bp, Homo sapiens
  ENST00000505173
aagacacactgagatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggtcagcaatagtcctgaacctcagaaggctgtagaacaggaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgaggtataataatgggtcatcaacttaggcaactgggtgaa

SEQ ID NO: 20183 - DNA, 558 bp, Homo sapiens
  ENST00000514205
ctgtaattgttttagtaaaaaaaatgttatttatagaagtttactttgctgttacaagaagatttatttttcaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccaggtatatccattctctttacctgccatctgtatagagtctaaggctacactcagatgcctcattatggacttaatttagatcttaagtaacaaggttgaaagaacttgaaagaagatactgtagtcccagctactcgggaggctgaggcaggagaatggcgtgaacctgggaggtggagcttgcagtgagccaagatcacgccgccgcactccagcctgggcaacagagcaagactctgtctcaaaaaaaaaaaaaatgctgtaat

SEQ ID NO: 20184 - DNA, 848 bp, Homo sapiens
  ENST00000506483
cctgttattgactcatgcctataatcctaacactttgggaggccaaggtggaggatggcttgagctcagggagtttgagaccagcctaggcaacatagcatgacctcatctctacaaaaaatttaaaaaattagctgggtgtggtggcctgtgcctgtagtcccagctaccttggaggctgaggtgggaggggaccgcttaagcctgacagattgaggctgcagtgagccatgatcaagccactgcactctagcctgggcagtagagcgaccctgtctcaaaaaaacaaaaaaacaaaaaacctgaacttgatttcaaggagtaaataacagcagtgcttgctcatgtctcagtggatctgtaataagttcacttttgatgaggcttactaatgtgcctttttcactcctccttccaccattattaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaa

SEQ ID NO: 20185 - DNA, 728 bp, Homo sapiens
  ENST00000513827
aggaagctgttcgatggacagagatgattcgggcatcacgagaaaatccagccatgcaggaaaaaaaaaggtcaagcatttggcagtttttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaatatgcacatgtggtaagagcatccagcaggaaagaagagggcaagttgagtgtgcgtgggcatgaaggattcactgtacgcatcccagccctgctcatctcagccgcatggactgggcacacatttaagcatggagggtggtggttttcaggctgttttctagagctgtagaactcaaatgaaatgctctgagtctgtgagggggggaggagtcaataaagggtggctaagtgcatggagtttgaggtacccgctctgctgtaaccagagcaattctggtttaatatttgaagatttcattttttaaaaaaccagcatcattgttgaaaaaa

SEQ ID NO: 20186 - DNA, 292 bp, Homo sapiens
  ENST00000515685
ggaagctgttcgatggacagagatgattcgggcatcacgagaaaatccagccatgcaggaaaaaaaaaggtcaagcatttggcagtttttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagagtaagtcttttccaaattaatcattatattc

SEQ ID NO: 20187 - DNA, 627 bp, Homo sapiens
  ENST00000513547
actaggtttcctggcaaagggtgcatgacaagtaatctatgggaagcactgagaccagcacctggtatagagcagaggagctgccattattgcttgtgtttgctgggatcacacaacaaaaacattctataatttcttcaccagctatttccatggagcttagtgagaatttcttaggaagcctttgagaaatctttttaagttatattttctagtaaacgtaaattatagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcc

SEQ ID NO: 20188 - DNA, 522 bp, Homo sapiens
  ENST00000511795
ggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggggaatattctgaccataatttctttggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatatt

SEQ ID NO: 20189 - DNA, 554 bp, Homo sapiens
  ENST00000576492
gacctttgaaatgtgctcaaaacagtcagcaatagtcctgaacctcagaaggctgtagaacaggaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaa

SEQ ID NO: 20190 - DNA, 686 bp, Homo sapiens
  ENST00000510855
gcataaatgctaggagcagcagctctatggttatgaggtggggagaacggaatgacgtcatcgcttgggagctgctgcaggatggagtggaaagctgctgctgatggcattgtttttgtggcagcaagctgaatgacagatcctcactacaaagatacccctttggcccccgtgtaggcctccttggttcgggtgtttcaccatgccagcacagcgccatgagtcctggatgcatgctgctgtttgtgtttggctttgttggcggggcggtggtcattaattctgctatcttagtatctctctctgttttgctgcttgtgcacttttctatttctaccggtgtgccagctctgacgcagaacctaccaaggatactcagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggtcagcaatagtcctgaacctcagaaggctgtagaacaggaggatgagctttctgatgttagccaaggcggatctaaagctaccactccagcatcaacagctaattcagatgtggcaacaattcctactgatactcccttaaaggaagaaaacgaa

SEQ ID NO: 20191 - DNA, 1298 bp, Homo sapiens
  ENST00000511987
ggagaacggaatgacgtcatcgcttgggagctgctgcaggatggagtggaaagctgctgctgatggcattgtttttgtggcagcaagctgaatgacagatcctcactacaaagatacccctttggcccccgtgtaggcctccttggttcgggtgtttcaccatgccagcacagcgccatgagtcctggatgcatgctgctgtttgtgtttggctttgttggcggggcggtggtcattaattctgctatcttagtatctctctctgttttgctgcttgtgcacttttctatttctaccggtgtgccagctctgacgcagaacctaccaaggatactcagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggtcagcaatagtcctgaacctcagaaggctgtagaacaggaggtgagaatggtgcttcttaacattttgcaaaaagtatactaaagtgattaactattgattacttcctcaactgctattctcaagacatcagatgctcagcttggaagactattgttgtaattcactgaaatataaaagaaaattatttccactgtagtggttgtcagggctttactgcaatctgtaatttattccttccccaaagtaagcatttttaaataaaggaaagaaaatataagtaaattctgtgaaattcagcctgtttgcatttatccagctctatgtaatggtatactttccagaaataccttcttcagggcataatgtatgtaacttgtatttgtcctgaatgtggcctagtgtgtcatcttacagtggactgcttccttagtttaatagagttcttcatctccagtcagggcaccatccagctttattcatcaaacatctgttaagagcctactacaggccaggtgtggtggctcatgcctgaaatcccagcactctgcccaggcaggcggatcacttggtcaggagtaggagttcaagaccagcatggccagtatggtgaaatcttgtctctactaaaaatacaaaaatcagccaggcatggtggcagacacctgtaatcccaggtacttaggagtctgaggcaggagaattgcttgaacccgggaggtggaggttgcagtgagctaagatggtgccactgccttccagcctgggcaacacagcgagactccatctcaaaaaaaaaaaaaaaaaaa

SEQ ID NO: 20192 - DNA, 528 bp, Homo sapiens
  ENST00000502329
agatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggtcagcaatagtcctgaacctcagaaggctgtagaacaggaggtgagaatggtgcttcttaacattttgcaaaaagtatactaaagtgattaactattgattacttcctcaactgctattctcaagacatcagatgctcagcttggaagactattgttgtaattcactgaaatataaaagaaaattatttccactgtagtggttgtcagggctttactgcaatctgtaatttattccttccccaaagtaagcatttttaaataaaggaaagaaaatataa

SEQ ID NO: 20193 - DNA, 8246 bp, Homo sapiens
  ENST00000618113
agttggtgcagcggcggttggggtgagagcgcctacgccacccctcccctcctccggccccggcccccaccccgccgggcccagccccagccccggcccgggctccagccctagtacccgtcccagcccgagtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggagaaattcattgaatttgaagactctcaagaacaggaaaaaaaggacttacagacccgagtggaatctttagaatctcaaacaagacaacttgagctgaaagcgaaaaactatgctgaccagattagcagacttgaagaaagagaagcagaactgaagaaggaatataatgcattacatcaaagacacactgagatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagttactgtcttcttttagtttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttagtagccctggctgacggcacccttgcaatctttcacagaggagtggatgggcagtgggatttgtcaaactatcacctcttagaccttggacggcctcatcattccatccgttgcatgactgtggtacatgacaaagtctggtgtggctataggaacaaaatctatgtggtgcagccaaaggccatgaaaatagagaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaacaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataaacgtttcctgtttctgacttattagagctctaaagtttatgaggcctacttctctgaatattctgatgggttttttttgagaccagtctcattttcatactgacatgtctgaaagatttattatttataaagcttaggacatactctgggaagcttagaagatacttcagcactgggaggattttttaaaggaaatgtgttttgtatttcttgtaccagagaatggtgatgttgattgagttttttccatgtaaaaaatgtacttgtttgccaaatgttcctagattgctcttaacctgttaatacaagtaaaactgtagtggggatggagtctggcctaagtacagaatgagggatttaattagaaaagttattttcttttgttctgtatcaaactgcagaacagctatatacttggtattttgtacgtgaataacgttttagcttttgtgcccttttgagcttgaagggttatcctcaaaggggaaaactatgaaggggaagaagacaaacctaagataccataaagtaaaggttgacattacatattttcattcacaatgcccattaaaaaaaaaaaataggttgggcatggtggctcacgcctgtaatcccaacactttaggaggctgaggcagatggattgcttgagcccaggagttcaagaccagcctgggcaacatggcgaaaccctgtctctaccaaaaaaaaaaaacaaaataaattaaccgggtgtggtggcacatgcctgtagtcccagctacttgggaggctgaggtgggaggatgacctgggcccaggaggtggaggttgcagtgagccttgatagcaccactgcactccagcctgggtgacggagcaagaccctgtctcaaaacagacaaacaagcaaaaaatagattaaagtctggatttcactgattttcttgcttaataagttttttaaaaccacgatgctgcaattttttccctctcaagcttcttgaaaatgtgtgatttacccttttttatctattactctaggcaaagctaaatatgatttttttttttttttttgagacggagtctggctctgttgcccaggctggaatgcagtggtgcgatctcagctcactgcaacctccacctctcaggttcaagtagttctcctgcctcagcctcccaagtagctgggattacaggtgtgtgccaccctgcccagctaatttttgtatttttagtagagacagggtttcaccacattggccaggctggtctcaaactcctgacctcagatgatctacccgccttggcctcccgaagtgcttgaattacaggcgtgagcccccgcgccggtccgaagcaaagctaaatgtaattttatgtactgttttaacagtataaacctatgggataaaggcccccaatcatcagaaggactactgaaaagaaaagaaagcaaacgtagatgtcaaattgtctaaacattcttaagtaccactgattttttttttctggactattatacaaagatgtctgtaaaaagtataccagtggcttttatgcatatacacgattaggctagattgtgaagtacatgggatttcatgagccagaggaggcatttggatccattgggccacatgtgactataagcacattgtgtacacaataaaattgtagccactcatgtattaaaactgttttggtaaaagctgtattaaaagaataattttttgcttgagctacttagtcacttttttgcagggcaccaaaatgtaggctacttttccatagcttgtttgctatgtttttatttcatcttaaatctgagccatttttggcaatatcttttaaaaaatcattattaaacatttattggaaatgttgtatagattcacaagaaagagacaccaaagtgtttgggaattttaatcccaagaagtaaacatcccagagtcagatcccatttgctgttgttcagccatgtttgtatgactgaatgtaatttaggaaatcaggagttagagatgaaaaatacaaacatgtcaaatggttgtaattgctttttttgaacttactggctttaacttaagtaatataggtgtgtagttgttttatctaaagatgtcagattatctgtggccctgttaattaactgcagggaccagagagaggacaaaaatgcctgtataatttgctttaaaggcttgtccttatgtttgtaatttcagttaaatattttctacagattgcttcacttcccctttcccccaataacaagttcatattcttgtaatgtttactttggtcaacgtggtaatttttggaagaaaatgccaaaatgtaagcttctcacaagcagcaaaggaatgtaactgcctgtagctaccacatcaagggagagaagaggcttgcgtactttgggttgatctcactgtacaaaaaaagtgtacccctattggaagaaataaggaatacttgaaggtttctcctttttttacacttgagtcatgtgcaaggttgaaccatatgaaattgccagtgttcaaccattgctgatctgcaaaagcgacaatatcatatgcctcaacctaacacttactcttaaatgcaggttaaaatctctgtgaggcaaagggataatattctctaggaactcacttttgagagtatttttctctaacccatgtggatctaaattttaaaaataggaatgaatctcttaattgcagcttgtggagagtataaaacattttgagcacaatatgcagcacataacttttcagattgtgtttgcatagaaaaggttaaaatcaattctttcagttactgtattgttcatttcttgtaaaggtcttcctacatttgagacgagaccctttaacataggctgccttagtaacaaaataaaacagatgtgtcataatattaactgtcctaaagaacatgtgtcttgcaaatgccatggaactgaatatttatttccttgtgagtattatgaccgttaccaaaggactcaaccagatttagggctcttcttaattgatcatgttcagaaagggactcatttggtcccactttgtaacatgggaagagtagaagagaaaattaaatgtggaaatcataaatgcttttctaacagggttatgctattctgtaacactaaatgtctgtcttttctcttaaaagattaagttttattaattttgtcatacatttctctatttgaatatatcttaaccattttatgttccaaattcgttttttgtccaagacattctatcagaattttacttgcctctataatctgaaaaatgggttctagaatgtcccacttgctgtctcttagaggctgagcttcatttctatgagcaaagagctcatttagcaatgtagttatttcagtatttatttctattatggaatccctggggttcagaatgtaactttgtacatgagatatatataaatatgtatatgaacatgta

SEQ ID NO: 20194 - DNA, 3701 bp, Homo sapiens
  ENST00000231061
taggcagcagccccggaacagatgaggcaggcagggttgggacgtttggtcaggacagcccaccgcaaaaagaggaggaaagaaatgaaagacagagacagctttggctatgggagaaggaggaggccgggggaaggaggagacaggaggaggagggaccacggggtggaggggagatagacccagcccagagctctgagtggtttcctgttgcctgtctctaaacccctccacattcccgcggtccttcagactgcccggagagcgcgctctgcctgccgcctgcctgcctgccactgagggttcccagcaccatgagggcctggatcttctttctcctttgcctggccgggagggccttggcagcccctcagcaagaagccctgcctgatgagacagaggtggtggaagaaactgtggcagaggtgactgaggtatctgtgggagctaatcctgtccaggtggaagtaggagaatttgatgatggtgcagaggaaaccgaagaggaggtggtggcggaaaatccctgccagaaccaccactgcaaacacggcaaggtgtgcgagctggatgagaacaacacccccatgtgcgtgtgccaggaccccaccagctgcccagcccccattggcgagtttgagaaggtgtgcagcaatgacaacaagaccttcgactcttcctgccacttctttgccacaaagtgcaccctggagggcaccaagaagggccacaagctccacctggactacatcgggccttgcaaatacatccccccttgcctggactctgagctgaccgaattccccctgcgcatgcgggactggctcaagaacgtcctggtcaccctgtatgagagggatgaggacaacaaccttctgactgagaagcagaagctgcgggtgaagaagatccatgagaatgagaagcgcctggaggcaggagaccaccccgtggagctgctggcccgggacttcgagaagaactataacatgtacatcttccctgtacactggcagttcggccagctggaccagcaccccattgacgggtacctctcccacaccgagctggctccactgcgtgctcccctcatccccatggagcattgcaccacccgctttttcgagacctgtgacctggacaatgacaagtacatcgccctggatgagtgggccggctgcttcggcatcaagcagaaggatatcgacaaggatcttgtgatctaaatccactccttccacagtaccggattctctctttaaccctccccttcgtgtttcccccaatgtttaaaatgtttggatggtttgttgttctgcctggagacaaggtgctaacatagatttaagtgaatacattaacggtgctaaaaatgaaaattctaacccaagacatgacattcttagctgtaacttaactattaaggccttttccacacgcattaatagtcccatttttctcttgccatttgtagctttgcccattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttagaaactgccttcctgggtgatttgcatgtgtcttagtcttagtcaccttattatcctgacacaaaaacacatgagcatacatgtctacacatgactacacaaatgcaaacctttgcaaacacattatgcttttgcacacacacacctgtacacacacaccggcatgtttatacacagggagtgtatggttcctgtaagcactaagttagctgttttcatttaatgacctgtggtttaacccttttgatcactaccaccattatcagcaccagactgagcagctatatccttttattaatcatggtcattcattcattcattcattcacaaaatatttatgatgtatttactctgcaccaggtcccatgccaagcactggggacacagttatggcaaagtagacaaagcatttgttcatttggagcttagagtccaggaggaatacattagataatgacacaatcaaatataaattgcaagatgtcacaggtgtgatgaagggagagtaggagagaccatgagtatgtgtaacaggaggacacagcattattctagtgctgtactgttccgtacggcagccactacccacatgtaactttttaagatttaaatttaaattagttaacattcaaaacgcagctccccaatcacactagcaacatttcaagtgcttgagagccatgcatgattagtggttaccctattgaataggtcagaagtagaatcttttcatcatcacagaaagttctattggacagtgctcttctagatcatcataagactacagagcacttttcaaagctcatgcatgttcatcatgttagtgtcgtattttgagctggggttttgagactccccttagagatagagaaacagacccaagaaatgtgctcaattgcaatgggccacatacctagatctccagatgtcatttcccctctcttattttaagttatgttaagattactaaaacaataaaagctcctaaaaaatcaaactgtattctggtgttctcttctacacagtgggagggcgagcagtaggagagattggcccatttggtgctggccatttgaggaatgcaagcccagcactagtctcataatctctaggaatctgtagagagaggaattgaagtaaatttcagcattggctcattcagtcattcggcgacattcatcaggtacctgcaatgtgttaggggatcttatgagtaggcagcgtgcgtgatccttgctcccctggagctttctaacattctagcaggcagaccacacataaatttgcaatactgtttctgataaaaacgtgctgtaaaggaaataaagcagagaactatcatggaaaa

SEQ ID NO: 20195 - DNA, 1598 bp, Homo sapiens
  ENST00000520687
gggagcacggcccaggcagggtctgtgctgaccgcccttgtgtttggaacctagacatccccccttgcctggactctgagctgaccgaattccccctgcgcatgcgggactggctcaagaacgtcctggtcaccctgtatgagagggatgaggacaacaaccttctgactgagaagcagaagctgcgggtgaagaagatccatgagaatgagaagcgcctggaggcaggagaccaccccgtggagctgctggcccgggacttcgagaagaactataacatgtacatcttccctgtacactggcagttcggccagctggaccagcaccccattgacgggtacctctcccacaccgagctggctccactgcgtgctcccctcatccccatggagcattgcaccacccgctttttcgagacctgtgacctggacaatgacaagtacatcgccctggatgagtgggccggctgcttcggcatcaagcagaaggatatcgacaaggatcttgtgatctaaatccactccttccacagtaccggattctctctttaaccctccccttcgtgtttcccccaatgtttaaaatgtttggatggtttgttgttctgcctggagacaaggtgctaacatagatttaagtgaatacattaacggtgctaaaaatgaaaattctaacccaagacatgacattcttagctgtaacttaactattaaggccttttccacacgcattaatagtcccatttttctcttgccatttgtagctttgcccattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgat

SEQ ID NO: 20196 - DNA, 576 bp, Homo sapiens
  ENST00000538026
gtttcctgttgcctgtctctaaacccctccacattcccgcggtccttcagactgcccggagaatccctgccagaaccaccactgcaaacacggcaaggtgtgcgagctggatgagaacaacacccccatgtgcgtgtgccaggaccccaccagctgcccagcccccattggcgagtttgagaaggtgtgcagcaatgacaacaagaccttcgactcttcctgccacttctttgccacaaagtgcaccctggagggcaccaagaagggccacaagctccacctggactacatcgggccttgcaaatacatccccccttgcctggactctgagctgaccgaattccccctgcgcatgcgggactggctcaagaacgtcctggtcaccctgtatgagagggatgaggacaacaaccttctgactgagaagcagaagctgcgggtgaagaagatccatgagaatgagaagcgcctggaggcaggagaccaccccgtggagctgctggcccgggacttcgagaagaactataacatgtacatcttccctgtacactggcagttcggccagctggaccagca

SEQ ID NO: 20197 - DNA, 218 bp, Homo sapiens
  ENST00000537849
ggactctgagctgaccgaattccccctgcgcatgcgggactggctcaagaacgtcctggtcaccctgtatgagagggatgaggacaacaaccttctgactgagaagcagaagctgcggtctctactccctcaggtgaagaagatccatgagaatgagaagcgcctggaggcaggagaccaccccgtggagctgctggcccgggacttcgagaagaact

SEQ ID NO: 20198 - DNA, 602 bp, Homo sapiens
  ENST00000521569
gagtggtttcctgttgcctgtctctaaacccctccacattcccgcggtccttcagactgcccggagagcgcgctctgcctgccgcctgcctgcctgccactgaggtatctgtgggagctaatcctgtccaggtggaagtaggagaatttgatgatggtgcagaggaaaccgaagaggaggtggtggcggaaaatccctgccagaaccaccactgcaaacacggcaaggtgtgcgagctggatgagaacaacacccccatgtgcgtgtgccaggaccccaccagctgcccagcccccattggcgagtttgagaaggtgtgcagcaatgacaacaagaccttcgactcttcctgccacttctttgccacaaagtgcaccctggagggcaccaagaagggccacaagctccacctggactacatcgggccttgcaaatacatccccccttgcctggactctgagctgaccgaattccccctgcgcatgcgggactggctcaagaacgtcctggtcaccctgtatgagagggatgaggacaacaaccttctgactgagaagcagaagctgcgggtgaagaagatccatgagaatgagaagcgcctg

SEQ ID NO: 20199 - DNA, 505 bp, Homo sapiens
  ENST00000524277
caggactcagggctgtccaaagcccagagtgggggccacagtcaaggactgtcagccctgagatctgtccaggtaggatgggggtggatgtgctagtccaggtgatgctaactcccttgtctttctgccctacagatccctgccagaaccaccactgcaaacacggcaaggtgtgcgagctggatgagaacaacacccccatgtgcgtgtgccaggaccccaccagctgcccagcccccattggcgagtttgagaaggtgtgcagcaatgacaacaagaccttcgactcttcctgccacttctttgccacaaagtgcaccctggagggcaccaagaagggccacaagctccacctggactacatcgggccttgcaaatacatccccccttgcctggactctgagctgaccgaattccccctgcgcatgcgggactggctcaagaacgtcctggtcaccctgtatgagagggatgaggacaacaaccttctgactgagaagcagaa

SEQ ID NO: 20200 - DNA, 511 bp, Homo sapiens
  ENST00000539687
agctatcagctgccacatcgacatagcctagagcaaagagggggagggaggagaagaagggggttgcctggagaaggaatcaacttttgaaactttctccaagtcccacccaccagaaggctcttctctgcctgactcactctccgaggaatgcgagttgccacgggttcccagcaccatgagggcctggatcttctttctcctttgcctggccgggagggccttggcagcccctcagcaagaagccctgcctgatgagacagaggtggtggaagaaactgtggcagaggtgactgaggtatctgtgggagctaatcctgtccaggtggaagtaggagaatttgatgatggtgcagaggaaaccgaagaggaggtggtggcggaaaatccctgccagaaccaccactgcaaacacggcaaggtgtgcgagctggatgagaacaacacccccatgtgcgtgtgccaggaccccaccagctgcccagcccccattggcgagtttgagaaggtg

SEQ ID NO: 20201 - DNA, 864 bp, Homo sapiens
  ENST00000521327
gagctctgagtggtttcctgttgcctgtctctaaacccctccacattcccgcggtccttcagactgcccggagagcgcgctctgcctgccgcctgcctgcctgccactgagggttcccagcaccatgagggcctggatcttctttctcctttgcctggccgggagggccttggcagcccctcagcaagaagccctgcctgatgagacagaggtggtggaagaaactgtggcagaggtgactgaggtatctgtgggagctaatcctgtccaggtggaagtaggagaatttgatgatggtgcagaggaaaccgaagaggaggtggtggcggaaagtatgtcccttccctgtaacttggcacatccaagctgcccttggctgcctgggcctggggcacgaggacagcctacatgaggctccttccagcagaaatgcagggtggggtcctcagtgggctatgaaggaaacacggctttgacttaacaagtgggaaactgtggcactcagtcccctgggatctgggcaagatcggtttccaggccatccatgtgtgtggtaggaaggagagttctccagctggaaatgggcttctcccctcatagctctttgccctgagtccaaagctgagtttcccagtcccacggaggtcgctgatcacatctggtcaccgaaatctcccattgcttctgtatcagcccgtgccccacagagaagtagaactgagagaagagatcaggaacttgcacactcataagctcattctatttcacacagtccaaggaaacgaggtcctgaggaaatgcaacctgacataatccgtaccatgctatccatgcgttagtgccctgggagagaaatgacctagg

SEQ ID NO: 20202 - DNA, 497 bp, Homo sapiens
  ENST00000522348
gtttcctgttgcctgtctctaaacccctccacattcccgcggtccttcagactgcccggagagcgcgctctgcctgccgcctgcctgcctgccactgaggccttggtcttctcatctgtactattgggcagaaatatgtgacttgagcccccagtggggtgctggattatgaaaacaccctgaaaatgataaatgtatgcatcatcacagactaaagaaatacaaaggagggagtttttgtttaatattggtcatttatatgaagggaatttaaattttcgccaggcacgctacacctaggtttgattggcaaaggatcacagctggttcccagcaccatgagggcctggatcttctttctcctttgcctggccgggagggccttggcagcccctcagcaagaagccctgcctgatgagacagaggtggtggaagaaactgtggcagaggtgactgaggtatctgtgggagctaatcctgtccaggtggaagtagga

SEQ ID NO: 20203 - DNA, 2906 bp, Homo sapiens
  ENST00000282470
aaaaaatgcataaagagccaagtgcttatattctggccaagttatgaggctctgagaacaagagcttgaggggaagactgttaaccccatccacgccaccagaattagctctttcccttttggtttgcaagcactgcctgtaaagccctcgcatgagaggccagcctgctagggaaatccaggaatctgcaacaaaaacgatgacagtctgaaatactctctggtgccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaagatctggaaagcatgaagactgggctttttttcctatgtctcttgggaactgcagctgcaatcccgacaaatgcaagattattatctgatcattccaaaccaactgctgaaacggtagcacctgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggccaagaaagcagagaactcatcaaatgaggaggaaacgtcaagtgaaggcaacatgagggtgcatgctgtggattcttgcatgagcttccagtgtaaaagaggccacatctgtaaggcagaccaacagggaaaacctcactgtgtctgccaggatccagtgacttgtcctccaacaaaaccccttgatcaagtttgtggcactgacaatcagacctatgctagttcctgtcatctattcgctactaaatgcagactggaggggaccaaaaaggggcatcaactccagctggattattttggagcctgcaaatctattcctacttgtacggactttgaagtgattcagtttcctctacggatgagagactggctcaagaatatcctcatgcagctttatgaagccaactctgaacacgctggttatctaaatgagaagcagagaaataaagtcaagaaaatttacctggatgaaaagaggcttttggctggggaccatcccattgatcttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggtttacgtgtattattttcaatatcttaataccctaataaagagtccataaaaatccaaa

SEQ ID NO: 20204 - DNA, 2520 bp, Homo sapiens
  ENST00000503414
aacttcaatttttctgcagtggctctgggtccagccccttacttaaagatctggaaagcatgaagactgggctttttttcctatgtctcttgggaactgcagctgcaatcccggtgaaaaggagataagaagcaaaggagcaaaccaaacctaatatgaatcctgtactttggccagaagccgtggctcacatctgtaatcccagcactttgggaggccaagacaaatgcaagattattatctgatcattccaaaccaactgctgaaacggtagcacctgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggccaagaaagcagagaactcatcaaatgaggaggaaacgtcaagtgaaggcaacatgagggtgcatgctgtggattcttgcatgagcttccagtgtaaaagaggccacatctgtaaggcagaccaacagggaaaacctcactgtgtctgccaggatccagtgacttgtcctccaacaaaaccccttgatcaagtttgtggcactgacaatcagacctatgctagttcctgtcatctattcgctactaaatgcagactggaggggaccaaaaaggggcatcaactccagctggattattttggagcctgcaaatctattcctacttgtacggactttgaagtgattcagtttcctctacggatgagagactggctcaagaatatcctcatgcagctttatgaagccaactctgaacacgctggttatctaaatgagaagcagagaaataaagtcaagaaaatttacctggatgaaaagaggcttttggctggggaccatcccattgatcttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaaga

SEQ ID NO: 20205 - DNA, 818 bp, Homo sapiens
  ENST00000541496
agaattagctctttcccttttggtttgcaagcactgcctgtaaagccctcgcatgagaggccagcctgctagggaaatccaggaatctgcaacaaaaacgatgacagtctgaaatactctctggtgccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaagatctggaaagcatgaagactgggctttttttcctatgtctcttgggaactgcagctgcaatcccgtttttaattttttcagacaaatgcaagattattatctgatcattccaaaccaactgctgaaacggtagcacctgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagcctcaggagaaaaaactctcagagaacactgattttttggctcctgg

SEQ ID NO: 20206 - DNA, 583 bp, Homo sapiens
  ENST00000509407
attgtctgaggcaaaaagacatcaagtcctttcatgctgtcctgggaaaggcggtttggaacaagttatcctgattctagagacaggggattcaacttcaatttttctgcagtggctctgggtccagccccttacttaaagatctggaaagcatgaagactgggctttttttcctatgtctcttgggaactgcagctgcaatcccgacaaatgcaagattattatctgatcattccaaaccaactgctgaaacggtagcacctgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagcctcaggagaaaaaactctcagagaacactgattttttggctcctgg

SEQ ID NO: 20207 - DNA, 950 bp, Homo sapiens
  ENST00000434434
ggctctgagaacaagagcttgaggggaagactgttaaccccatccacgccaccagaattagctctttcccttttggtttgcaagcactgcctgtaaagccctcgcatgagaggccagcctgctagggaaatccaggaatctgcaacaaaaacgatgacagtctgaaatactctctggtgccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaaggccataagatgttttattgaaagaaactttcaatatcaagtaatccaaccaaccttctaagataagccttttccttcaacacaaagaagtgcattttgccaaatctggaaagcatgaagactgggctttttttcctatgtctcttgggaactgcagctgcaatcccgacaaatgcaagattattatctgatcattccaaaccaactgctgaaacggtagcacctgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagcctcaggagaaaaaactctcagagaacactgattttttgg

SEQ ID NO: 20208 - DNA, 561 bp, Homo sapiens
  ENST00000535835
taaagttattcaatctcctgagcctaacagcaatgtagaaacggaactttttgcttttccaaaaggccataagatgttttattgaaagaaactttcaatatcaagtaatccaaccaaccttctaagataagccttttccttcaacacaaagaagtgcattttgccaaatctggaaagcatgaagactgggctttttttcctatgtctcttgggaactgcagctgcaatcccgacaaatgcaagattattatctgatcattccaaaccaactgctgaaacggtagcacctgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtga

SEQ ID NO: 20209 - DNA, 587 bp, Homo sapiens
  ENST00000512317
aaaaagacatcaagtcctttcatgctgtcctgggaaaggcggtttggaacaagttatcctgattctagagacgatgcaaagcactgtgctaggcaccaggagaatgcagaaagggcacatccccttccttcaaggagtttacagctttctcagaagcagaggggattcaacttcaatttttctgcagtggctctgggtccagccccttacttaaagatctggaaagcatgaagactgggctttttttcctatgtctcttgggaactgcagctgcaatcccgacaaatgcaagattattatctgatcattccaaaccaactgctgaaacggtagcacctgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattg

SEQ ID NO: 20210 - DNA, 583 bp, Homo sapiens
  ENST00000543631
actagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaaggtattaaaggtcactctgcaagagaaaaaaagaaaagaaaggaaaagaaaagaaaaaaaaacatgcttttaactgcagatcaatactgttgaaacagtacaccaagagatctggaaagcatgaagactgggctttttttcctatgtctcttgggaactgcagctgcaatcccgacaaatgcaagattattatctgatcattccaaaccaactgctgaaacggtagcacctgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaag

SEQ ID NO: 20211 - DNA, 568 bp, Homo sapiens
  ENST00000458304
actgcctgtaaagccctcgcatgagaggccagcctgctagggaaatccaggaatctgcaacaaaaacgatgacagtctgaaatactctctggtgccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaagttattcaatctcctgagcctaacagcaatgtagaaacggaactttttgcttttccaaaagatctggaaagcatgaagactgggctttttttcctatgtctcttgggaactgcagctgcaatcccgacaaatgcaagattattatctgatcattccaaaccaactgctgaaacggtagcacctgacaacactgcaatccccagtttaagggctgaagctgaagaaaatgaaaaagaaacag

SEQ ID NO: 20212 - DNA, 2994 bp, Homo sapiens
  ENST00000418378
aaaaatgcataaagagccaagtgcttatattctggccaagttatgaggctctgagaacaagagcttgaggggaagactgttaaccccatccacgccaccagaattagctctttcccttttggtttgcaagcactgcctgtaaagccctcgcatgagaggccagcctgctagggaaatccaggaatctgcaacaaaaacgatgacagtctgaaatactctctggtgccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaaggccataagatgttttattgaaagaaactttcaatatcaagtaatccaaccaaccttctaagataagccttttccttcaacacaaagaagtgcattttgccaaatctggaaagcatgaagactgggctttttttcctatgtctcttgggaactgcagctgcaatcccgacaaatgcaagattattatctgatcattccaaaccaactgctgaaacggtagcacctgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggccaagaaagcagagaactcatcaaatgaggaggaaacgtcaagtgaaggcaacatgagggtgcatgctgtggattcttgcatgagcttccagtgtaaaagaggccacatctgtaaggcagaccaacagggaaaacctcactgtgtctgccaggatccagtgacttgtcctccaacaaaaccccttgatcaagtttgtggcactgacaatcagacctatgctagttcctgtcatctattcgctactaaatgcagactggaggggaccaaaaaggggcatcaactccagctggattattttggagcctgcaaatctattcctacttgtacggactttgaagtgattcagtttcctctacggatgagagactggctcaagaatatcctcatgcagctttatgaagccaactctgaacacgctggttatctaaatgagaagcagagaaataaagtcaagaaaatttacctggatgaaaagaggcttttggctggggaccatcccattgatcttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggtttacgtgtattattttcaatatcttaataccctaataaagagtcc

SEQ ID NO: 20213 - DNA, 1721 bp, Homo sapiens
  ENST00000439928
cccgggacagtttccagtcggcttctccgtgaccttcctcccccttccagctcggagcgggatgctgggatccctccaaggaccctctgaggacgtaggagggatgctgagacagggccagcttcaaaccttgtcaagctctgacaagggaagatgaagcctagttccagctaggggtgacctgtctatctgcattttttgagctgcagagtgatgggagtcatattcgctgcctgtgcagcaccacaggcctgatgaaaatgaaatggcaacaccgtgcagatggcaaagcgtaggcctcacaaacatcctggccgtgaagagcttgtcttcaagagtagctggtgcagaaactcgctcggactgacctggaagaagaccctgaggagaacccgggcacacagcagccattccagtcctcagcttcaagggggctcacgaaggttgtggatccttgcccagcctgcagtggggacctggtgtggcattgagtggctgtgagtgctcagtgtcccccatctcatgctaagcacagcgaagtagggggagattgcgtagtgtgctgatggagcagttgcctccacctggctgcgtgtccctccgtcatgtgacagaaaagaagaaggcaatggtgtttttctgtagcaagtcactatttatggaagaggagaccctttatctgcatcgcaattctgaagattccactttgttccagtcattgttgtgggcacactttcaacatttgattaagagccataagggtggcttcctccacccacagaaaaattcctctaaggaatcatgagaccgtcgacatttagcagctgtttaaaagactgtttagactcctgggatgatgatggggaattcctggaattatggtcttgggcaagaagggaactcaagtaggaaagtcagcaatctaaatttcaaacctcagggaaccttctttgtataacctgataatctccttcgctcaacacagtgcttgctgagtgaaggagtgtaatggaaaagaaagttaataatcccttgtgctctggatcaaaaatgaggtaggagaccaaattttccatcaaactggttgggtccaatcacttaatgcaaaatgcttacttcagggtctgtagcacttgttgatcaatgtacctaacaggtcttaatagagaaagtgatcaattcaagcagtgtcttcccaaattctatatatatataacagatattgctgcataacaaaccagacaacgcttaatagtttaaggcaaccgttttattattccccagagttctatgcgtggaccaaggtcacttgggccctagtcttgtgatgtcacttggaccacagtcattgggaggttcaccaggtggaagcctccatgacagctcaatcccatagctgccagtgggtacggcacctacacgtggctgcttgtatggcctgggattttcacagcacagcagcaggggctgagaggcagagtcctaggagtgattgtccccagagagcagaagcaaaagctctcatcagtcttctaagaggctgagctgacaatgggcacagcaccactctgccatcatctatggcttaagcattcacagggccaggctaaattcaggctgtcggaagataaactccacctctcaatggagagagttcaaagcaactgtggccatctttaccccatcagctttcttgccaagaaataaagctctacatgaca

SEQ ID NO: 20214 - DNA, 8603 bp, Homo sapiens
  ENST00000424834
gcgcacccgggacagtttccagtcggcttctccgtgaccttcctcccccttccagctcggagcgggatgctgggatccctccaaggaccctctgaggacgtaggagggatgctgagacagggccagcttcaaaccttgtcaagctctgacaagggaagatgaagcctagttccagctaggggtgacctgtctatctgcattttttgagctgcagagtgatgggagtcatattcgctgcctgtgcagcaccacaggcctgatgaaaatgaaatggcaacaccgtgcagatggcaaagcgtaggcctcacaaacatcctggccgtgaagagcttgtcttcaagagtagctggtgcagaaactcgcccgtggccacccaggagcccgatgtgcaaggcaggtgtgagtgccaggacggcattcctggagatgaaggcctggagctgcggtctgcggactcggcagtgcccgtggccatgacccaggctgccgtgcggccctgggcaccctgcctggagaacatgaccactgccccaaacggcctcgggccaggccccgcagccccctgtgcaggctcggacctgaaagacgccaagatggtgacctcccttgcgtgtggaaatggagtctgtggctgcagccctggtggcgacacggacacccaggaagccaaactcagcccagccaagcttgtgcgcctcttttccaccagtcggaagaggacgggtgcccaccccgagcggccccactccatggtcctggtggggaactcctccacatggaacaccctcgcctccttccggaaaatgggatcctttaagaaactgaagtcctcagtcctgaaaggaattcagagccgagaggggtcaaatgcctgttcaaagggagaggcttcggagcatggcctgggaaagtccatcccaaatggcgctgtcccaggagcccaggcaagcaggggctcccccttagcaccgggaccagcatgtggtgccctcaggccagcagagtggggcacattggatggctccgacctcgaggacacggacgatgccttccagcggagcacacaccgctcccgcagcctccgcagagcctacggcctgggccgcatctgcctgctggatgcgccccagaaccatgcgacacccacgatagccactggccaggtgcccgccgtgtgtgagattctcgtgagggaccctgaaaacaacagcatgggctacaggaggagcaagagcacggacaatcttgcctttctgaagaagagctcctttaagcggaagtccacctccaatcttgcagacctcaggacggcccatgacgcacgggtaccacagaggaccctgagcagttcctccactgactcccaaaagcttgggtcaggaaggaccaaacgctggaggagcccgataagggccaaggactttgacagagtcttcaaacttgtgagcaatgtgactgaggctgcctggaggagggagagtcctaggagtggggccccatcccctggagaggccagcctgagacttcaggcacacagccggctgcatgacgactactcccgccgcgtctccaggagcactgagcaggacagcaggcggggcggggcggtcatgcatgggaccactgcaacctgcaccgtggcccccggtttcggctcagccacctctaaggggccccacctagacgctgacactgccgtatttcctcttgaaaccaaaagttcctgggcggtggaaagcgacagttcctgcacttgcagctctttgccaagcccgattgtccaggatgtgttgagcaaagactcctgtgacccaaacgctggcagccagttgacatttgaccctgagcagcctcccacccctctaaggcccaccacacccaagccccagagccctcagagcccccagagccccggggcaggaagtgccagctgtcacagcaatcacagtgccctgtccgcgaattcagaggaaagtgaaggaagggcagaagagcctgctcagagagagccagggcctgtgtccttgcaggatcccctggaagccacacatggtgatgagggcagcaaggaccttctggtgaacattggtgtggcagccggcccagaagaaaaggagaaggaggaggtcgtccctgatggcccctggaggcgaagctcatcacaggatgaggaaaggacagaggcacagagaacccccaagaggagatggggctctgggagacggccaaggcctcggccattctctgactacggccagctggccagccgcagtttgtctattcctgaagactcggttgctgcagacccccagaaggaagaccgtgtggacgaggacccccaggcaagcatgacttctgccagccctgaagaccagaatgctccagtgggctgccccaaaggagcccggagaaggcgccccatttccgtgataggtggggtcagcttgtatgggaccaaccagacggaggaactggacaatcttctgacccaaccggcttccaggccgcccatgcctgctcaccaggtgccaccctacaaggctgtgtcggcccggttccggcccttcacattctcccagagcacccccattgggttggaccgtgtgggacgccggcggcagatgagagcatccaacgtttcttcagatggaggtactgagccctctgccttagtggatgacaacggtagtgaggaggacttcagctatgaagacctctgccaggccagccctcggtacctgcagcccggcggggagcagctggccatcaatgagctgatcagtgatggcaacgtggtctgcgcagaagccctgtgggaccatgtgaccatggatgaccaggaactgggcttcaaagccggggatgtcatccaggttctggaagcctccaacaaggactggtggtggggccgcagtgaagataaggaagcctggttccccgcgagcttcgtcagattgcgagtgaatcaggaagagctgtcggaaaactccagcagcacccccagtgaggagcaggacgaggaggccagccagagccgccacagacactgtgagaacaagcagcagatgcggaccaacgtcatccgggagatcatggacaccgagcgggtgtacatcaaacacctcagggacatctgtgagggctatatccgacagtgccgcaagcacacaggaatgttcaccgttgcgcagctagccactatttttggaaacattgaagatatttacaaattccaaagaaagtttctgaaagaccttgagaaacagtacaacaaagaggaacctcacttaagtgaaataggatcttgctttcttcaaaatcaagagggctttgccatctattccgagtactgcaacaaccacccgggcgcctgcctggagctcgccaacctcatgaagcagggcaagtacagacatttctttgaagcctgccgcctgctgcagcagatgattgacatcgccatcgacgggttcctgctcacaccagtgcagaagatctgcaaatacccgctgcagctggccgagctgctcaagtataccacacaggaacacggtgattacagcaacataaaggcagcatatgaggccatgaagaatgtggcctgtctgatcaacgagcgcaagcgcaagctggagagcatcgacaagatagctcgctggcaggtgtctatcgtgggctgggagggactggatatcttagaccgaagctcagaattgattcattctggggagctgaccaaaatcactaagcaaggcaaaagccagcagcggacgttcttcctgtttgaccaccagctggtgtcctgcaagaaggacctgctgcgcagggacatgctgtactacaagggccggctggacatggatgagatggagcttgtggacctgggggatgggcgcgacaaggactgcaacctcagcgtgaaaaatgccttcaagctcgtcagtaggaccacagacgaggtttatttgttttgtgccaaaaaacaagaagacaaggcgaggtggctgcaggcctgtgcagatgaaaggaggcgggtgcaagaggacaaggagatgggaatggaaatttcagaaaaccagaagaaacttgccatgttaaatgctcaaaaggcaggacatggaaagtcaaaaggctacaacaggtgccctgtggccccaccgcaccagggcctgcaccccatccaccagcgccacatcactatgcccacaagcgtcccccagcagcaggtctttggcctggcggaacccaagaggaagtcctcgctcttctggcacaccttcaacaggctcacccccttccggaaatgaaaacaggaggctgtgcttccatggagctgggtgtcaagagaagaactgtctttgtttcttgtgtgcttcaatccagggaaagtttcttggacccagtgataaaaacttccttttagggatcaatgaaggagagaaggtcttggaatcaccttcagtctttggagacccagctgcctttgtggaagggaggagacggtcatgacacaaagctttatcctacacagaaacacccgtgacccactatgagatggcccagatgtgggacccggtaccatgctctaaagcgagtgattaggcagcagctgaagccacccctgctgatgatgagcaagtgcctgctgcaggtccaaacacagcatccagggctttgcagttcctaaggagtgatgaggttagaggatcacttctgcatttgattttcaaggatgccgtcaagacggggttgacacaatgctgcacgtgtctggtcacacttagaaattgagctcttactctcttctgtaatactgggggacctacagctgccgtggggctgaccacggtgttccctggcatcgtctgtgtccacacagatgctaactggtagtgcaaatgtcatcctgcaaggttcctcttcctgcaagcaaagtggagagaaagaagatgcatctgtcaccttcatcagggtcctcagtgcagagcaacttacgcatcctcaagaatccactgcttttcaggcaaggagggagaaatcctgctgcacactggctttgtcccggagtcggattccctcctgcctgcacgccttcagtaactccgagcagaaatcacatcttgcccacatgctgtaacctaagaaactgctatgcaaggctgggtgctgtggctcatgcctgtaatcccagcactttgggaggccaaggcaggtggatcacctgaggtcaggagttcgagacaagcgtggccaatatggcaaagcccagtctctactaataatacaaaaattagctgggcatggtggcgcatgcctgtaatcccagctactgggaaggctgaggtaggagaatcttttgaatctgggaagcggaggttgcagtgagctgagatcgcaccactgcactccagcctgggagatacagcgagactgtctccaaaaacaaaaacaaaaacaaaaaacattcaaacaactgtttgcaatataaaaagctcatttactgtaatatttatgatacagtgaatatgaaaatgcactggtcagaaggcactctcaaagagccgcactgctcctgacatcgtccttagcaatgaagtcacaaagacagccaaagcagtcctgcttcttggaaatcagaagctgcctttatcacatataaagccaaacagggcataaccatgtcacgtgagcatgtcatcaggcttctgaggacttgttctttataaaaaaagaccttcacaaaatatcttggcttagagatagcagtctttattaacaaaggccacctaggctgacacctgcagataatcatctccttttctttgtctatgttgtacattttcatgatataacttttaactatgtctagagaaggcaggctctgcaagagaggtgccctttcaacccgctcagtgccctggacaggagatgctgtgttaaactgttaatggatatctatatgagaagctcatttttgtatgctatccctgcagtttttttttttctaacaggcccatgtttgagaataaacaagtctgtgatgtcagagacaaaggtgtattcttcagtctgcaggtgtgtggcacctcccttctcccctgcagccccccacatccagagccgttcctgagagtgacatcatgcatcaagaaaacataaccttggtcctcaggtgaacccttggaacattctgtgaccgcctgatgtccattctgagccaccttggcacacatgcttacaggcagcactgctaagggttcaggtgccccatggctgacagcccgagttgcttctgtggaccatcatgccgctcggcacgtcctgagacagaagttgctgcaggaaggagcttctggagaggtcctgtggcatgtgtgggggtgtgtgtgtgtatgtttccttcttgaacagacattccaactttagatgtgtttatagaactgacctttttactaacaaaatacaatgatatatgttggaaactacttaatatgcttttcctgcacaccttagcaataactgtaggggtctctgctagagttgtttgtatgtacagcaattttgaacaaattgttttaaatgtaatataagagaattagtttaaggaagtaaagagaatcatttgcttgtgttacattttcagtgaggattcagtttaagagtcattcttaggacttccatttcctaatatttattcatgggtaatgaagaaatggtttgcattttgtggccagtcctaatttattttccagctgagccctaacttccggctcccacctacctccacggacttcctaacagagacttatgaataccaggatgtgtttttgttaagtcaggttcaattcgttgcccctgtcagttttatagagtgtgagggtcactccattaaagatctctcctgggtggatcctacttggatgttcaggtgattttgaaaactgctaacatttttaaaaggctagaacatcctttgacttcttgaaaatctgcatgtctggcttgggttttattaccacatgcctgagttcttcaagaatggaaggctcaagtattctcatcttccatttgccaaacttccttcctgatttgagtcacgtgttccacttggaaagaaagggaacagagagcctcctccatggacagtgtatgaatttcattgggaatcttgctctctcccgcctctatgcctttctctctttttaaccttactttacataatattatagatgggccaagaaaagaaaagatgacataacattttgatgaatttcacctattccattcttcacgtttcagaattggtcgactttgttagaagataattgaagtagccttgggtcaaaagcaaccttttcaattgtgatcatacctaaaacatataaaaaccctgccgtagattaaaagcaattataaaatcataaaattgaatgtttgcagaatcctggagcagtagatttctttgtctttggcctgcggactagaaagagggcagcagtagtatgctggagcttccctgggataccagccacatggtttcttttcattagatctgatttttgtttcccactgtagatctgattttgtagttgaaaacatttcaccaccatcaaacactatttctgaatattgtgcctttttatacctagcctagatgaaaaccgatgccattcttattcagaaaatccccccatcctacatgactgttatctagacataaagcaaagtgcatttaattcaaaatttggttcacaatataagtattttgtaaaagccagctgaaccagcattttatcaggtggaaatctctgcaagccaaattgctgatactccttcatgcagatcaacttggtgtcccagtcagaatagaacagcataattacctggagttagggggagtatttctgcactattacttgtcagggagagaagaaacttagaattgtccctcaaaggagtgtcaagaagtatgaataaatgtcctttcaccagctcacaggccagaaatggaggacccaagtcaactaggtgaaactactagcagacccagctttcccataataacctaatctgcaaattgttctattaaagtctcattgttttcaggatgcaatgaaagtggatttcaaaaggctttggaaaaataagtggaacatgactgatcttgaaaaaaaaagcaaaagcttaaatatttgatacaagtttacttagctacaacatactttacattgttgcctttagttatctcacaggcactgacattttatatttagaaaatacttttaatctttctaatctttttttgtaaatattagtgtccattctgtatgactcgctaacctactttgcaaggctttgggcaacattttagctcattaacttcaagatgatgtgtcatctgtataggtcaaagaatgggacttctgaactgaggaatttgctgttgacagccaaagtatagtgtacaagattgatgtaacttgatatgtatttttgttgaagttttttgtaaaaaaaaattatttacaatgttatttgaatgatttttttaaatgctgtgaatctatatttgttgttttgtatattaaaattcatttgccaaa

SEQ ID NO: 20215 - DNA, 2191 bp, Homo sapiens
  ENST00000466831
gtgtgctgccgcggcgcgggaggagagtgtgcgttgcgctttctcccgcgatcgccctgccggtcgctagctccgagggcgcgcactggatcccaggctcctccgagagtgcggcgacctcggggctccgccggcaccggaggtggctctgagggcagggacgtgttggacacgctgactttgtaggctccgccaagaggcgccgcaggagcccgtggccacccaggagcccgatgtgcaaggcaggtgtgagtgccaggacggcattcctggagatgaaggcctggagctgcggtctgcggactcggcagtgcccgtggccatgacccaggctgccgtgcggccctgggcaccctgcctggagaacatgaccactgccccaaacggcctcgggccaggccccgcagccccctgtgcaggctcggacctgaaagacgccaagatggtgacctcccttgcgtgtggaaatggagtctgtggctgcagccctggtggcgacacggacacccaggaagccaaactcagcccagccaagcttgtgcgcctcttttccaccagtcggaagaggacgggtgcccaccccgagcggccccactccatggtcctggtggggaactcctccacatggaacaccctcgcctccttccggaaaatgggatcctttaagaaactgaagtcctcagtcctgaaaggaattcagagccgagaggggtcaaatgcctgttcaaagggagaggcttcggagcatggcctgggaaagtccatcccaaatggcgctgtcccaggagcccaggcaagcaggggctcccccttagcaccgggaccagcatgtggtgccctcaggccagcagagtggggcacattggatggctccgacctcgaggacacggacgatgccttccagcggagcacacaccgctcccgcagcctccgcagagcctacggcctgggccgcatctgcctgctggatgcgccccagaaccatgcgacacccacgatagccactggccaggtgcccgccgtgtgtgagattctcgtgagggaccctgaaaacaacagcatgggctacaggaggagcaagagcacggacaatcttgcctttctgaagaagagctcctttaagcggaagtccacctccaatcttgcagacctcaggacggcccatgacgcacgggtaccacagaggaccctgagcagttcctccactgactcccaaaagcttgggtcaggaaggaccaaacgctggaggagcccgataagggccaaggactttgacagagtcttcaaacttgtgagcaatgtgactgaggctgcctggaggagggagagtcctaggagtggggccccatcccctggagaggccagcctgagacttcaggcacacagccggctgcatgacgactactcccgccgcgtctccaggagcactgagcaggacagcaggcggggcggggcggtcatgcatgggaccactgcaacctgcaccgtggcccccggtttcggctcagccacctctaaggggccccacctagacgctgacactgccgtatttcctcttgaaaccaaaagttcctgggcggtggaaagcgacagttcctgcacttgcagctctttgccaagcccgattgtccaggatgtgttgagcaaagactcctgtgacccaaacgctggcagccagttgacatttgaccctgagcagcctcccacccctctaaggcccaccacacccaagccccagagccctcagagcccccagagccccggggcaggaagtgccagctgtcacagcaatcacagtgccctgtccgcgaattcagaggaaagtgaaggaagggcagaagagcctgctcagagagagccagggcctgtgtccttgcaggatcccctggaagccacacatggtgatgagggcagcaaggaccttctggtgaacattggtgtggcagccggcccagaagaaaaggagaaggaggaggtaagggcagcggcgaggtccctcatgtgggcgaccctcctgcgggaagggagcttgcacaggtgttgcccttggtccctaacctgtcaaggtcagtggccctctgctgaccttgttgcccttacagtattagtgggaatgggagttgtcaagttgctgtttaccaagttcagaagtaatctctatctcctttgaaataaattgacaatgtacgag

SEQ ID NO: 20216 - DNA, 6665 bp, Homo sapiens
  ENST00000382095
gtgtgcgttgcgctttctcccgcgatcgccctgccggtcgctagctccgagggcgcgcactggatcccaggctcctccgagagtgcggcgacctcggggctccgccggcaccggaggtggctctgagggcagggacgtgttggacacgctgactttgtaggctccgccaagaggcgccgcaggaggtcgtccctgatggcccctggaggcgaagctcatcacaggatgaggaaaggacagaggcacagagaacccccaagaggagatggggctctgggagacggccaaggcctcggccattctctgactacggccagctggccagccgcagtttgtctattcctgaagactcggttgctgcagacccccagaaggaagaccgtgtggacgaggacccccaggcaagcatgacttctgccagccctgaagaccagaatgctccagtgggctgccccaaaggagcccggagaaggcgccccatttccgtgataggtggggtcagcttgtatgggaccaaccagacggaggaactggacaatcttctgacccaaccggcttccaggccgcccatgcctgctcaccaggtgccaccctacaaggctgtgtcggcccggttccggcccttcacattctcccagagcacccccattgggttggaccgtgtgggacgccggcggcagatgagagcatccaacgtttcttcagatggaggtactgagccctctgccttagtggatgacaacggtagtgaggaggacttcagctatgaagacctctgccaggccagccctcggtacctgcagcccggcggggagcagctggccatcaatgagctgatcagtgatggcaacgtggtctgcgcagaagccctgtgggaccatgtgaccatggatgaccaggaactgggcttcaaagccggggatgtcatccaggttctggaagcctccaacaaggactggtggtggggccgcagtgaagataaggaagcctggttccccgcgagcttcgtcagattgcgagtgaatcaggaagagctgtcggaaaactccagcagcacccccagtgaggagcaggacgaggaggccagccagagccgccacagacactgtgagaacaagcagcagatgcggaccaacgtcatccgggagatcatggacaccgagcgggtgtacatcaaacacctcagggacatctgtgagggctatatccgacagtgccgcaagcacacaggaatgttcaccgttgcgcagctagccactatttttggaaacattgaagatatttacaaattccaaagaaagtttctgaaagaccttgagaaacagtacaacaaagaggaacctcacttaagtgaaataggatcttgctttcttcaaaatcaagagggctttgccatctattccgagtactgcaacaaccacccgggcgcctgcctggagctcgccaacctcatgaagcagggcaagtacagacatttctttgaagcctgccgcctgctgcagcagatgattgacatcgccatcgacgggttcctgctcacaccagtgcagaagatctgcaaatacccgctgcagctggccgagctgctcaagtataccacacaggaacacggtgattacagcaacataaaggcagcatatgaggccatgaagaatgtggcctgtctgatcaacgagcgcaagcgcaagctggagagcatcgacaagatagctcgctggcaggtgtctatcgtgggctgggagggactggatatcttagaccgaagctcagaattgattcattctggggagctgaccaaaatcactaagcaaggcaaaagccagcagcggacgttcttcctgtttgaccaccagctggtgtcctgcaagaaggacctgctgcgcagggacatgctgtactacaagggccggctggacatggatgagatggagcttgtggacctgggggatgggcgcgacaaggactgcaacctcagcgtgaaaaatgccttcaagctcgtcagtaggaccacagacgaggtttatttgttttgtgccaaaaaacaagaagacaaggcgaggtggctgcaggcctgtgcagatgaaaggaggcgggtgcaagaggacaaggagatgggaatggaaatttcagaaaaccagaagaaacttgccatgttaaatgctcaaaaggcaggacatggaaagtcaaaaggctacaacaggtgccctgtggccccaccgcaccagggcctgcaccccatccaccagcgccacatcactatgcccacaagcgtcccccagcagcaggtctttggcctggcggaacccaagaggaagtcctcgctcttctggcacaccttcaacaggctcacccccttccggaaatgaaaacaggaggctgtgcttccatggagctgggtgtcaagagaagaactgtctttgtttcttgtgtgcttcaatccagggaaagtttcttggacccagtgataaaaacttccttttagggatcaatgaaggagagaaggtcttggaatcaccttcagtctttggagacccagctgcctttgtggaagggaggagacggtcatgacacaaagctttatcctacacagaaacacccgtgacccactatgagatggcccagatgtgggacccggtaccatgctctaaagcgagtgattaggcagcagctgaagccacccctgctgatgatgagcaagtgcctgctgcaggtccaaacacagcatccagggctttgcagttcctaaggagtgatgaggttagaggatcacttctgcatttgattttcaaggatgccgtcaagacggggttgacacaatgctgcacgtgtctggtcacacttagaaattgagctcttactctcttctgtaatactgggggacctacagctgccgtggggctgaccacggtgttccctggcatcgtctgtgtccacacagatgctaactggtagtgcaaatgtcatcctgcaaggttcctcttcctgcaagcaaagtggagagaaagaagatgcatctgtcaccttcatcagggtcctcagtgcagagcaacttacgcatcctcaagaatccactgcttttcaggcaaggagggagaaatcctgctgcacactggctttgtcccggagtcggattccctcctgcctgcacgccttcagtaactccgagcagaaatcacatcttgcccacatgctgtaacctaagaaactgctatgcaaggctgggtgctgtggctcatgcctgtaatcccagcactttgggaggccaaggcaggtggatcacctgaggtcaggagttcgagacaagcgtggccaatatggcaaagcccagtctctactaataatacaaaaattagctgggcatggtggcgcatgcctgtaatcccagctactgggaaggctgaggtaggagaatcttttgaatctgggaagcggaggttgcagtgagctgagatcgcaccactgcactccagcctgggagatacagcgagactgtctccaaaaacaaaaacaaaaacaaaaaacattcaaacaactgtttgcaatataaaaagctcatttactgtaatatttatgatacagtgaatatgaaaatgcactggtcagaaggcactctcaaagagccgcactgctcctgacatcgtccttagcaatgaagtcacaaagacagccaaagcagtcctgcttcttggaaatcagaagctgcctttatcacatataaagccaaacagggcataaccatgtcacgtgagcatgtcatcaggcttctgaggacttgttctttataaaaaaagaccttcacaaaatatcttggcttagagatagcagtctttattaacaaaggccacctaggctgacacctgcagataatcatctccttttctttgtctatgttgtacattttcatgatataacttttaactatgtctagagaaggcaggctctgcaagagaggtgccctttcaacccgctcagtgccctggacaggagatgctgtgttaaactgttaatggatatctatatgagaagctcatttttgtatgctatccctgcagtttttttttttctaacaggcccatgtttgagaataaacaagtctgtgatgtcagagacaaaggtgtattcttcagtctgcaggtgtgtggcacctcccttctcccctgcagccccccacatccagagccgttcctgagagtgacatcatgcatcaagaaaacataaccttggtcctcaggtgaacccttggaacattctgtgaccgcctgatgtccattctgagccaccttggcacacatgcttacaggcagcactgctaagggttcaggtgccccatggctgacagcccgagttgcttctgtggaccatcatgccgctcggcacgtcctgagacagaagttgctgcaggaaggagcttctggagaggtcctgtggcatgtgtgggggtgtgtgtgtgtatgtttccttcttgaacagacattccaactttagatgtgtttatagaactgacctttttactaacaaaatacaatgatatatgttggaaactacttaatatgcttttcctgcacaccttagcaataactgtaggggtctctgctagagttgtttgtatgtacagcaattttgaacaaattgttttaaatgtaatataagagaattagtttaaggaagtaaagagaatcatttgcttgtgttacattttcagtgaggattcagtttaagagtcattcttaggacttccatttcctaatatttattcatgggtaatgaagaaatggtttgcattttgtggccagtcctaatttattttccagctgagccctaacttccggctcccacctacctccacggacttcctaacagagacttatgaataccaggatgtgtttttgttaagtcaggttcaattcgttgcccctgtcagttttatagagtgtgagggtcactccattaaagatctctcctgggtggatcctacttggatgttcaggtgattttgaaaactgctaacatttttaaaaggctagaacatcctttgacttcttgaaaatctgcatgtctggcttgggttttattaccacatgcctgagttcttcaagaatggaaggctcaagtattctcatcttccatttgccaaacttccttcctgatttgagtcacgtgttccacttggaaagaaagggaacagagagcctcctccatggacagtgtatgaatttcattgggaatcttgctctctcccgcctctatgcctttctctctttttaaccttactttacataatattatagatgggccaagaaaagaaaagatgacataacattttgatgaatttcacctattccattcttcacgtttcagaattggtcgactttgttagaagataattgaagtagccttgggtcaaaagcaaccttttcaattgtgatcatacctaaaacatataaaaaccctgccgtagattaaaagcaattataaaatcataaaattgaatgtttgcagaatcctggagcagtagatttctttgtctttggcctgcggactagaaagagggcagcagtagtatgctggagcttccctgggataccagccacatggtttcttttcattagatctgatttttgtttcccactgtagatctgattttgtagttgaaaacatttcaccaccatcaaacactatttctgaatattgtgcctttttatacctagcctagatgaaaaccgatgccattcttattcagaaaatccccccatcctacatgactgttatctagacataaagcaaagtgcatttaattcaaaatttggttcacaatataagtattttgtaaaagccagctgaaccagcattttatcaggtggaaatctctgcaagccaaattgctgatactccttcatgcagatcaacttggtgtcccagtcagaatagaacagcataattacctggagttagggggagtatttctgcactattacttgtcagggagagaagaaacttagaattgtccctcaaaggagtgtcaagaagtatgaataaatgtcctttcaccagctcacaggccagaaatggaggacccaagtcaactaggtgaaactactagcagacccagctttcccataataacctaatctgcaaattgttctattaaagtctcattgttttcaggatgcaatgaaagtggatttcaaaaggctttggaaaaataagtggaacatgactgatcttgaaaaaaaaagcaaaagcttaaatatttgatacaagtttacttagctacaacatactttacattgttgcctttagttatctcacaggcactgacattttatatttagaaaatacttttaatctttctaatctttttttgtaaatattagtgtccattctgtatgactcgctaacctactttgcaaggctttgggcaacattttagctcattaacttcaagatgatgtgtcatctgtataggtcaaagaatgggacttctgaactgaggaatttgctgttgacagccaaagtatagtgtacaagattgatgtaacttgatatgtatttttgttgaagttttttgtaaaaaaaaattatttacaatgttatttgaatgatttttttaaatgctgtgaatctatatttgttgttttgtatattaaaattcatttgccaaactc

SEQ ID NO: 20217 - DNA, 529 bp, Homo sapiens
  ENST00000474317
gatgtgttgagcaaagactcctgtgacccaaacgctggcagccagttgacatttgaccctgagcagcctcccacccctctaaggcccaccacacccaagccccagagccctcagagcccccagagccccggggcaggaagtgccagctgtcacagcaatcacagtgccctgtccgcgaattcagaggaaagtgaaggaagggcagaagagcctgctcagagagagccagggcctgtgtccttgcaggatcccctggaagccacacatggtgatgagggcagcaaggaccttctggtgaacattggtgtggcagccggcccagaagaaaaggagaaggaggaggtcgtccctgatggcccctggaggcgaagctcatcacaggatgaggaaaggacagaggcacagagaacccccaagaggagatggggctctgggagacggccaaggcctcggccattctctgactacggccagctggccagccgcagtttgtctattcctgaagactcggttgctgcagacccccaga

SEQ ID NO: 20218 - DNA, 2001 bp, Homo sapiens
  ENST00000434675
acagattttgctttctttttgcagccggcttccaggccgcccatgcctgctcaccaggtgccaccctacaaggctgtgtcggcccggttccggcccttcacattctcccagagcacccccattgggttggaccgtgtgggacgccggcggcagatgagagcatccaacgtttcttcagatggaggtactgagccctctgccttagtggatgacaacggtagtgaggaggacttcagctatgaagacctctgccaggccagccctcggtacctgcagcccggcggggagcagctggccatcaatgagctgatcagtgatggcaacgtggtctgcgcagaagccctgtgggaccatgtgaccatggatgaccaggaactgggcttcaaagccggggatgtcatccaggttctggaagcctccaacaaggactggtggtggggccgcagtgaagataaggaagcctggttccccgcgagcttcgtcagaggctatatccgacagtgccgcaagcacacaggaatgttcaccgttgcgcagctagccactatttttggaaacattgaagatatttacaaattccaaagaaagtttctgaaagaccttgagaaacagtacaacaaagaggaacctcacttaagtgaaataggatcttgctttcttcaaaatcaagagggctttgccatctattccgagtactgcaacaaccacccgggcgcctgcctggagctcgccaacctcatgaagcagggcaagtacagacatttctttgaagcctgccgcctgctgcagcagatgattgacatcgccatcgacgggttcctgctcacaccagtgcagaagatctgcaaatacccgctgcagctggccgagctgctcaagtataccacacaggaacacggtgattacagcaacataaaggcagcatatgaggccatgaagaatgtggcctgtctgatcaacgagcgcaagcgcaagctggagagcatcgacaagatagctcgctggcaggtgtctatcgtgggctgggagggactggatatcttagaccgaagctcagaattgattcattctggggagctgaccaaaatcactaagcaaggcaaaagccagcagcggacgttcttcctgtttgaccaccagctggtgtcctgcaagaaggacctgctgcgcagggacatgctgtactacaagggccggctggacatggatgagatggagcttgtggacctgggggatgggcgcgacaaggactgcaacctcagcgtgaaaaatgccttcaagctcgtcagtaggaccacagacgaggtttatttgttttgtgccaaaaaacaagaagacaaggcgaggtggctgcaggcctgtgcagatgaaaggaggcgggtgcaagaggacaaggagatgggaatggaaatttcagaaaaccagaagaaacttgccatgttaaatgctcaaaaggcaggacatggaaagtcaaaaggctacaacaggtgccctgtggccccaccgcaccagggcctgcaccccatccaccagcgccacatcactatgcccacaagcgtcccccagcagcaggtctttggcctggcggaacccaagaggaagtcctcgctcttctggcacaccttcaacaggctcacccccttccggaaatgaaaacaggaggctgtgcttccatggagctgggtgtcaagagaagaactgtctttgtttcttgtgtgcttcaatccagggaaagtttcttggacccagtgataaaaacttccttttagggatcaatgaaggagagaaggtcttggaatcaccttcagtctttggagacccagctgcctttgtggaagggaggagacggtcatgacacaaagctttatcctacacagaaacacccgtgacccactatgagatggcccagatgtgggacccggtaccatgctctaaagcgagtgattaggcagcagctgaagccacccctgctgatgatgagcaagtgcctgctgcaggtcc

SEQ ID NO: 20219 - DNA, 301 bp, Homo sapiens
  ENST00000494772
ccggcttccaggccgcccatgcctgctcaccaggtgccaccctacaaggctgtgtcggcccggttccggcccttcacattctcccagagcacccccattgggttggaccgtgtgggacgccggcggcagatgagagcatccaacgggtgctttcatgtatcatcattccacttgaggctcaaagcacaccaataacaagtacttgttcagaatgtataaacaaccctgagagatgggttttatcatccacattcaacaggtgaaaaaacaaagaaagaaacttgaccaaggactcatactc

SEQ ID NO: 20220 - DNA, 3026 bp, Homo sapiens
  ENST00000399949
gtttctgggcaggctctggccgggaacgcatacaacgtcaaagcagtgaataagcgatttctgcagttcccgtagctgccagcctgtgcagtcctctgtgatgcttggggaccggctcctcggtcacaccccagtcctgctctgaaggttgccgttttccaaacagaaggatggtagctagaggggagatagcaagattctggagtctggaaagccttcacttggtttcttcagatggaggtactgagccctctgccttagtggatgacaacggtagtgaggaggacttcagctatgaagacctctgccaggccagccctcggtacctgcagcccggcggggagcagctggccatcaatgagctgatcagtgatggcaacgtggtctgcgcagaagccctgtgggaccatgtgaccatggatgaccaggaactgggcttcaaagccggggatgtcatccaggttctggaagcctccaacaaggactggtggtggggccgcagtgaagataaggaagcctggttccccgcgagcttcgtcagattgcgagtgaatcaggaagagctgtcggaaaactccagcagcacccccagtgaggagcaggacgaggaggccagccagagccgccacagacactgtgagaacaagcagcagatgcggaccaacgtcatccgggagatcatggacaccgagcgggtgtacatcaaacacctcagggacatctgtgagggctatatccgacagtgccgcaagcacacaggaatgttcaccgttgcgcagctagccactatttttggaaacattgaagatatttacaaattccaaagaaagtttctgaaagaccttgagaaacagtacaacaaagaggaacctcacttaagtgaaataggatcttgctttcttcaaaatcaagagggctttgccatctattccgagtactgcaacaaccacccgggcgcctgcctggagctcgccaacctcatgaagcagggcaagtacagacatttctttgaagcctgccgcctgctgcagcagatgattgacatcgccatcgacgggttcctgctcacaccagtgcagaagatctgcaaatacccgctgcagctggccgagctgctcaagtataccacacaggaacacggtgattacagcaacataaaggcagcatatgaggccatgaagaatgtggcctgtctgatcaacgagcgcaagcgcaagctggagagcatcgacaagatagctcgctggcaggtgtctatcgtgggctgggagggactggatatcttagaccgaagctcagaattgattcattctggggagctgaccaaaatcactaagcaaggcaaaagccagcagcggacgttcttcctgtttgaccaccagctggtgtcctgcaagaaggacctgctgcgcagggacatgctgtactacaagggccggctggacatggatgagatggagcttgtggacctgggggatgggcgcgacaaggactgcaacctcagcgtgaaaaatgccttcaagctcgtcagtaggaccacagacgaggtttatttgttttgtgccaaaaaacaagaagacaaggcgaggtggctgcaggcctgtgcagatgaaaggaggcgggtgcaagaggacaaggagatgggaatggaaatttcagaaaaccagaagaaacttgccatgttaaatgctcaaaaggcaggacatggaaagtcaaaaggctacaacaggtgccctgtggccccaccgcaccagggcctgcaccccatccaccagcgccacatcactatgcccacaagcgtcccccagcagcaggtctttggcctggcggaacccaagaggaagtcctcgctcttctggcacaccttcaacaggctcacccccttccggaaatgaaaacaggaggctgtgcttccatggagctgggtgtcaagagaagaactgtctttgtttcttgtgtgcttcaatccagggaaagtttcttggacccagtgataaaaacttccttttagggatcaatgaaggagagaaggtcttggaatcaccttcagtctttggagacccagctgcctttgtggaagggaggagacggtcatgacacaaagctttatcctacacagaaacacccgtgacccactatgagatggcccagatgtgggacccggtaccatgctctaaagcgagtgattaggcagcagctgaagccacccctgctgatgatgagcaagtgcctgctgcaggtccaaacacagcatccagggctttgcagttcctaaggagtgatgaggttagaggatcacttctgcatttgattttcaaggatgccgtcaagacggggttgacacaatgctgcacgtgtctggtcacacttagaaattgagctcttactctcttctgtaatactgggggacctacagctgccgtggggctgaccacggtgttccctggcatcgtctgtgtccacacagatgctaactggtagtgcaaatgtcatcctgcaaggttcctcttcctgcaagcaaagtggagagaaagaagatgcatctgtcaccttcatcagggtcctcagtgcagagcaacttacgcatcctcaagaatccactgcttttcaggcaaggagggagaaatcctgctgcacactggctttgtcccggagtcggattccctcctgcctgcacgccttcagtaactccgagcagaaatcacatcttgcccacatgctgtaacctaagaaactgctatgcaaggctgggtgctgtggctcatgcctgtaatcccagcactttgggaggccaaggcaggtggatcacctgaggtcaggagttcgagacaagcgtggccaatatggcaaagcccagtctctactaataatacaaaaattagctgggcatggtggcgcatgcctgtaatcccagctactgggaaggctgaggtaggagaatcttttgaatctgggaagcggaggttgcagtgagctgagatcgcaccactgcactccagcctgggagatacagcgagactgtctcc

SEQ ID NO: 20221 - DNA, 2111 bp, Homo sapiens
  ENST00000409126
acaacgtcaaagcagtgaataagcgatttctgcagttcccgtagctgccagcctgtgcagtcctctgtgatgcttggggaccggctcctcggtcacaccccagtcctgctctgaaggttgccgttttccaaacagaaggatggtagctagaggggagatagcaagattctggagtctggaaagccttcacttggtttcttcagatggaggtactgagccctctgccttagtggatgacaacggtagtgaggaggacttcagctatgaagacctctgccaggccagccctcggtacctgcagcccggcggggagcagctggccatcaatgagctgatcagtgatggcaacgtggtctgcgcagaagccctgtgggaccatgtgaccatggatgaccaggaactgggcttcaaagccggggatgtcatccaggttctggaagcctccaacaaggactggtggtggggccgcagtgaagataaggaagcctggttccccgcgagcttcgtcagaggctatatccgacagtgccgcaagcacacaggaatgttcaccgttgcgcagctagccactatttttggaaacattgaagatatttacaaattccaaagaaagtttctgaaagaccttgagaaacagtacaacaaagaggaacctcacttaagtgaaataggatcttgctttcttcaaaatcaagagggctttgccatctattccgagtactgcaacaaccacccgggcgcctgcctggagctcgccaacctcatgaagcagggcaagtacagacatttctttgaagcctgccgcctgctgcagcagatgattgacatcgccatcgacgggttcctgctcacaccagtgcagaagatctgcaaatacccgctgcagctggccgagctgctcaagtataccacacaggaacacggtgattacagcaacataaaggcagcatatgaggccatgaagaatgtggcctgtctgatcaacgagcgcaagcgcaagctggagagcatcgacaagatagctcgctggcaggtgtctatcgtgggctgggagggactggatatcttagaccgaagctcagaattgattcattctggggagctgaccaaaatcactaagcaaggcaaaagccagcagcggacgttcttcctgtttgaccaccagctggtgtcctgcaagaaggacctgctgcgcagggacatgctgtactacaagggccggctggacatggatgagatggagcttgtggacctgggggatgggcgcgacaaggactgcaacctcagcgtgaaaaatgccttcaagctcgtcagtaggaccacagacgaggtttatttgttttgtgccaaaaaacaagaagacaaggcgaggtggctgcaggcctgtgcagatgaaaggaggcgggtgcaagaggacaaggagatgggaatggaaatttcagaaaaccagaagaaacttgccatgttaaatgctcaaaaggcaggacatggaaagtcaaaaggctacaacaggtgccctgtggccccaccgcaccagggcctgcaccccatccaccagcgccacatcactatgcccacaagcgtcccccagcagcaggtctttggcctggcggaacccaagaggaagtcctcgctcttctggcacaccttcaacaggctcacccccttccggaaatgaaaacaggaggctgtgcttccatggagctgggtgtcaagagaagaactgtctttgtttcttgtgtgcttcaatccagggaaagtttcttggacccagtgataaaaacttccttttagggatcaatgaaggagagaaggtcttggaatcaccttcagtctttggagacccagctgcctttgtggaagggaggagacggtcatgacacaaagctttatcctacacagaaacacccgtgacccactatgagatggcccagatgtgggacccggtaccatgctctaaagcgagtgattaggcagcagctgaagccacccctgctgatgatgagcaagtgcctgctgcaggtccaaacacagcatccagggctttgcagttcctaaggagtgatgaggttagaggatcacttctgcatttgattttcaaggatgccgtc

SEQ ID NO: 20222 - DNA, 597 bp, Homo sapiens
  ENST00000454083
gttttccaaacagaaggatggtagctagaggggagatagcaagattctggagtctggaaagccttcacttggggtgctttcatgtatcatcattccacttgaggctcaaagcacaccaataacaagtacttgttcagaatgtataaacaaccctgagagatgggttttatcatccacattcaacaggtgaaaaaacaaagaaagaaacttgaccaaggactcatactcaaaaaagaaaaatatagaaaagaaaaaaaatgtgcatcgctatcatttgaagtttcttcagatggaggtactgagccctctgccttagtggatgacaacggtagtgaggaggacttcagctatgaagacctctgccaggccagccctcggtacctgcagcccggcggggagcagctggccatcaatgagctgatcagtgatggcaacgtggtctgcgcagaagccctgtgggaccatgtgaccatggatgaccaggaactgggcttcaaagccggggatgtcatccaggttctggaagcctccaacaaggactggtggtggggccgcagtgaagataaggaagcctggttccccgcgagcttcgtcaga

SEQ ID NO: 20223 - DNA, 605 bp, Homo sapiens
  ENST00000488060
gagacaggctcatagcaggatcgctttgctggcagacacacctggctttgaatccagccccgcaacttggggaaagttacttaacatctttgagccacggtttcctccttcataaccagacagcaacactccaagatgcttgtgaggctctcaagaggatttattccagcgctgagcgcagtgcctggcgcacattaagatgccaggaagccggatgggtgattgctcaggtctgtccagccagttgggcagccgtcagaaactgggagggctgacgagacaccagcccagagagctgtcagggagcggcagagcagaggagagggcccaggatggatcggcaggtgtcagccaggatggacgggaggagccgtgctcagagccagcagccccaggacgagcagctcctggctaggaacagaagacaggcactgtgggacaagtcaaagggtgctttcatgtatcatcattccacttgaggctcaaagcacaccaataacaagtacttgttcagaatgtataaacaaccctgagagatgggttttatcatccacattcaacaggtgaaaaaacaaagaaagaaacttgaccaaggactcatactc

SEQ ID NO: 20224 - DNA, 6405 bp, Homo sapiens
  ENST00000343003
agtttctgggcaggctctggccgggaacgcatacaacgtcaaagcagtgaataagcgatttctgcagttcccgtagctgccagcctgtgcagtcctctgtgatgcttggggaccggctcctcggtcacaccccagtcctgctctgaaggttgccgttttccaaacagaaggatggtagctagaggggagatagcaagattctggagtctggaaagccttcacttggggtgctttcatgtatcatcattccacttgaggctcaaagcacaccaataacaagtacttgttcagaatgtataaacaaccctgagagatgggttttatcatccacattcaacaggtgaaaaaacaaagaaagaaacttgaccaaggactcatactcaaaaaagaaaaatatagaaaagaaaaaaaatgtgcatcgctatcatttgaagtttcttcagatggaggtactgagccctctgccttagtggatgacaacggtagtgaggaggacttcagctatgaagacctctgccaggccagccctcggtacctgcagcccggcggggagcagctggccatcaatgagctgatcagtgatggcaacgtggtctgcgcagaagccctgtgggaccatgtgaccatggatgaccaggaactgggcttcaaagccggggatgtcatccaggttctggaagcctccaacaaggactggtggtggggccgcagtgaagataaggaagcctggttccccgcgagcttcgtcagattgcgagtgaatcaggaagagctgtcggaaaactccagcagcacccccagtgaggagcaggacgaggaggccagccagagccgccacagacactgtgagaacaagcagcagatgcggaccaacgtcatccgggagatcatggacaccgagcgggtgtacatcaaacacctcagggacatctgtgagggctatatccgacagtgccgcaagcacacaggaatgttcaccgttgcgcagctagccactatttttggaaacattgaagatatttacaaattccaaagaaagtttctgaaagaccttgagaaacagtacaacaaagaggaacctcacttaagtgaaataggatcttgctttcttcaaaatcaagagggctttgccatctattccgagtactgcaacaaccacccgggcgcctgcctggagctcgccaacctcatgaagcagggcaagtacagacatttctttgaagcctgccgcctgctgcagcagatgattgacatcgccatcgacgggttcctgctcacaccagtgcagaagatctgcaaatacccgctgcagctggccgagctgctcaagtataccacacaggaacacggtgattacagcaacataaaggcagcatatgaggccatgaagaatgtggcctgtctgatcaacgagcgcaagcgcaagctggagagcatcgacaagatagctcgctggcaggtgtctatcgtgggctgggagggactggatatcttagaccgaagctcagaattgattcattctggggagctgaccaaaatcactaagcaaggcaaaagccagcagcggacgttcttcctgtttgaccaccagctggtgtcctgcaagaaggacctgctgcgcagggacatgctgtactacaagggccggctggacatggatgagatggagcttgtggacctgggggatgggcgcgacaaggactgcaacctcagcgtgaaaaatgccttcaagctcgtcagtaggaccacagacgaggtttatttgttttgtgccaaaaaacaagaagacaaggcgaggtggctgcaggcctgtgcagatgaaaggaggcgggtgcaagaggacaaggagatgggaatggaaatttcagaaaaccagaagaaacttgccatgttaaatgctcaaaaggcaggacatggaaagtcaaaaggctacaacaggtgccctgtggccccaccgcaccagggcctgcaccccatccaccagcgccacatcactatgcccacaagcgtcccccagcagcaggtctttggcctggcggaacccaagaggaagtcctcgctcttctggcacaccttcaacaggctcacccccttccggaaatgaaaacaggaggctgtgcttccatggagctgggtgtcaagagaagaactgtctttgtttcttgtgtgcttcaatccagggaaagtttcttggacccagtgataaaaacttccttttagggatcaatgaaggagagaaggtcttggaatcaccttcagtctttggagacccagctgcctttgtggaagggaggagacggtcatgacacaaagctttatcctacacagaaacacccgtgacccactatgagatggcccagatgtgggacccggtaccatgctctaaagcgagtgattaggcagcagctgaagccacccctgctgatgatgagcaagtgcctgctgcaggtccaaacacagcatccagggctttgcagttcctaaggagtgatgaggttagaggatcacttctgcatttgattttcaaggatgccgtcaagacggggttgacacaatgctgcacgtgtctggtcacacttagaaattgagctcttactctcttctgtaatactgggggacctacagctgccgtggggctgaccacggtgttccctggcatcgtctgtgtccacacagatgctaactggtagtgcaaatgtcatcctgcaaggttcctcttcctgcaagcaaagtggagagaaagaagatgcatctgtcaccttcatcagggtcctcagtgcagagcaacttacgcatcctcaagaatccactgcttttcaggcaaggagggagaaatcctgctgcacactggctttgtcccggagtcggattccctcctgcctgcacgccttcagtaactccgagcagaaatcacatcttgcccacatgctgtaacctaagaaactgctatgcaaggctgggtgctgtggctcatgcctgtaatcccagcactttgggaggccaaggcaggtggatcacctgaggtcaggagttcgagacaagcgtggccaatatggcaaagcccagtctctactaataatacaaaaattagctgggcatggtggcgcatgcctgtaatcccagctactgggaaggctgaggtaggagaatcttttgaatctgggaagcggaggttgcagtgagctgagatcgcaccactgcactccagcctgggagatacagcgagactgtctccaaaaacaaaaacaaaaacaaaaaacattcaaacaactgtttgcaatataaaaagctcatttactgtaatatttatgatacagtgaatatgaaaatgcactggtcagaaggcactctcaaagagccgcactgctcctgacatcgtccttagcaatgaagtcacaaagacagccaaagcagtcctgcttcttggaaatcagaagctgcctttatcacatataaagccaaacagggcataaccatgtcacgtgagcatgtcatcaggcttctgaggacttgttctttataaaaaaagaccttcacaaaatatcttggcttagagatagcagtctttattaacaaaggccacctaggctgacacctgcagataatcatctccttttctttgtctatgttgtacattttcatgatataacttttaactatgtctagagaaggcaggctctgcaagagaggtgccctttcaacccgctcagtgccctggacaggagatgctgtgttaaactgttaatggatatctatatgagaagctcatttttgtatgctatccctgcagtttttttttttctaacaggcccatgtttgagaataaacaagtctgtgatgtcagagacaaaggtgtattcttcagtctgcaggtgtgtggcacctcccttctcccctgcagccccccacatccagagccgttcctgagagtgacatcatgcatcaagaaaacataaccttggtcctcaggtgaacccttggaacattctgtgaccgcctgatgtccattctgagccaccttggcacacatgcttacaggcagcactgctaagggttcaggtgccccatggctgacagcccgagttgcttctgtggaccatcatgccgctcggcacgtcctgagacagaagttgctgcaggaaggagcttctggagaggtcctgtggcatgtgtgggggtgtgtgtgtgtatgtttccttcttgaacagacattccaactttagatgtgtttatagaactgacctttttactaacaaaatacaatgatatatgttggaaactacttaatatgcttttcctgcacaccttagcaataactgtaggggtctctgctagagttgtttgtatgtacagcaattttgaacaaattgttttaaatgtaatataagagaattagtttaaggaagtaaagagaatcatttgcttgtgttacattttcagtgaggattcagtttaagagtcattcttaggacttccatttcctaatatttattcatgggtaatgaagaaatggtttgcattttgtggccagtcctaatttattttccagctgagccctaacttccggctcccacctacctccacggacttcctaacagagacttatgaataccaggatgtgtttttgttaagtcaggttcaattcgttgcccctgtcagttttatagagtgtgagggtcactccattaaagatctctcctgggtggatcctacttggatgttcaggtgattttgaaaactgctaacatttttaaaaggctagaacatcctttgacttcttgaaaatctgcatgtctggcttgggttttattaccacatgcctgagttcttcaagaatggaaggctcaagtattctcatcttccatttgccaaacttccttcctgatttgagtcacgtgttccacttggaaagaaagggaacagagagcctcctccatggacagtgtatgaatttcattgggaatcttgctctctcccgcctctatgcctttctctctttttaaccttactttacataatattatagatgggccaagaaaagaaaagatgacataacattttgatgaatttcacctattccattcttcacgtttcagaattggtcgactttgttagaagataattgaagtagccttgggtcaaaagcaaccttttcaattgtgatcatacctaaaacatataaaaaccctgccgtagattaaaagcaattataaaatcataaaattgaatgtttgcagaatcctggagcagtagatttctttgtctttggcctgcggactagaaagagggcagcagtagtatgctggagcttccctgggataccagccacatggtttcttttcattagatctgatttttgtttcccactgtagatctgattttgtagttgaaaacatttcaccaccatcaaacactatttctgaatattgtgcctttttatacctagcctagatgaaaaccgatgccattcttattcagaaaatccccccatcctacatgactgttatctagacataaagcaaagtgcatttaattcaaaatttggttcacaatataagtattttgtaaaagccagctgaaccagcattttatcaggtggaaatctctgcaagccaaattgctgatactccttcatgcagatcaacttggtgtcccagtcagaatagaacagcataattacctggagttagggggagtatttctgcactattacttgtcagggagagaagaaacttagaattgtccctcaaaggagtgtcaagaagtatgaataaatgtcctttcaccagctcacaggccagaaatggaggacccaagtcaactaggtgaaactactagcagacccagctttcccataataacctaatctgcaaattgttctattaaagtctcattgttttcaggatgcaatgaaagtggatttcaaaaggctttggaaaaataagtggaacatgactgatcttgaaaaaaaaagcaaaagcttaaatatttgatacaagtttacttagctacaacatactttacattgttgcctttagttatctcacaggcactgacattttatatttagaaaatacttttaatctttctaatctttttttgtaaatattagtgtccattctgtatgactcgctaacctactttgcaaggctttgggcaacattttagctcattaacttcaagatgatgtgtcatctgtataggtcaaagaatgggacttctgaactgaggaatttgctgttgacagccaaagtatagtgtacaagattgatgtaacttgatatgtatttttgttgaagttttttgtaaaaaaaaattatttacaatgttatttgaatgatttttttaaatgctgtgaatctatatttgttgttttgtatattaaaattcatttgccaaactcgt

SEQ ID NO: 20225 - DNA, 8463 bp, Homo sapiens
  ENST00000382108
ggctgagtgtgctgccgcggcgcgggaggagagtgtgcgttgcgctttctcccgcgatcgccctgccggtcgctagctccgagggcgcgcactggatcccaggctcctccgagagtgcggcgacctcggggctccgccggcaccggaggtggctctgagggcagggacgtgttggacacgctgactttgtaggctccgccaagaggcgccgcaggagcccgtggccacccaggagcccgatgtgcaaggcaggtgtgagtgccaggacggcattcctggagatgaaggcctggagctgcggtctgcggactcggcagtgcccgtggccatgacccaggctgccgtgcggccctgggcaccctgcctggagaacatgaccactgccccaaacggcctcgggccaggccccgcagccccctgtgcaggctcggacctgaaagacgccaagatggtgacctcccttgcgtgtggaaatggagtctgtggctgcagccctggtggcgacacggacacccaggaagccaaactcagcccagccaagcttgtgcgcctcttttccaccagtcggaagaggacgggtgcccaccccgagcggccccactccatggtcctggtggggaactcctccacatggaacaccctcgcctccttccggaaaatgggatcctttaagaaactgaagtcctcagtcctgaaaggaattcagagccgagaggggtcaaatgcctgttcaaagggagaggcttcggagcatggcctgggaaagtccatcccaaatggcgctgtcccaggagcccaggcaagcaggggctcccccttagcaccgggaccagcatgtggtgccctcaggccagcagagtggggcacattggatggctccgacctcgaggacacggacgatgccttccagcggagcacacaccgctcccgcagcctccgcagagcctacggcctgggccgcatctgcctgctggatgcgccccagaaccatgcgacacccacgatagccactggccaggtgcccgccgtgtgtgagattctcgtgagggaccctgaaaacaacagcatgggctacaggaggagcaagagcacggacaatcttgcctttctgaagaagagctcctttaagcggaagtccacctccaatcttgcagacctcaggacggcccatgacgcacgggtaccacagaggaccctgagcagttcctccactgactcccaaaagcttgggtcaggaaggaccaaacgctggaggagcccgataagggccaaggactttgacagagtcttcaaacttgtgagcaatgtgactgaggctgcctggaggagggagagtcctaggagtggggccccatcccctggagaggccagcctgagacttcaggcacacagccggctgcatgacgactactcccgccgcgtctccaggagcactgagcaggacagcaggcggggcggggcggtcatgcatgggaccactgcaacctgcaccgtggcccccggtttcggctcagccacctctaaggggccccacctagacgctgacactgccgtatttcctcttgaaaccaaaagttcctgggcggtggaaagcgacagttcctgcacttgcagctctttgccaagcccgattgtccaggatgtgttgagcaaagactcctgtgacccaaacgctggcagccagttgacatttgaccctgagcagcctcccacccctctaaggcccaccacacccaagccccagagccctcagagcccccagagccccggggcaggaagtgccagctgtcacagcaatcacagtgccctgtccgcgaattcagaggaaagtgaaggaagggcagaagagcctgctcagagagagccagggcctgtgtccttgcaggatcccctggaagccacacatggtgatgagggcagcaaggaccttctggtgaacattggtgtggcagccggcccagaagaaaaggagaaggaggaggtcgtccctgatggcccctggaggcgaagctcatcacaggatgaggaaaggacagaggcacagagaacccccaagaggagatggggctctgggagacggccaaggcctcggccattctctgactacggccagctggccagccgcagtttgtctattcctgaagactcggttgctgcagacccccagaaggaagaccgtgtggacgaggacccccaggcaagcatgacttctgccagccctgaagaccagaatgctccagtgggctgccccaaaggagcccggagaaggcgccccatttccgtgataggtggggtcagcttgtatgggaccaaccagacggaggaactggacaatcttctgacccaaccggcttccaggccgcccatgcctgctcaccaggtgccaccctacaaggctgtgtcggcccggttccggcccttcacattctcccagagcacccccattgggttggaccgtgtgggacgccggcggcagatgagagcatccaacgtttcttcagatggaggtactgagccctctgccttagtggatgacaacggtagtgaggaggacttcagctatgaagacctctgccaggccagccctcggtacctgcagcccggcggggagcagctggccatcaatgagctgatcagtgatggcaacgtggtctgcgcagaagccctgtgggaccatgtgaccatggatgaccaggaactgggcttcaaagccggggatgtcatccaggttctggaagcctccaacaaggactggtggtggggccgcagtgaagataaggaagcctggttccccgcgagcttcgtcagattgcgagtgaatcaggaagagctgtcggaaaactccagcagcacccccagtgaggagcaggacgaggaggccagccagagccgccacagacactgtgagaacaagcagcagatgcggaccaacgtcatccgggagatcatggacaccgagcgggtgtacatcaaacacctcagggacatctgtgagggctatatccgacagtgccgcaagcacacaggaatgttcaccgttgcgcagctagccactatttttggaaacattgaagatatttacaaattccaaagaaagtttctgaaagaccttgagaaacagtacaacaaagaggaacctcacttaagtgaaataggatcttgctttcttcaaaatcaagagggctttgccatctattccgagtactgcaacaaccacccgggcgcctgcctggagctcgccaacctcatgaagcagggcaagtacagacatttctttgaagcctgccgcctgctgcagcagatgattgacatcgccatcgacgggttcctgctcacaccagtgcagaagatctgcaaatacccgctgcagctggccgagctgctcaagtataccacacaggaacacggtgattacagcaacataaaggcagcatatgaggccatgaagaatgtggcctgtctgatcaacgagcgcaagcgcaagctggagagcatcgacaagatagctcgctggcaggtgtctatcgtgggctgggagggactggatatcttagaccgaagctcagaattgattcattctggggagctgaccaaaatcactaagcaaggcaaaagccagcagcggacgttcttcctgtttgaccaccagctggtgtcctgcaagaaggacctgctgcgcagggacatgctgtactacaagggccggctggacatggatgagatggagcttgtggacctgggggatgggcgcgacaaggactgcaacctcagcgtgaaaaatgccttcaagctcgtcagtaggaccacagacgaggtttatttgttttgtgccaaaaaacaagaagacaaggcgaggtggctgcaggcctgtgcagatgaaaggaggcgggtgcaagaggacaaggagatgggaatggaaatttcagaaaaccagaagaaacttgccatgttaaatgctcaaaaggcaggacatggaaagtcaaaaggctacaacaggtgccctgtggccccaccgcaccagggcctgcaccccatccaccagcgccacatcactatgcccacaagcgtcccccagcagcaggtctttggcctggcggaacccaagaggaagtcctcgctcttctggcacaccttcaacaggctcacccccttccggaaatgaaaacaggaggctgtgcttccatggagctgggtgtcaagagaagaactgtctttgtttcttgtgtgcttcaatccagggaaagtttcttggacccagtgataaaaacttccttttagggatcaatgaaggagagaaggtcttggaatcaccttcagtctttggagacccagctgcctttgtggaagggaggagacggtcatgacacaaagctttatcctacacagaaacacccgtgacccactatgagatggcccagatgtgggacccggtaccatgctctaaagcgagtgattaggcagcagctgaagccacccctgctgatgatgagcaagtgcctgctgcaggtccaaacacagcatccagggctttgcagttcctaaggagtgatgaggttagaggatcacttctgcatttgattttcaaggatgccgtcaagacggggttgacacaatgctgcacgtgtctggtcacacttagaaattgagctcttactctcttctgtaatactgggggacctacagctgccgtggggctgaccacggtgttccctggcatcgtctgtgtccacacagatgctaactggtagtgcaaatgtcatcctgcaaggttcctcttcctgcaagcaaagtggagagaaagaagatgcatctgtcaccttcatcagggtcctcagtgcagagcaacttacgcatcctcaagaatccactgcttttcaggcaaggagggagaaatcctgctgcacactggctttgtcccggagtcggattccctcctgcctgcacgccttcagtaactccgagcagaaatcacatcttgcccacatgctgtaacctaagaaactgctatgcaaggctgggtgctgtggctcatgcctgtaatcccagcactttgggaggccaaggcaggtggatcacctgaggtcaggagttcgagacaagcgtggccaatatggcaaagcccagtctctactaataatacaaaaattagctgggcatggtggcgcatgcctgtaatcccagctactgggaaggctgaggtaggagaatcttttgaatctgggaagcggaggttgcagtgagctgagatcgcaccactgcactccagcctgggagatacagcgagactgtctccaaaaacaaaaacaaaaacaaaaaacattcaaacaactgtttgcaatataaaaagctcatttactgtaatatttatgatacagtgaatatgaaaatgcactggtcagaaggcactctcaaagagccgcactgctcctgacatcgtccttagcaatgaagtcacaaagacagccaaagcagtcctgcttcttggaaatcagaagctgcctttatcacatataaagccaaacagggcataaccatgtcacgtgagcatgtcatcaggcttctgaggacttgttctttataaaaaaagaccttcacaaaatatcttggcttagagatagcagtctttattaacaaaggccacctaggctgacacctgcagataatcatctccttttctttgtctatgttgtacattttcatgatataacttttaactatgtctagagaaggcaggctctgcaagagaggtgccctttcaacccgctcagtgccctggacaggagatgctgtgttaaactgttaatggatatctatatgagaagctcatttttgtatgctatccctgcagtttttttttttctaacaggcccatgtttgagaataaacaagtctgtgatgtcagagacaaaggtgtattcttcagtctgcaggtgtgtggcacctcccttctcccctgcagccccccacatccagagccgttcctgagagtgacatcatgcatcaagaaaacataaccttggtcctcaggtgaacccttggaacattctgtgaccgcctgatgtccattctgagccaccttggcacacatgcttacaggcagcactgctaagggttcaggtgccccatggctgacagcccgagttgcttctgtggaccatcatgccgctcggcacgtcctgagacagaagttgctgcaggaaggagcttctggagaggtcctgtggcatgtgtgggggtgtgtgtgtgtatgtttccttcttgaacagacattccaactttagatgtgtttatagaactgacctttttactaacaaaatacaatgatatatgttggaaactacttaatatgcttttcctgcacaccttagcaataactgtaggggtctctgctagagttgtttgtatgtacagcaattttgaacaaattgttttaaatgtaatataagagaattagtttaaggaagtaaagagaatcatttgcttgtgttacattttcagtgaggattcagtttaagagtcattcttaggacttccatttcctaatatttattcatgggtaatgaagaaatggtttgcattttgtggccagtcctaatttattttccagctgagccctaacttccggctcccacctacctccacggacttcctaacagagacttatgaataccaggatgtgtttttgttaagtcaggttcaattcgttgcccctgtcagttttatagagtgtgagggtcactccattaaagatctctcctgggtggatcctacttggatgttcaggtgattttgaaaactgctaacatttttaaaaggctagaacatcctttgacttcttgaaaatctgcatgtctggcttgggttttattaccacatgcctgagttcttcaagaatggaaggctcaagtattctcatcttccatttgccaaacttccttcctgatttgagtcacgtgttccacttggaaagaaagggaacagagagcctcctccatggacagtgtatgaatttcattgggaatcttgctctctcccgcctctatgcctttctctctttttaaccttactttacataatattatagatgggccaagaaaagaaaagatgacataacattttgatgaatttcacctattccattcttcacgtttcagaattggtcgactttgttagaagataattgaagtagccttgggtcaaaagcaaccttttcaattgtgatcatacctaaaacatataaaaaccctgccgtagattaaaagcaattataaaatcataaaattgaatgtttgcagaatcctggagcagtagatttctttgtctttggcctgcggactagaaagagggcagcagtagtatgctggagcttccctgggataccagccacatggtttcttttcattagatctgatttttgtttcccactgtagatctgattttgtagttgaaaacatttcaccaccatcaaacactatttctgaatattgtgcctttttatacctagcctagatgaaaaccgatgccattcttattcagaaaatccccccatcctacatgactgttatctagacataaagcaaagtgcatttaattcaaaatttggttcacaatataagtattttgtaaaagccagctgaaccagcattttatcaggtggaaatctctgcaagccaaattgctgatactccttcatgcagatcaacttggtgtcccagtcagaatagaacagcataattacctggagttagggggagtatttctgcactattacttgtcagggagagaagaaacttagaattgtccctcaaaggagtgtcaagaagtatgaataaatgtcctttcaccagctcacaggccagaaatggaggacccaagtcaactaggtgaaactactagcagacccagctttcccataataacctaatctgcaaattgttctattaaagtctcattgttttcaggatgcaatgaaagtggatttcaaaaggctttggaaaaataagtggaacatgactgatcttgaaaaaaaaagcaaaagcttaaatatttgatacaagtttacttagctacaacatactttacattgttgcctttagttatctcacaggcactgacattttatatttagaaaatacttttaatctttctaatctttttttgtaaatattagtgtccattctgtatgactcgctaacctactttgcaaggctttgggcaacattttagctcattaacttcaagatgatgtgtcatctgtataggtcaaagaatgggacttctgaactgaggaatttgctgttgacagccaaagtatagtgtacaagattgatgtaacttgatatgtatttttgttgaagttttttgtaaaaaaaaattatttacaatgttatttgaatgatttttttaaatgctgtgaatctatatttgttgttttgtatattaaaattcatttgccaaactcgt

SEQ ID NO: 20226 - DNA, 2169 bp, Homo sapiens
  ENST00000477715
agtaacaaagaattccagcagtgagctgtgagttctgtccttgctggctttcccaagtggaaggctaccctcatctttcactaatggcagactaggacaagcattacccaggcctgcaagcttgttaaggactaggaacccaagcaagaactcaccatgccaatcaaacctgttgggtggatatgtgggcaggtgttgaagaacttttctggaagaatcgaggggatccagaaagcaatcatggaccttgtagatgagtttaaagatgaatttcccaccatcctaagattatcacagtctaatcaggtcagaaagggttctttgtttgaaatcatctcctttccagcaaagactgctttaactagcataatatatgcttcatatgcagcactaatttatttggcagtctgtgttaatgctgtgctgaagaaggtaaagaacatcttccaggaagaagaatccataaggcaaaacagagaggagagtgaaaattgtagaaaagccttttctgagcctgtgctttcggagcctatgtttgctgaaggtgaaatcaaagcaaaaccttataggtcattgccggagaagccagacatttcagattaccccaagcttcttgctaataagcagagtaataacatccaagttttacattctgtgtttgaccaatcagctgaaatgaatgagcaaatctgaatacaggcattcaaagaacattggctcactgaataggagactttacatctctcatggctgggcagcagctgtgtctggcttccttacttcaagatctgccttgatcacagatcacttaacagtggttaagtttcttattttcaagttcagcaggggcaaactatacacggtcgtccatcaaaatcctggggaagagaataactcatttaatattctgacatgtcaaatgttcttgatagactctgaagagtctgctgcagaagaaccaggttaaaaaaacagtaggtctaaggggttggggtgacaagattctgcatgtctaagaagctcccatgtgacaccaaagttgctggtctatggacaacagtttgaggagcaaggtcttcaagctctcattatggactgaaactggagaaaattctatggaactattatcagctcacacatataaaaactggtcactgagatgacagctgagctgaaatgcccaaaatgcaaatgaactagacatgccaacagcttggggaagagaattccatactgaaagaagagcaaatacaaaagcctgaaggaaagaaaagtcttggtgaatgtgttccagaagactggaacataatatgcaagattggtaaacaggcaggagccaggttgtgcagtgctgtgtatggattttactctaagagcaaaggaaagccactgaagagtataaagcaggaaagtgtgaattgatttctttttgaaagaatgctcccggctctgtggagaatggattatagcaaaacaacaatggatgcccagaaatcagaaagctaggggtccatgaaaaaggtggtggcttgccgcagggggttgatgctgtaggggataaaaagtaataacaacagtagcagtagtagctacaattatattgtgttaactatgtgccaggcactattcaaaggctacatttatttattaactcctttaatcctccatgttactaaaaaggtattattttaattttatagtacagagaagttgggttgatgaacttgaatgaagatgctacagaaaaataaataaagatgactcccaagttttaggtttgtgcagctaggtgaactgtagtgccaaagactgtgaggagaaaggccaagaaatgaatggtatttttgcagaatggaaaatcaagagctatatatattttacacatattgagtttaaggtatctcagagacatccaagtagagatgtcaagtcaacaaccagatatatgagactaaagtcgagaatttctagagagaaaaactggggagtttccaggtcatagaattctatggactcacttggagaggaagtgtagataaggaagaaggtctaagacaattcctgaaacacttcaacatttagaggtcaggtggaagagaggttgtagagaggcaagatcagtagagtgtccaatctattgctaatcaaatgaaattcattcacagcttt

SEQ ID NO: 20227 - DNA, 1592 bp, Homo sapiens
  ENST00000477047
agtgagctgtgagttctgtccttgctggctttcccaagtggaaggctaccctcatctttcactaatggcagactaggacaagcattacccaggcctgcaagcttgttaaggactaggaacccaagcaagaactcaccatgccaatcaaacctgttgggtggatatgtgggcagtcgaggggatccagaaagcaatcatggaccttgtagatgagtttaaagatgaatttcccaccatcctaagattatcacagtctaatcagaaaagagaacctgcgcagaaaacatccaaaatcaggatggctattgctttagctaagattaatcgagcaacattaattcgtggattaaacagcatatccagatcctccaaatcagtggccaaacttctgcatcctcagcttgcatgcagacttttagagctaagggacatatctggtcgtctgctgagggaagttaatgcgccgaggcaacccctatataacattcaggtcagaaagggttctttgtttgaaatcatctcctttccagcaaagactgctttaactagcataatatatgcttcatatgcagcactaatttatttggcagtctgtgttaatgctgtgctgaagaaggtaaagaacatcttccaggaagaagaatccataaggcaaaacagagaggagagtgaaaattgtagaaaagccttttctgagcctgtgctttcggagcctatgtttgctgaaggggcaaactatacacggtcgtccatcaaaatcctggggaagagaataactcatttaatattctgacatgtcaaatgttcttgatagactctgaagagtctgctgcagaagaaccaggttaaaaaaacagtaggtctaaggggttggggtgacaagattctgcatgtctaagaagctcccatgtgacaccaaagttgctggtctatggacaacagtttgaggagcaaggtcttcaagctctcattatggactgaaactggagaaaattctatggaactattatcagctcacacatataaaaactggtcactgagatgacagctgagctgaaatgcccaaaatgcaaatgaactagacatgccaacagcttggggaagagaattccatactgaaagaagagcaaatacaaaagcctgaaggaaagaaaagtcttggtgaatgtgttccagaagactggaacataatatgcaagattggtaaacaggcaggagccaggttgtgcagtgctgtgtatggattttactctaagagcaaaggaaagccactgaagagtataaagcaggaaagtgtgaattgatttctttttgaaagaatgctcccggctctgtggagaatggattatagcaaaacaacaatggatgcccagaaatcagaaagctaggggtccatgaaaaaggtggtggcttgccgcagggggttgatgctgtaggggataaaaagtaataacaacagtagcagtagtagctacaattatattgtgttaactatgtgccaggcactattcaaaggctacatttatttattaactcctttaatcctccatgttactaaaaaggtattattttaattttatagtacagagaag

SEQ ID NO: 20228 - DNA, 1583 bp, Homo sapiens
  ENST00000316087
ccagcagtgagctgtgagttctgtccttgctggctttcccaagtggaaggctaccctcatctttcactaatggcagactaggacaagcattacccaggcctgcaagcttgttaaggactaggaacccaagcaagaactcaccatgccaatcaaacctgttgggtggatatgtgggcaggtgttgaagaacttttctggaagaatcgaggggatccagaaagcaatcatggaccttgtagatgagtttaaagatgaatttcccaccatcctaagattatcacagtctaatcagaaaagagaacctgcgcagaaaacatccaaaatcaggatggctattgctttagctaagattaatcgagcaacattaattcgtggattaaacagcatatccagatcctccaaatcagtggccaaacttctgcatcctcagcttgcatgcagacttttagagctaagggacatatctggtcgtctgctgagggaagttaatgcgccgaggcaacccctatataacattcaggtcagaaagggttctttgtttgaaatcatctcctttccagcaaagactgctttaactagcataatatatgcttcatatgcagcactaatttatttggcagtctgtgttaatgctgtgctgaagaaggtaaagaacatcttccaggaagaagaatccataaggcaaaacagagaggagagtgaaaattgtagaaaagccttttctgagcctgtgctttcggagcctatgtttgctgaaggtgaaatcaaagcaaaaccttataggtcattgccggagaagccagacatttcagattaccccaagcttcttgctaataagcagagtaataacatccaagttttacattctgtgtttgaccaatcagctgaaatgaatgagcaaatctgaatacaggcattcaaagaacattggctcactgaataggagactttacatctctcatggctgggcagcagctgtgtctggcttccttacttcaagatctgccttgatcacagatcacttaacagtggttaagtttcttattttcaagttcagcaggggcaaactatacacggtcgtccatcaaaatcctggggaagagaataactcatttaatattctgacatgtcaaatgttcttgatagactctgaagagtctgctgcagaagaaccaggttaaaaaaacagtaggtctaaggggttggggtgacaagattctgcatgtctaagaagctcccatgtgacaccaaagttgctggtctatggacaacagtttgaggagcaaggtcttcaagctctcattatggactgaaactggagaaaattctatggaactattatcagctcacacatataaaaactggtcactgagatgacagctgagctgaaatgcccaaaatgcaaatgaactagacatgccaacagcttggggaagagaattccatactgaaagaagagcaaatacaaaagcctgaaggaaagaaaagtcttggtgaatgtgttccagaagactggaacataatatgcaagattggtaaacaggcaggagccaggttgtgcagtgctgtgtatggattttact

SEQ ID NO: 20229 - DNA, 1100 bp, Homo sapiens
  ENST00000274432
ccagcagtgagctgtgagttctgtccttgctggctttcccaagtggaaggctaccctcatctttcactaatggcagactaggacaagcattacccaggcctgcaagcttgttaaggactaggaacccaagcaagaactcaccatgccaatcaaacctgttgggtggatatgtgggcaggtgttgaagaacttttctggaagaatcgaggggatccagaaagcaatcatggaccttgtagatgagtttaaagatgaatttcccaccatcctaagattatcacagtctaatcagaaaagagaacctgcgcagaaaacatccaaaatcaggatggctattgctttagctaagattaatcgagcaacattaattcgtggattaaacagcatatccagatcctccaaatcagtggccaaacttctgcatcctcagcttgcatgcagacttttagagctaagggacatatctggtcgtctgctgagggaagttaatgcgccgaggcaacccctatataacattcaggtcagaaagggttctttgtttgaaatcatctcctttccagcaaagactgctttaactagcataatatatgcttcatatgcagcactaatttatttggcagtctgtgttaatgctgtgctgaagaaggtaaagaacatcttccaggaagaagaatccataaggcaaaacagagaggagagtgaaaattgtagaaaagccttttctgagcctgtgctttcggagcctatgtttgctgaaggtgaaatcaaagcaaaaccttataggtcattgccggagaagccagacatttcagattaccccaagcttcttgctaataagcagagtaataacatccaagttttacattctgtgtttgaccaatcagctgaaatgaatgagcaaatctgaatacaggtatcactgaacagaacttaagagttatctatttaatggcacatttcatctgacaaaactcagagtctagtttacatattctgaattgctctgctttcttaaaaaaaagagaagggggctactattaaaatgtcattttctagtatttacatgatagagtaaataaaatgaatattgatgtggaata

SEQ ID NO: 20230 - DNA, 702 bp, Homo sapiens
  ENST00000379990
gcttggaagtctacagtggaagagtgagggaactttggtcagctgcttttcctctcctcagctctcctccctcatcggtttctgcttttggcctcttcaaagctgcaagagggaaggagaaaaggtcagaaagggttctttgtttgaaatcatctcctttccagcaaagactgctttaactagcataatatatgcttcatatgcagcactaatttatttggcagtctgtgttaatgctgtgctgaagaaggtaaagaacatcttccaggaagaagaatccataaggcaaaacagagaggagagtgaaaattgtagaaaagccttttctgagcctgtgctttcggagcctatgtttgctgaaggtgaaatcaaagcaaaaccttataggtcattgccggagaagccagacatttcagattaccccaagcttcttgctaataagcagagtaataacatccaagttttacattctgtgtttgaccaatcagctgaaatgaatgagcaaatctgaatacaggtatcactgaacagaacttaagagttatctatttaatggcacatttcatctgacaaaactcagagtctagtttacatattctgaattgctctgctttcttaaaaaaaagagaagggggctactattaaaatgtcattttctagtatttacatgatagagtaaataaaatgaatattgatgtggaa

SEQ ID NO: 20231 - DNA, 1046 bp, Homo sapiens
  ENST00000489917
agtaacaaagaattccagcagtgagctgtgagttctgtccttgctggctttcccaagtggaaggctaccctcatctttcactaatggcagactaggacaagcattacccaggcctgcaagcttgttaaggactaggaacccaagcaagaactcaccatgccaatcaaacctgttgggtggatatgtgggcaggtgttgaagaacttttctggaagaatcgaggggatccagaaagcaatcatggaccttgtagatgagtttaaagatgaatttcccaccatcctaagattatcacagtctaatcagaaaagagaacctgcgcagaaaacatccaaaatcaggatggctattgctttagctaagattaatcgagcaacattaattcgtggattaaacagcatatccagatcctccaaatcagtggccaaacttctgcatcctcagcttgcatgcagacttttagagctaagggacatatctggtcgtctgctgagggaagttaatgcgccgaggcaacccctatataacattcaggagaagaaaatggggctccaattgagttaaaccaaaaaagaagatgtattagctcccataaacaacccagagctgttgagattcccgacatggctggatacaggtcagaaagggttctttgtttgaaatcatctcctttccagcaaagactgctttaactagcataatatatgcttcatatgcagcactaatttatttggcagtctgtgttaatgctgtgctgaagaaggtaaagaacatcttccaggaagaagaatccataaggcaaaacagagaggagagtgaaaattgtagaaaagccttttctgagcctgtgctttcggagcctatgtttgctgaaggtgaaatcaaagcaaaaccttataggtcattgccggagaagccagacatttcagattaccccaagcttcttgctaataagcagagtaataacatccaagttttacattctgtgtttgaccaatcagctgaaatgaatgagcaaatctgaatacaggtatcactgaacagaa

SEQ ID NO: 20232 - DNA, 2007 bp, Homo sapiens
  ENST00000377470
agactctgcaccctccttcagcccaggcaaggcctggggccctgggcagcctccaggtgcagtgccctcccgtgggccgcacccttgccactgccccagggcatgtctctactcaccaattatgaagggcttcggcatcagatagagaggctggtgcgggaaaatgaggaactgaagaagttggtgcggctcattcgggagaatcacgagctcaagtcagcgatcaagactcaggcaggcgggctcggcatcagcgggttcacgagtgggcttggtgaggcaacagcaggcctttcctcacgccagaacaatggtgtcttcctgcccccgtccccagcagtggcaaacgaacgagtcctcgaagaagtggggatcatggccttggcacccctggccgagatgctaaccagcttgcagcccagcgccacaccgggctcactcatgagccccctgacaggcaccctcagcacgctgctgtctggcccagcacccacgtcacagagcagccccctcaccagcttcctgaccagtcccattgcgggacccctaacaggcacactggccagttccctgggcctgccctccactggcaccctgactcccagcagcctcgtggcaggccctgtggccatgtcccagagcagccccctgatagcccctgtgatgggcacggtggctgtctctctgagcagccccctcctcagctccactgccaccccaccaggggtctctcagaacctgctggccaaccccatgagcaacctggtcctgccagaggccccaaggctgcggctggctgagccactccgcggaggccccactgggccccagtccccagcttgcgtggtacccactgccaccaccaaagtcccactctccactgagcccccccagtcgacccaggacccagagcctctcagcatggcgtttgcaggagcacccctccagacctccacccctatcggagccatgggcacacctgctcccaagacggccttctccttcaacacttcggacacacaggcccagcccagtgccgcccaggaacaagtggtccctgcatctgtccccacctcccccaccacctcccccacggtcaccgtccttgcctctgcccccgcccttgccccccaggttgccaccagctacacaccctcaagcaccacccacatcgcccagggtgccccccatcccccttcccgaatgcataattccccaacccagaacctgcctgtcccccactgtcctccacacaacgcccactccccacctcgtacctcatcctccccggcttcagtcaatgactctcgaggtccacgcaccacagaaccgtcgacgaagagcatgatggaggtggaacggaagctggcccaccgcaagaccagcaagttccccgagaacccccgagagtcgaagcagctggcctgggagaggctggtgggtgagattgccttccagctggaccgcaggatcctgtccagcatcttcccagagcgcgtacggctctacggcttcactgtctccaacatcccagagaagatcatccaggcttccctgaaccccagtgaccacaagctggatgagaagctgtgccagaggctcacacagcgctatgtgagcgtcatgaacaggctgcagagtctgggctacaacgggcgggtgcaccctgcgctgaccgagcagctggtgaacgcttatggcatcctgcgagagcgcccggagctggcggcgtctgagggcggcccctacaccgtggacttcctgcagcgtgtggtggtggagaccgtgcaccccggcatgctcgccgacgcgctgctgctgctctcctgcctcagccagctggcgcacgatgacggcaagcccatgttcatctggtgacgctggagctgggaggtccaggctcgctcagccccacagccctgtgcacggccattaaagcttcccacagacactggtcgctgggcctgtgccagcgctcctgggtggtgctgcctcctctggggtggc

SEQ ID NO: 20233 - DNA, 1795 bp, Homo sapiens
  ENST00000447830
ctccttcagcccaggcaaggcctggggccctgggcagcctccaggtgcagtgccctcccgtgggccgcacccttgccactgccccagggcatgtctctactcaccaattatgaagggcttcggcatcagatagagaggctggtgcgggaaaatgaggaactgaagaagttggtgcggctcattcgggagaatcacgagctcaagtcagcgatcaagactcaggcaggcgggctcggcatcagcgggttcacgagtgggcttggtgaggcaacagcaggcctttcctcacgccagaacaatggtgtcttcctgcccccgtccccagcagtggcaaacgaacgagtcctcgaagaagtggggatcatggccttggcacccctggccgagatgctaaccagcttgcagcccagcgccacaccgggctcactcatgagccccctgacaggcaccctcagcacgctgctgtctggcccagcacccacgtcacagagcagccccctcaccagcttcctgaccagtcccattgcgggacccctaacaggcacactggccagttccctgggcctgccctccactggcaccctgactcccagcagcctcgtggcaggccctgtggccatgtcccagagcagccccctgatagcccctgtgatgggcacggtggctgtctctctgagcagccccctcctcagctccactgccaccccaccaggggtctctcagaacctgctggccaaccccatgagcaacctggtcctgccagaggccccaaggctgcggctggctgagccactccgcggaggccccactgggccccagtccccagcttgcgtggtacccactgccaccaccaaagtcccactctccactgagcccccccagtcgacccaggacccagagcctctcagcatggcgtttgcaggagcacccctccagacctccacccctatcggagccatgggcacacctgctcccaagacggccttctccttcaacacttcggacacacaggcccagcccagtgccgcccaggaacaagtggtccctgcatctgtccccacctcccccaccacctcccccacggtcaccgtccttgcctctgcccccgcccttgccccccaggttgccaccagctacacaccctcaagcaccacccacatcgcccagggtgccccccatcccccttcccgaatgcataattccccaacccagaacctgcctgtcccccactgtcctccacacaacgcccactccccacctcgtacctcatcctccccggcttcagtcaatgactctcgaggtccacgcaccacagaaccgtcgacgaagagcatgatggaggtggaacggaagctggcccaccgcaagaccagcaagttccccgagaacccccgaggcttccctgaaccccagtgaccacaagctggatgagaagctgtgccagaggctcacacagcgctatgtgagcgtcatgaacaggctgcagagtctgggctacaacgggcgggtgcaccctgcgctgaccgagcagctggtgaacgcttatggcatcctgcgagagcgcccggagctggcggcgtctgagggcggcccctacaccgtggacttcctgcagcgtgtggtggtggagaccgtgcaccccggcatgctcgccgacgcgctgctgctgctctcctgcctcagccagctggcgcacgatgacggcaagcccatgttcatctggtgacgctggagctgggaggtccaggctcgctcagccccacagccctgtgcacggccattaaagcttcccaca

SEQ ID NO: 20234 - DNA, 614 bp, Homo sapiens
  ENST00000472876
gcgggtccctctcctgagcatcagtgagcgcccggagccgtggccgctgggggttgcggcggcgctgagccagcggggccggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccctccctgggctctgtcagctagcagagcatttggtggaagaaaga

SEQ ID NO: 20235 - DNA, 3363 bp, Homo sapiens
  ENST00000395527
atcagtgagcgcccggagccgtggccgctgggggttgcggcggcgctgagccagcggggccggacagacccacgaagtcaagcatgcggagtgcagccaagccctggaacccagccatcagagcagggggccacggcccagaccgggtgcggcctctgcctgcagcctcttccggcatgaagagttctaagtcttcaacttccttggcttttgagtcccgactcagcaggctcaagagggccagcagtgaggacacgctcaacaagccaggaagtaccgctgcatcgggggtggttcgcctgaagaagaccgccactgccggagccatctcggagctcacggagagccgcctgaggagcggcacaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagatgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccacctgtggatgaagagccagagtcctctgaggtcgatgctgctggtcggtggcctggtgtctgtgttagcagaacatctccaacacccccagagtcggcaaccaccgttaagtcacttatcaagtcatttgacttgggacgcccaggtggagctggacagaatatttctgtccataagacccccagaagtcccctaagtgggataccagtgaggactgctccagcagctgctgtctctccaatgcagaggcattcgacttacagcagtgtgcggccagccagcagaggggtgactcaacgcttggaccttcctgaccttcccctctcagatattctaaagggaaggactgagaccctgaagccagacccccacctccgcaagagtccctcactagagtcactgagcagacccccgtctctgggctttggggacacaagactgctgagtgcttccacccgggcatggaaaccacaaagcaaactcagtgtggaaagaaaagaccctctggcagccttggcccgggaatacggtggttccaagcgcaatgctctactgaaatggtgccagaagaagacacaaggttatgcgaacattgacatcaccaatttcagcagcagctggagcgatggcctggccttctgtgctctgctccacacctacctgcctgcccacatcccctaccaggagctgaatagtcaggagaaaaagaggaatctcttgttggcatttgaagcggctgaaagtgtaggcatcaaacccagcctggaactcagcgagatgctgtacacagaccggcccgactggcagagtgtgatgcagtacgtggcccaaatctacaagtactttgagacgtaaccctggagggcctggggcagccaccattgccacctactgcagcttttcctggaagcgcctgattactgtccac

SEQ ID NO: 20236 - DNA, 570 bp, Homo sapiens
  ENST00000583482
tcagtgagcgcccggagccgtggccgctgggggttgcggcggcgctgagccagcggggccgatgtagattccaatgatgtcatctcactgaaacctccgcctcccaggttcaagtgatcctcctgcctcagcctcccaagtagctgggactacaggtgcacaccaccacgcccagctgatttttgtatttagtagagacaggatttcaccatgttagccagactggtcttgaactcctgacctaaggacagacccacgaagtcaagcatgcggagtgcagccaagccctggaacccagccatcagagcagggggccacggcccagaccgggtgcggcctctgcctgcagcctcttccggcatgaagagttctaagtcttcaacttccttggcttttgagtcccgactcagcaggctcaagagggccagcagtgaggacacgctcaacaagccaggaagtaccgctgcatcgggggtggttcgcctgaagaagaccgccactgccggagccatctcggagctcacggagagccgcctgaggagcggcacaggggcctttacaacaactaaa

SEQ ID NO: 20237 - DNA, 571 bp, Homo sapiens
  ENST00000583528
agtgagcgcccggagccgtggccgctgggggttgcggcggcgctgagccagcggggccggcgtagcgtgcctcctgtgattgttgaagagctgtggtgtgctgctgagtggcgtgtgtattccatgtgaggggaagggtccaacagtcctggtcattcagactgcagttccccagagacagagttttgctatgttgctcaggctggtcttgagctcctggcctcaagcaatccacctgccttggcctcccaaagtgctgagattacagatgtgagccaccacacccagtccaagtgtttctatttagttgataatggacagacccacgaagtcaagcatgcggagtgcagccaagccctggaacccagccatcagagcagggggccacggcccagaccgggtgcggcctctgcctgcagcctcttccggcatgaagagttctaagtcttcaacttccttggcttttgagtcccgactcagcaggctcaagagggccagcagtgaggacacgctcaacaagccaggaagtaccgctgcatcgggggtggttcgcctgaagaagaccgccact

SEQ ID NO: 20238 - DNA, 581 bp, Homo sapiens
  ENST00000583463
agccgtggccgctgggggttgcggcggcgctgagccagcggggccggcgtagcgtgcctcctgtgattgttgaagagctgtggtgtgctgctgagtggcgtgtgtattccatgtgaggggaagggtccaacagtcctggtcattcagactgcagttccccaggacagacccacgaagtcaagcatgcggagtgcagccaagccctggaacccagccatcagagcagggggccacggcccagaccgggtgcggcctctgcctgcagcctcttccggcatgaagagttctaagtcttcaacttccttggcttttgagtcccgactcagcaggctcaagagggccagcagtgaggacacgctcaacaagccaggaagtaccgctgcatcgggggtggttcgcctgaagaagaccgccactgccggagccatctcggagctcacggagagccgcctgaggagcggcacaggggcctttacaacaactaaacggacaggcattccagccccacgggaattttcagtaactgtctcaagagagaggtctgtgccacgtggtccctccaaccccaggaaatcagtgtc

SEQ ID NO: 20239 - DNA, 433 bp, Homo sapiens
  ENST00000578321
ctccctgttgtgccttgggggtgctgcgtggtgcagaggaccgagaagcccttcgccctcggcgtccgccgcgctcccgccccttcctggccggggtgacaggggaagggctagggctgcgcatcccgggtcagctggggcgccgcggcgcagtgcacctggaaggcccgggggcagcgcgcggtgcccgtgggtttcccggtggtgcggacctgcgggcgtgcggaagtaacgacctccttccccagtgcccatgcaaggaaattagtgttatgtgcttgctttttttttttttttttcctaaggaagtttgactctgaatatcttattttgctggagctccatttgccagcacgacagacccacgaagtcaagcatgcggagtgcagccaagccctggaacccagccatcagagcagggggccacggccca

SEQ ID NO: 20240 - DNA, 662 bp, Homo sapiens
  ENST00000582604
ggtaacgtgctgcggtcgcattccgcgctgctgaaggtttgtccttttgatgtttggaatgcgttcttattactgctcactctttgggtctgcactgtctatatgagctgcaacacacacctcgaaggtctgcagcttcactcctgaagctagcgagaccacgaactcaccaggaggaacgaacaactctagatgcgcccccttaagagctgtaacactcgccgcgaaggtctgcagcttcactcctgagtcagcgagactacgaacccaccagaaggaagaaactccgaacacatccaaacatcagaaggaacaaactccagacacaccgcctttaagaactgttacgctcaccgcgagggtccacggcttcattctccaagtcagaccaagaacccaccaattccggacacaaaaggtgttcccaccattcctgtcctcttacttctctcgccttacaagcgtagcgtgcctcctgtgattgttgaagagctgtggtgtgctgctgagtggcgtgtgtattccatgtgaggggaagggtccaacagtcctggtcattcagactgcagttccccaggacagacccacgaagtcaagcatgcggagtgcagccaagccctggaacccagccatcagagcagggggccacggcccagaccggg

SEQ ID NO: 20241 - DNA, 574 bp, Homo sapiens
  ENST00000413167
attgctcaagcgctctctgcccggccccctccgagtgtggttttcctcccaggccagcaccaaacccagaatagagtggctgacttgctgattgaggtcggcagctcccgagaagcaggagaagcagagtttttgcagacagacccacgaagtcaagcatgcggagtgcagccaagccctggaacccagccatcagagcagggggccacggcccagaccgggtgcggcctctgcctgcagcctcttccggcatgaagagttctaagtcttcaacttccttggcttttgagtcccgactcagcaggctcaagagggccagcagtgaggacacgctcaacaagccaggaagtaccgctgcatcgggggtggttcgcctgaagaagaccgccactgccggagccatctcggagctcacggagagccgcctgaggagcggcacaggggcctttacaacaactaaacggacaggcattccagccccacgggaattttcagtaactgtctcaagagagaggtctgtgccacgtggtccctccaaccccaggaaatcagtgtccagtccaacttcttccaa

SEQ ID NO: 20242 - DNA, 4971 bp, Homo sapiens
  ENST00000395529
aagaagcagaaaaggttggataaaagataaggacagacccacgaagtcaagcatgcggagtgcagccaagccctggaacccagccatcagagcagggggccacggcccagaccgggtgcggcctctgcctgcagcctcttccggcatgaagagttctaagtcttcaacttccttggcttttgagtcccgactcagcaggctcaagagggccagcagtgaggacacgctcaacaagccaggaagtaccgctgcatcgggggtggttcgcctgaagaagaccgccactgccggagccatctcggagctcacggagagccgcctgaggagcggcacaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagatgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccctccctgggctctgtcagctagcagagcatttggtggaagaaagacagcccagctcttgccatgattgggagccgcagccatctctagatgaaagggggaatgtgtagaggagaaattgcctctttataaagagcccagttgtctccttgtgacattctctgtttctcagagtcattgccgtcgagtctctgctttttgtccacattttgggatcagcttactgcatgatcaaagatgatgtttccctctttttacttttcctcagaagattgagctgtcttttatttggagaataaaatgaagttctgaaaaaaacaaagtacaagtcttatgaaaagttatttgcagctggagtgctgaaaagggcacagtggcagagcagatgcagagctgggtacagcgcaggcccgagttcttttgttttttgttgttgttgttgttgttgttttgttttgttttttttttttttttgagacagagtttcactcttgttgcccaggctggagtgcaatggtacgatctcggctcactgcaacctctgcctcccgggttcaagtgattctcttgcctcagccttccaagtagctggaattacaggcgcctgccaccacacccagctaatttttgtattgttagtagagatggggtttcaccgtgttggccaggctgctcttgaactcctgacctcaggtgatccccacctcagcctcccaaagtgctgggattacagacatgagccaccgcacccagaacctaaggcccaagttctactttttggtgttcatttctctgcttccttttgatcgtggtgtctgatcatcttggaattcacattactcaaggcaaaataggaagccatctgcgtgatgtcacattccgaagaagtcagaaggttcggcgagttggagctttactcttgttgcccaggctagagtgcagtggtgcgatcttggctcattgcaagctccgcttcctgggtttaagctattctcctgccttggcctcccaagtagctgggattacaggcatgtgccgtcactcctggctaattttgtatttttagtagagatgcaatttcaccatgttggtcaggctggtctcgaactcctgacctcaagtgatctggccgcctcagcctcccaaagtgctgggattacaggcttgagaccccatgtctggccccttctgtggggtcttgattgagccccttcacttggagtctgacttcattacctcgtctgaaacaaggtgcctccaagctttgggttgatttccagaatcttgttgggttaaacataagtagaagtttgatcataaaggatgttattaagccggataggtaagcacggtgacaatggcaatagaaatctaatggaaaacgattgaatgacaactacaccaaagtttcatggatgaaactcaccccagaaacttagtgttcaaatcagagtgatacacaattcaaaatgtgattttaaacttctggaaatatgtgtgtttgtgaagatccaaatccaattcagcaacctccatcaggcagaaaccttctgcaatcctcacatgaggaactggttcacagtgtacacagcatggagccattagtgacgttatccaaaggatgagacaagacaaaagttactgtctaataaaaggaaaattaggaacaggaatgctctttaaactcaggaagatcttttggggtgtcaaactggacagcacagaatcattagaaaaattagcttggcgtgagaagagacattgaggtcttctctgtaaaatttacttagatacttgtgaataggactgaaatttatattttgggcactctttacctcagattcagagttcttaggattatttaaaattcatttgctggatgttttcaagtataaacaataagaaaactgcaacttcaacttaaaaggcactgctgtatttgcaccctatattttgacctgtcgttaggtactgttgaatatttttatctgtaagcatttatgaagtgcaaaataaacatgttattatatagaagcgtctgctgcttagttttaatcaccagctacgtttctgcagggcctttatgtcgttttgttctacatttttttctgaatacagtttcagaacttcaaagtcacatcaagtaactagaatttgaggtagaaaaaagctggatgtaagttgtaaataggaggttgacatggaatatgaacagtttcattagtagaacaaaagggcatggagtaaaaatgctaattttgcataaatttttaaaactctagggtctcagaaaatatagcatggacttaaagtctagatgtgttttgttgacatttaaatatgaatagattgatgatttaatgtattggattttttcttaattatgaagtattatttaggtatactaataacaaaatggagacgtgtgaagaaaaatattaatctttcttctccctcagtaccacctgtgaggaaatcagtgttaacagtgtgtacatttttctttactcatgaatatgtatagggttcattttcatatttttaataaaaattggattatattcttttca

SEQ ID NO: 20243 - DNA, 3948 bp, Homo sapiens
  ENST00000261503
agaagcagaaaaggttggataaaagataaggacagacccacgaagtcaagcatgcggagtgcagccaagccctggaacccagccatcagagcagggggccacggcccagaccgggtgcggcctctgcctgcagcctcttccggcatgaagagttctaagtcttcaacttccttggcttttgagtcccgactcagcaggctcaagagggccagcagtgaggacacgctcaacaagccaggaagtaccgctgcatcgggggtggttcgcctgaagaagaccgccactgccggagccatctcggagctcacggagagccgcctgaggagcggcacaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagatgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccacctgtggatgaagagccagagtcctctgaggtcgatgctgctggtcggtggcctggtgtctgtgttagcagaacatctccaacacccccagagtcggcaaccaccgttaagtcacttatcaagtcatttgacttgggacgcccaggtggagctggacagaatatttctgtccataagacccccagaagtcccctaagtgggataccagtgaggactgctccagcagctgctgtctctccaatgcagaggcattcgacttacagcagtgtgcggccagccagcagaggggtgactcaacgcttggaccttcctgaccttcccctctcagatattctaaagggaaggactgagaccctgaagccagacccccacctccgcaagagtccctcactagagtcactgagcagacccccgtctctgggctttggggacacaagactgctgagtgcttccacccgggcatggaaaccacaaagcaaactcagtgtggaaagaaaagaccctctggcagccttggcccgggaatacggtggttccaagcgcaatgctctactgaaatggtgccagaagaagacacaaggttatgcgaacattgacatcaccaatttcagcagcagctggagcgatggcctggccttctgtgctctgctccacacctacctgcctgcccacatcccctaccaggagctgaatagtcaggagaaaaagaggaatctcttgttggcatttgaagcggctgaaagtgtaggcatcaaacccagcctggaactcagcgagatgctgtacacagaccggcccgactggcagagtgtgatgcagtacgtggcccaaatctacaagtactttgagacgtaaccctggagggcctggggcagccaccattgccacctactgcagcttttcctggaagcgcctgattactgtccactgaccctgctctgcccaccacccagctgcctagacttcaaagacaggctcaatccaagtggaccaacacccaaataagaaacagagtgggtcccacgatgtacctgtctgaaatgcaaatgcagctggactgtaaattggggactctttgatctcttgtgggatgcttctaaagagggcagcctccctccttccagaccaagaccccacacccaggcttgttttgctgattatattgggtggctgaacgaacacattatctgcagaaattcagacaaagaacatctccaaatcagtcttttggttgctgttgttaaaaatatcccggctttgcctttatgaaacctttgcccttggctgggtgtggtagctcgtggctgtaatcccagcactttaggaagccaaggcagtaggatcgtttgagcccaggagttcgaggctgcagtgagctatgagcataccactgcactccagcctgtgtgaaagagccagaccctgtctcaaaaaaatgataaaacccaaaactttgcccttgtgaaccctcccttcccccctccccccccaaaaaaaaacaacaaaacacaaaaaataaacatttgttccagggcaacctggaaa

SEQ ID NO: 20244 - DNA, 674 bp, Homo sapiens
  ENST00000581973
tgtgagagtggcagttagaattggttgtcacttgtgggtgttttgtaaagtgcatttctgatgttctttgaaaggacagaacatcatgggtttggtgccctgtgtcacaccctgagtccatggggacaggcggagtcagggttggggctggaagagaaccgagagggcatttaatccagtcctgttatgttattgacagaagaaacagaggctctgagagggtgagggatggaccaggccgctccttgctcaggaatcacagtgccggtccctgctggccagtctcgggctgccttccacatctctgtgtggattttcccctgatgtcttcagctgtatcttgctggacagacccacgaagtcaagcatgcggagtgcagccaagccctggaacccagccatcagagcagggggccacggcccagaccgggtgcggcctctgcctgcagcctcttccggcatgaagagttctaagtcttcaacttccttggcttttgagtcccgactcagcaggctcaagagggccagcagtgaggacacgctcaacaagccaggaagtaccgctgcatcgggggtggttcgcctgaagaagaccgccactgccggagccatctcggagctcacggagagccgcctgaggagcggcacaggggcctttacaacaactaaacgga

SEQ ID NO: 20245 - DNA, 462 bp, Homo sapiens
  ENST00000580934
gtgagagtggcagttagaattggttgtcacttgtgggtgttttgtaaagtgcatttctgatgttctttgaaaggacagaacatcatgggtttggtgccctgtgtcacaccctgagtccatggggacaggcggagtcagggttggggctggaagagaaccgagagggcatttaatccagtcctgttatgttattgacagaagaaacagaggctctgagagggacagacccacgaagtcaagcatgcggagtgcagccaagccctggaacccagccatcagagcagggggccacggcccagaccgggtgcggcctctgcctgcagcctcttccggcatgaagagttctaagtcttcaacttccttggcttttgagtcccgactcagcaggctcaagagggccagcagtgaggacacgctcaacaagccaggaagtaccgctgcatcgggggtggttcgcctgaa

SEQ ID NO: 20246 - DNA, 580 bp, Homo sapiens
  ENST00000582063
tgcacgagatagaaccagtcataccactaatggtttttttagtcctaaatatttttactgcaagatttcgttgttctaagtgttttcactgtcagatgaaggatgaaagtcgttcagggtaatttccattttagtaatttccgacagcggcagaacagtttctacttacgattggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttga

SEQ ID NO: 20247 - DNA, 461 bp, Homo sapiens
  ENST00000579688
gcagtggggtttttccagcctaccttgtgcagctgcggttctcagcatccgcgggcggaggcctgcagccggtcagccggtgcgtcccgcccacggcgcggggccttctggcagccaagaaggaaatacagatgaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctga

SEQ ID NO: 20248 - DNA, 8133 bp, Homo sapiens
  ENST00000395530
gatgcagatgagggggcggggcccacgggcgcgggagagcagcggctccgccggcagctgctgggaactggaaggcgcccggtcctttctttgactggagcggacccgccggacgcaaccgcctcgccagccggagccagcgcgagctcggcacggtggacacccggtccgaggccggcaagccggctggtgcccgagtcggccaagcatgggcaaccactcaggacggcccgaggatccggaaccaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagatgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccacctgtggatgaagagccagagtcctctgaggtcgatgctgctggtcggtggcctggtgtctgtgttagcagaacatctccaacacccccagagtcggcaaccaccgttaagtcacttatcaagtcatttgacttgggacgcccaggtggagctggacagaatatttctgtccataagacccccagaagtcccctaagtgggataccagtgaggactgctccagcagctgctgtctctccaatgcagaggcattcgacttacagcagtgtgcggccagccagcagaggggtgactcaacgcttggaccttcctgaccttcccctctcagatattctaaagggaaggactgagaccctgaagccagacccccacctccgcaagagtccctcactagagtcactgagcagacccccgtctctgggctttggggacacaagactgctgagtgcttccacccgggcatggaaaccacaaagcaaactcagtgtggaaagaaaagaccctctggcagccttggcccgggaatacggtggttccaagcgcaatgctctactgaaatggtgccagaagaagacacaaggttatgcgaacattgacatcaccaatttcagcagcagctggagcgatggcctggccttctgtgctctgctccacacctacctgcctgcccacatcccctaccaggagctgaatagtcaggagaaaaagaggaatctcttgttggcatttgaagcggctgaaagtgtaggcatcaaacccagcctggaactcagcgagatgctgtacacagaccggcccgactggcagagtgtgatgcagtacgtggcccaaatctacaagtactttgagacgtaaccctggagggcctggggcagccaccattgccacctactgcagcttttcctggaagcgcctgattactgtccactgaccctgctctgcccaccacccagctgcctagacttcaaagacaggctcaatccaagtggaccaacacccaaataagaaacagagtgggtcccacgatgtacctgtctgaaatgcaaatgcagctggactgtaaattggggactctttgatctcttgtgggatgcttctaaagagggcagcctccctccttccagaccaagaccccacacccaggcttgttttgctgattatattgggtggctgaacgaacacattatctgcagaaattcagacaaagaacatctccaaatcagtcttttggttgctgttgttaaaaatatcccggctttgcctttatgaaacctttgcccttggctgggtgtggtagctcgtggctgtaatcccagcactttaggaagccaaggcagtaggatcgtttgagcccaggagttcgaggctgcagtgagctatgagcataccactgcactccagcctgtgtgaaagagccagaccctgtctcaaaaaaatgataaaacccaaaactttgcccttgtgaaccctcccttcccccctccccccccaaaaaaaaacaacaaaacacaaaaaataaacatttgttccagggcaacctggaaacgtgcgtgcgcactcagccttttggggaaaaatgggagttctaggtaacaatgttaacacctggaacttgattcacttttagctctcaccatcccttatttgatttattgtagcaaaaggaaagcctgtgagaatgcaagggagcccctggctgctttgctggagtccctgggaggtgccccacacctctgccaccaaagtctgtgtgctcctgagcagctcgcggctttcacagtagggaaaccgcagtcctcgtcacctgcgcctttgtcctcccattcgtttaccctcccgttcacatccacacaggcttgtaccccacagaacttgacaggaggtcacatgtgtgaatggcctgtgtctgctttacagggttgagcaggctgagggtgtgtgcctctggggatgctgggctgacagcaaatcccaacagtatttcggctctggactgatttggcctttagtgcttccccaggcctctttcatcggcatgggaaaagcccttaggggtgggcggtgagggcacatttataactaacaaagaagaatgcagttgccccagcatcctactggtcaccttaagtggcagcagagccctccccagcggtgccccagtccctcagaagtgctcagtccggcccgagtgcccatctggtggctctgccgtgttcttctgggcggatctgtgtgcactacacagcgagtgagggcgtggctcacacagttgtttgagggaaatgggtaatgcccatcccttgctgttttaagtgccaaatagcgtgttagcgcccctccaacaaaggatcatccttccagtgagtcaccgagaatgacagtgactgccattactattcaaagtacatctctgattgctgatctgagccactggttcagagccaggttctagaggctgcaggtccagccccttaccattcctggagaggtaggagctcagtcccttcctccaagccagacctttgcagaggtggcaactgggctgcacgggtcagcagatccctgattctcaagccaccttgagacaagaactccgcccccctgttagtgcatcccagctgcagctctgcatcagaacctacagtggacccttttgaaaacactcttggctgccctagttggttaacttcagaatgtctggaatgggaccagagatgcagttcacatgttttgtaagttctttaggcgactgaagcacagctgcttggagaaccactgaggggtggacaccttcccctggcagccacaaggcaggcagcctgcgggagctcctgagcagctgttgggcgatggtcattacatcacccatgcctttgtatttaaatgaaactcgacacatagaaccaattcaacctgaaagttactacttctgctgattcaggcacttgtttgaagcattttttttttattaaccctgtacttcttctttgcccaccattaaagtgggggaaagtaatatcccaagtagttgagttgagctgttggttgttagatttaagctggaattagtccagggttttatgtggggaggcagttgctgtcttgggatacccggagtgggagtgggtgttttctgtgattggttctgttttttatttttacttatttattttgagatggagtttcatccttattgcccaggctggagggcaatagcaccgtctcagctcactgcaacctccgccgcccgtgtttaagcgattctcctgcctcagcctcccatgtggctgggattacaggtgcccatcaccacacccagctaatgtttttgtatttttagtaaagagggggtttcaccatgttggcccggctggtctcgaactcctgatggcaaggtgatctgcctgcctcagcctcccaaagtgctgggattacaggcatgagccactgagcccggctgtttttttgtgttttttttgttgttgtttgtttgtttttttttttgagacagagtcttgctctgtcgcccaggctggagtgccagtggcgcgatttcagctcactcaggagtgagccaccacacctggcctgtgattggctctattttgagtgattacgtgtaaatcatctagaaccagctctgagcaatggcgttgcggtgtccctccctccccgctggggccataccagcccctctccactgggagcccaagttgccaatgactgtggccaaactcccccatttttgtctgtatcctgctctctttaggttaaaaagaaggaaagaaacatgaaaggccatgtacaatttatttttacaactccaggagtttccccgactaccattttttttttttttatttgccagtggtgtgcatgtagaagaggaatgccatgtcctgtccatagaaatacacatggtggtcaggcatggtggctcatgcctataatcccagcactttgggaggctgaggtgggaggattgcttgagcccaggagtttgagaccagcctgggcaacatggcaagacctctgactctataaaaaaatttttttttttttttttttttgagagagcgtctcacttctctgtcacccaggctagagtagtgtgatcttggcttattacaacttccgcctcccaggttcaagagattctcctgccttagcctcctaagtagctgggattataggcacatgccaccatgcctggcatatttttgtatttttagtagaaacagtttcaccatgttggccaggctggtcttgaactcctgacctcaagtgataagcctgcctcaacctcccaaagtgctgggactacaggggtaagccaccgcgcctggcccaaaattttgttttttaattagctgggtacaatgataggcacctgtaatctcagctgcttgggaggctgaggtgggagcatcacttgagcccaggagtttgaggctgcagtaagctgtgtttgtgccactgcactctggcctgggccaaagagcaagaccctgtcacacacacacacaaaaaaaagaaatacaggtggtgttttggggaagggaaggttctgctggggtcctggaactgtgactgatggcctcaggagtccaggaataggccttctagcacagcagctagtagggctcccccaagccatccgctggcgtgtggaggtgcaggacctgggggaggcagtccccaacccagctaggccaaggggtagggtttttaggtctgtttttaacagagctcagagcaccaggtgaaggtggaaagttggcaggaaaacaaggtcagcatcttattttttctatactcagcagagtgtgccattcccagtttctgtcctgaggatttcaaagaccacaacagccacatttctttccatcttccctcagccagtagtcatttaaaattcttcagttgttctgaagatcctttttttaatgtatcatttttacatgaaagacagctgcaaaatgcaagccccagtagagttggagagtttttcaaggtgagaagtcgctgttctctgcattgaacatggattgaattttccttgtctgatggtaacccatggcccccgccctgcggggataacattctcaggagcttctcttgtcctagccccttctcatttcaaaaatattagtcttttattttcctttttcattcagtttttgttttacagcttttgtagagaccaacccaagtagatgcaggtgggtgttagataaaaacacacatccccaggggacaagccatccagcggtgaggaatctctgccatgttctcttccctgctgcccacaaacgttacggagactcccttagcctccccctcctcttccccactgaggggcagcttgtggagatggaggactcgggcccatagatgcagaccccctaccaaatctagcaatagttctcacccttccaaagctcgagtgccattttgagatgacctaccaatgacatgcagtaaaggacataacctcacagcctttttagaagcatttcgaatatctacagttgcctcaattcacggggcatttcactcctctgatccaggttagaattttgctaaatctgtagcatcctgaatagcacactaatttttttttttagcacactaactttaactacattagttgagtgtagttgatacatctgtggcctcgtgtctataaagagcacactagattgtacccagcacttttggatatgacatgctaattagatgtatttaactattcataggaaagtgtatgataaatgactgtaatatttctaataaatatattttgtttctaatta

SEQ ID NO: 20249 - DNA, 731 bp, Homo sapiens
  ENST00000467722
agatgagggggcggggcccacgggcgcgggagagcagcggctccgccggcagctgctgggaactggaaggcgcccggtcctttctttgactggagcggacccgccggacgcaaccgcctcgccagccggagccagcgcgagctcggcacggtggacacccggtccgaggccggcaagccggctggtgcccgagtcggccaagcatgggcaaccactcaggacggcccgaggatccggaaccaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctcc

SEQ ID NO: 20250 - DNA, 2982 bp, Homo sapiens
  ENST00000395522
ctggagcggacccgccggacgcaaccgcctcgccagccggagccagcgcgagctcggcacggtggacacccggtccgaggccggcaagccggctggtgcccgagtcggccaagcatgggcaaccactcaggacggcccgaggatccggaaccaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagatgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccgtgagtctgctccctgggctctgtcagctagcagagcatttggtggaagaaagacagcccagctcttgccatgattgggagccgcagccatctctagatgaaagggggaatgtgtagaggagaaattgcctctttataaagagcccagttgtctccttgtgacattctctgtttctcagagtcattgccgtcgagtctctgctttttgtccacattttgggatcagcttactgcatgatcaaagatgatgtttccctctttttacttttcctcagaagattgagctgtcttttatttggagaataaaatgaagttctgaaaaaaacaaagtacaagtcttatgaaaagttatttgcagctggagtgctgaaaagggcacagtggcagagcagatgcagagctgggtacagcgcaggcccgagttcttttgttttttgttgttgttgttgttgttgttttgttttgttttttttttttttttgagacagagtttcactcttgttgcccaggctggagtgcaatggtacgatctcggctcactgcaacctctgcctcccgggttcaagtgattctcttgcctcagccttccaagtagctggaattacaggcgcctgccaccacacccagctaatttttgtattgttagtagagatggggtttcaccgtgttggccaggctgctcttgaactcctgacctcaggtgatccccacctcagcctcccaaagtgctgggattacagacatgagccaccgcacccag

SEQ ID NO: 20251 - DNA, 2536 bp, Homo sapiens
  ENST00000395525
cggacccgccggacgcaaccgcctcgccagccggagccagcgcgagctcggcacggtggacacccggtccgaggccggcaagccggctggtgcccgagtcggccaagcatgggcaaccactcaggacggcccgaggatccggaaccaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagatgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccctccctgggctctgtcagctagcagagcatttggtggaagaaagacagcccagctcttgccatgattgggagccgcagccatctctagatgaaagggggaatgtgtagaggagaaattgcctctttataaagagcccagttgtctccttgtgacattctctgtttctcagagtcattgccgtcgagtctctgctttttgtccacattttgggatcagcttactgcatgatcaaagatgatgtttccctctttttacttttcctcagaagattgagctgtcttttatttggagaataaaatgaagttctgaaaaaaacaaa

SEQ ID NO: 20252 - DNA, 2249 bp, Homo sapiens
  ENST00000581399
ggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccacctgtggatgaagagccagagtcctctgaggtcgatgctgctggtcggtggcctggtgtctgtgttagcagaacatctccaacacccccagagtcggcaaccaccgttaagtcacttatcaagtcatttgacttgggacgcccaggtggagctggacagaatatttctgtccataagacccccagaagtcccctaagtgggataccagtgaggactgctccagcagctgctgtctctccaatgcagaggcattcgacttacagcagtgtgcggccagccagcagaggggtgactcaacgcttggaccttcctgaccttcccctctcagatattctaaagggaaggactgagaccctgaagccagacccccacctccgcaagagtccctcactagagtcactgagcagacccccgtctctgggctttggggacacaagactgctgagtgcttccacccgggcatggaaaccacaaagcaaactcagtgtggaaagaaaagaccctctggcagccttggcccgggaatacggtggttccaagcgcaatgctctactgaaatggtgccagaagaagacacaaggttatgcgaagaggaatctcttgttggcatttgaagcggctgaaagtgtaggcatcaaacccagcctggaactcagcgagatgctgtacacagaccggcccgactggcagagtgtgatgcagtacgtggcccaaatctacaagtactttgagacgtaaccctggagggcctggggcagccaccattgccacctactgcagcttttcctggaagcgcctgattactgtccactgaccctgctctgcccaccacccagctgcctagacttcaaagacaggctcaatccaagtggaccaacacccaaataagaaacagagtgggtcccacgatgtacctgtctgaaatgcaaatgcagctggactgtaaattggggactctttgatctcttgtgggatgcttctaaagagggcagcctccctccttccagaccaagaccccacacccaggcttgttttgctgattatattgggtggctgaacgaacacattatctgcagaaattcagacaaagaacatctccaaatcagtcttttggttgctgttgttaaaaatatcccggctttgcctttatgaaacctttgcccttggctgggtgtggtagctcgtggctgtaatcccagcactttaggaagccaaggcagtaggatcgtttgagcccaggagttcgaggctgcagtgagctatgagcataccactgcactccagcctgtgtgaaagagccagaccctgtctcaaaaaaatgataaaacccaaaactttgcccttgtgaaccctcccttcccccctccccccccaaaaaaaaac

SEQ ID NO: 20253 - DNA, 732 bp, Homo sapiens
  ENST00000582226
aagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaagaaagacagcccagctcttgccatgattgggagccgcagccatctctagatgaaagggggaatgtgtagaggagaaattgcctctttataaagagcccagttgtctccttgtgacattctctgtttctcagagtcattgccgtcgagtctctgctttttgtccacattttgggatcagcttactgcatgatcaaagatgatgtttccctctttttacttttcctcagaagattgagctgtcttttatttggagaataaaatgaagttctgaaaaaaac

SEQ ID NO: 20254 - DNA, 940 bp, Homo sapiens
  ENST00000584527
atgttgaaagtagcccgagcagagaaagatctactggaactgtcttgcaatgagctcagacaagaattactaaaggcaaacggtgaaattaaacatgtttccagtctgctggccaaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccgtgagtctggtgggcaccagggccgtgcttgcttctcaatcactatctccctgggctctgtcagctagcagagcatttggtggaagaaagacagcccagctcttgccatgattgggagccgcagccatctctagatgaaagggggaatgtgtagaggagaaattgcctctttataaagagcccagttgtctccttgtgacattctctgtttctcagagtcattgccgtcgagtctctgctttttgtccacattttgggatcagcttactgcatgatcaaagatgatgtttccctctttttacttttcctcagaagattgagctgtcttttatttg

SEQ ID NO: 20255 - DNA, 195 bp, Homo sapiens
  ENST00000578153
tgcctgcccacatcccctaccaggagctgaatagtcaggagaaaaagaggaatctcttgttggcatttgaagcggctgaaagtgtaggcatcaaacccagcctggtacgtatcctattttgtatccttgtgatactttaattgtatgagaaatgactttatgccatctgataaacagtttctcgtagaacattga

SEQ ID NO: 20256 - DNA, 1190 bp, Homo sapiens
  ENST00000492188
tatatatactataatatatgcatttattactttgataatttttttgatatagcatcatgattaagcaactttgttatgcaacagaatgtttatgccataaatcttgcaaagtatgaattacctaaatcttgacaaaggtaaacaaaaatttatctttgataggtgtcaatcagtaatgttagttttggtgcagttgcaacctgttgatttttttttttcttaaactgagatcaaatattgtacacttgacttactattcttcgctttataatagtgaataatctatatgggaatatcagttgatattctttcctggcaaaagctatatattttaaattactgattccagtctctttgtctttttaacttagaagaggaatctcttgttggcatttgaagcggctgaaagtgtaggcatcaaacccagcctggaactcagcgagatgctgtacacagaccggcccgactggcagagtgtgatgcagtacgtggcccaaatctacaagtactttgagacgtaaccctggagggcctggggcagccaccattgccacctactgcagcttttcctggaagcgcctgattactgtccactgaccctgctctgcccaccacccagctgcctagacttcaaagacaggctcaatccaagtggaccaacacccaaataagaaacagagtgggtcccacgatgtacctgtctgaaatgcaaatgcagctggactgtaaattggggactctttgatctcttgtgggatgcttctaaagagggcagcctccctccttccagaccaagaccccacacccaggcttgttttgctgattatattgggtggctgaacgaacacattatctgcagaaattcagacaaagaacatctccaaatcagtcttttggttgctgttgttaaaaatatcccggctttgcctttatgaaacctttgcccttggctgggtgtggtagctcgtggctgtaatcccagcactttaggaagccaaggcagtaggatcgtttgagcccaggagttcgaggctgcagtgagctatgagcataccactgcactccagcctgtgtgaaagagccagaccctgtctcaaaaaaatgataaaacccaaaactttgcccttgtgaaccctcccttcccccctccccccccaaaaaaaaacaacaaaacacaaaaaataaacatt

SEQ ID NO: 20257 - DNA, 10782 bp, Homo sapiens
  ENST00000312358
acaggccgaaggcgggcgggcagcaggaaggcaggccgccggccccccagacttgtctcctagggcaccgtcccgcgggtgcccccgtggccgcccagttccggcgtccccccagcccagctctcagtggccatgcagaaagcccggggcacgcgaggcgaggatgcgggcacgagggcaccccccagccccggagtgcccccgaaaagggccaaggtgggggccggcggcggggctcctgtggccgtggccggggcgccagtcttcctgcggcccctgaagaacgcggcggtgtgcgcgggcagcgacgtgcggctgcgggtggtggtgagcgggacgccccagcccagcctccgctggttccgggatgggcagctcctgcccgcgccggcccccgagcccagctgcctgtggctgcggcgctgcggggcgcaggacgccggcgtgtacagctgcatggcccagaacgagcggggccgggcctcctgcgaggcggtgctcacagtgctggaggtcggagactcagagacggctgaggatgacatcagcgatgtgcagggaacccagcgcctggagcttcgggatgacggggccttcagcacccccacggggggttctgacaccctggtgggcacctccctggacacacccccgacctccgtgacaggcacctcagaggagcaagtgagctggtggggcagcgggcagacggtcctggagcaggaagcgggcagtgggggtggcacccgccgcctcccgggcagcccaaggcaagcacaggcaaccggggccgggccacggcacctgggggtggagccgctggtgcgggcatctcgagctaatctggtgggcgcaagctgggggtcagaggatagcctttccgtggccagtgacctgtacggcagcgcattcagcctgtacagaggacgggcgctctctatccacgtcagcgtccctcagagcgggttgcgcagggaggagcccgaccttcagcctcaactggccagcgaagccccacgccgccctgcccagccgcctccttccaaatccgcgctgctccccccaccgtcccctcgggtcgggaagcggtccccgccgggacccccggcccagcccgcggccacccccacgtcgccccaccgtcgcactcaggagcctgtgctgcccgaggacaccaccaccgaagagaagcgagggaagaagtccaagtcgtccgggccctccctggcgggcaccgcggaatcccgaccccagacgccactgagcgaggcctcaggccgcctgtcggcgttgggccgatcgcctaggctggtgcgcgccggctcccgcatcctggacaagctgcagttcttcgaggagcgacggcgcagcctggagcgcagcgactcgccgccggcgcccctgcggccctgggtgcccctgcgcaaggcccgctctctggagcagcccaagtcggagcgcggcgcaccgtggggcacccccggggcctcgcaggaagaactgcgggcgccaggcagcgtggccgagcggcgccgcctgttccagcagaaagcggcctcgctggacgagcgcacgcgtcagcgcagcccggcctcagacctcgagctgcgcttcgcccaggagctgggccgcatccgccgctccacgtcgcgggaggagctggtgcgctcgcacgagtccctgcgcgccacgctgcagcgtgccccatcccctcgagagcccggcgagcccccgctcttctctcggccctccacccccaagacatcgcgggccgtgagccccgccgccgcccagccgccctctccgagcagcgcggagaagccgggggacgagcctgggaggcccaggagccgcgggccggcgggcaggacagagccgggggaaggcccgcagcaggaggttaggcgtcgggaccaattcccgctgacccggagcagagccatccaggagtgcaggagccctgtgccgccccccgccgccgatcccccagaggccaggacgaaagcaccccccggtcggaagcgggagcccccggcgcaggccgtgcgcttcctgccctgggccacgccgggcctggagggcgctgctgtaccccagaccttggagaagaacagggcggggcctgaggcagagaagaggcttcgcagagggccggaggaggacggtccctgggggccctgggaccgccgaggggcccgcagccagggcaaaggtcgccgggcccggcccacctcccctgagctcgagtcttcggatgactcctacgtgtccgctggagaagagcccctagaggcccctgtgtttgagatccccctgcagaatgtggtggtggcaccaggggcagatgtgctgctcaagtgtatcatcactgccaaccccccgccccaagtgtcctggcacaaggatgggtcagcgctgcgcagcgagggccgcctcctcctccgggctgagggtgagcggcacaccctgctgctcagggaggccagggcagcagatgccgggagctatatggccaccgccaccaacgagctgggccaggccacctgtgccgcctcactgaccgtgagacccggtgggtctacatcccctttcagcagccccatcacctccgacgaggaatacctgagccccccagaggagttcccagagcctggggagacctggccgcgaacccccaccatgaagcccagtcccagccagaaccgccgttcttctgacactggctccaaggcaccccccaccttcaaggtctcacttatggaccagtcagtaagagaaggccaagatgtcatcatgagcatccgcgtgcagggggagcccaagcctgtggtctcctggctgagaaaccgccagcccgtgcgcccagaccagcggcgctttgcggaggaggctgagggtgggctgtgccggctgcggatcctggctgcagagcgtggcgatgctggtttctacacttgcaaagcggtcaatgagtatggtgctcggcagtgcgaggcccgcttggaggtccgagcacaccctgaaagccggtccctggccgtgctggcccccctgcaggacgtggacgtgggggccggggagatggcgctgtttgagtgcctggtggcggggcccactgacgtggaggtggattggctgtgccgtggccgcctgctgcagcctgcactgctcaaatgcaagatgcatttcgatggccgcaaatgcaagctgctacttacatctgtacatgaggacgacagtggcgtctacacctgcaagctcagcacggccaaagatgagctgacctgcagtgcccggctgaccgtgcggccctcgttggcacccctgttcacacggctgctggaagatgtggaggtgttggagggccgagctgcccgtttcgactgcaagatcagtggcaccccgccccctgttgttacctggactcattttggctgccccatggaggagagtgagaacttgcggctgcggcaggacgggggtctgcactcactgcacattgcccatgtgggcagcgaggacgaggggctctatgcggtcagtgctgttaacacccatggccaggcccactgctcagcccagctgtatgtagaagagccccggacagccgcctcaggccccagctcgaagctggagaagatgccatccattcccgaggagccagagcagggtgagctggagcggctgtccattcctgacttcctgcggccactgcaggacctggaggtgggactggccaaggaggccatgctagagtgccaggtgaccggcctgccctaccccaccatcagctggttccacaatggccaccgcatccagagcagcgacgaccggcgcatgacacagtacagggatgtccatcgcttggtgttccctgccgtggggcctcagcacgccggtgtctacaagagcgtcattgccaacaagctgggcaaagctgcctgctatgcccacctgtatgtcacagatgtggtcccaggccctccagatggcgccccgcaggtggtggctgtgacggggaggatggtcacactcacatggaacccccccaggagtctggacatggccatcgacccggactccctgacgtacacagtgcagcaccaggtgctgggctcggaccagtggacggcactggtcacaggcctgcgggagccagggtgggcagccacagggctgcgtaagggggtccagcacatcttccgggtcctcagcaccactgtcaagagcagcagcaagccctcacccccttctgagcctgtgcagctgctggagcacggcccaaccctggaggaggcccctgccatgctggacaaaccagacatcgtgtatgtggtggagggacagcctgccagcgtcaccgtcacattcaaccatgtggaggcccaggtcgtctggaggagctgccgaggggccctcctagaggcacgggccggtgtgtacgagctgagccagccagatgatgaccagtactgtcttcggatctgccgggtgagccgccgggacatgggggccctcacctgcaccgcccgaaaccgtcacggcacacagacctgctcggtcacattggagctggcagaggcccctcggtttgagtccatcatggaggacgtggaggtgggggctggggaaactgctcgctttgcggtggtggtcgagggaaaaccactgccggacatcatgtggtacaaggacgaggtgctgctgaccgagagcagccatgtgagcttcgtgtacgaggagaatgagtgctccctggtggtgctcagcacgggggcccaggatggaggcgtctacacctgcaccgcccagaacctggcgggtgaggtctcctgcaaagcagagttggctgtgcattcagctcagacagctatggaggtcgagggggtcggggaggatgaggaccatcgaggaaggagactcagcgacttttatgacatccaccaggagatcggcaggggtgctttctcctacttgcggcgcatagtggagcgtagctccggcctggagtttgcggccaagttcatccccagccaggccaagccaaaggcatcagcgcgtcgggaggcccggctgctggccaggctccagcacgactgtgtcctctacttccatgaggccttcgagaggcgccggggactggtcattgtcaccgagctctgcacagaggagctgctggagcgaatcgccaggaaacccaccgtgtgtgagtctgagatccgggcctatatgcggcaggtgctagagggaatacactacctgcaccagagccacgtgctgcacctcgatgtcaagcctgagaacctgctggtgtgggatggtgctgcgggcgagcagcaggtgcggatctgtgactttgggaatgcccaggagctgactccaggagagccccagtactgccagtatggcacacctgagtttgtagcacccgagattgtcaatcagagccccgtgtctggagtcactgacatctggcctgtgggtgttgttgccttcctctgtctgacaggaatctccccgtttgttggggaaaatgaccggacaacattgatgaacatccgaaactacaacgtggccttcgaggagaccacattcctgagcctgagcagggaggcccggggcttcctcatcaaagtgttggtgcaggaccggctgagacctaccgcagaagagaccctagaacatccttggttcaaaactcaggcaaagggcgcagaggtgagcacggatcacctgaagctattcctctcccggcggaggtggcagcgctcccagatcagctacaaatgccacctggtgctgcgccccatccccgagctgctgcgggcccccccagagcgggtgtgggtgaccatgcccagaaggccaccccccagtggggggctctcatcctcctcggattctgaagaggaagagctggaagagctgccctcagtgccccgcccactgcagcccgagttctctggctcccgggtgtccctcacagacattcccactgaggatgaggccctggggaccccagagactggggctgccacccccatggactggcaggagcagggaagggctccctctcaggaccaggaggctcccagcccagaggccctcccctccccaggccaggagcccgcagctggggctagccccaggcggggagagctccgcaggggcagctcggctgagagcgccctgccccgggccgggccgcgggagctgggccggggcctgcacaaggcggcgtctgtggagctgccgcagcgccggagccccagcccgggagccacccgcctggcccggggaggcctgggtgagggcgagtatgcccagaggctgcaggccctgcgccagcggctgctgcggggaggccccgaggatggcaaggtcagcggcctcaggggtcccctgctggagagcctggggggccgtgctcgggacccccggatggcacgagctgcctccagcgaggcagcgccccaccaccagcccccactcgagaaccggggcctgcaaaagagcagcagcttctcccagggtgaggcggagccccggggccggcaccgccgagcgggggcgcccctcgagatccccgtggccaggcttggggcccgtaggctacaggagtctccttccctgtctgccctcagcgaggcccagccatccagccctgcacggcccagcgcccccaaacccagtacccctaagtctgcagaaccttctgccaccacacctagtgatgctccgcagccccccgcaccccagcctgcccaagacaaggctccagagcccaggccagaaccagtccgagcctccaagcctgcaccacccccccaggccctgcaaaccctagcgctgcccctcacaccctatgctcagatcattcagtccctccagctgtcaggccacgcccagggcccctcgcagggccctgccgcgccgccttcagagcccaagccccacgctgctgtctttgccagggtggcctccccacctccgggagcccccgagaagcgcgtgccctcagccgggggtcccccggtgctagccgagaaagcccgagttcccacggtgccccccaggccaggcagcagtctcagtagcagcatcgaaaacttggagtcggaggccgtgttcgaggccaagttcaagcgcagccgcgagtcgcccctgtcgctggggctgcggctgctgagccgttcgcgctcggaggagcgcggccccttccgtggggccgaggaggaggatggcatataccggcccagcccggcggggaccccgctggagctggtgcgacggcctgagcgctcacgctcggtgcaggacctcagggctgtcggagagcctggcctcgtccgccgcctctcgctgtcactgtcccagcggctgcggcggacccctcccgcgcagcgccacccggcctgggaggcccgcggcggggacggagagagctcggagggcgggagctcggcgcggggctccccggtgctggcgatgcgcaggcggctgagcttcaccctggagcggctgtccagccgattgcagcgcagtggcagcagcgaggactcggggggcgcgtcgggccgcagcacgccgctgttcggacggcttcgcagggccacgtccgagggcgagagtctgcggcgccttggccttccgcacaaccagttggccgcccaggccggcgccaccacgccttccgccgagtccctgggctccgaggccagcgccacgtcgggctcctcagccccaggggaaagccgaagccggctccgctggggcttctctcggccgcggaaggacaaggggttatcgccaccaaacctctctgccagcgtccaggaggagttgggtcaccagtacgtgcgcagtgagtcagacttccccccagtcttccacatcaaactcaaggaccaggtgctgctggagggggaggcagccaccctgctctgcctgccagcggcctgccctgcaccgcacatctcctggatgaaagacaagaagtccttgaggtcagagccctcagtgatcatcgtgtcctgcaaagatgggcggcagctgctcagcatcccccgggcgggcaagcggcacgccggtctctatgagtgctcggccaccaacgtactgggcagcatcaccagctcctgtaccgtggctgtggcccgagtcccaggaaagctagctcctccagaggtaccccagacctaccaggacacggcgctggtgctgtggaagccgggagacagccgggcaccttgcacgtatacgctggagcggcgagtggatggggagtctgtgtggcaccctgtgagctcaggcatccccgactgttactacaacgtgacccacctgccagttggcgtgactgtgaggttccgtgtggcctgtgccaaccgtgctgggcaggggcccttcagcaactcttctgagaaggtctttgtcaggggtactcaagattcttcagctgtgccatctgctgcccaccaagaggcccctgtcacctcaaggccagccagggcccggcctcctgactctcctacctcactggccccacccctagctcctgctgcccccacacccccgtcagtcactgtcagcccctcatctccccccacacctcctagccaggccttgtcctcgctcaaggctgtgggtccaccaccccaaacccctccacgaagacacaggggcctgcaggctgcccggccagcggagcccaccctacccagtacccacgtcaccccaagtgagcccaagcctttcgtccttgacactgggaccccgatcccagcctccactcctcaaggggttaaaccagtgtcttcctctactcctgtgtatgtggtgacttcctttgtgtctgcaccaccagcccctgagcccccagcccctgagccccctcctgagcctaccaaggtgactgtgcagagcctcagcccggccaaggaggtggtcagctcccctgggagcagtccccgaagctctcccaggcctgagggtaccactcttcgacagggtccccctcagaaaccctacaccttcctggaggagaaagccaggggccgctttggtgttgtgcgagcgtgccgggagaatgccacggggcgaacgttcgtggccaagatcgtgccctatgctgccgagggcaagcggcgggtcctgcaggagtacgaggtgctgcggaccctgcaccacgagcggatcatgtccctgcacgaggcctacatcacccctcggtacctcgtgctcattgctgagagctgtggcaaccgggaactcctctgtgggctcagtgacaggttccggtattctgaggatgacgtggccacttacatggtgcagctgctacaaggcctggactacctccacggccaccacgtgctccacctagacatcaagccagacaacctgctgctggcccctgacaatgccctcaagattgtggactttggcagtgcccagccctacaacccccaggcccttaggccccttggccaccgcacgggcacgctggagttcatggctccggagatggtgaagggagaacccatcggctctgccacggacatctggggagcgggtgtgctcacttacattatgctcagtggacgctccccgttctatgagccagacccccaggaaacggaggctcggattgtggggggccgctttgatgccttccagctgtaccccaatacatcccagagcgccaccctcttcttgcgaaaggttctctctgtacatccctggagccggccctccctgcaggactgcctggcccacccatggttgcaggacgcctacctgatgaagctgcgccgccagacgctcaccttcaccaccaaccggctcaaggagttcctgggcgagcagcggcggcgccgggctgaggctgccacccgccacaaggtgctgctgcgctcctaccctggcggcccctagaggcacggaccacagccaggcctcgggcttcaactggggttcccaccaatgccacgggacattccagggcccacgctgagccaggcgggcctggggcttcggttaccaccagcagcaacatctggctgggctcttacctcatagaccttcaaggacagagaccccagggcctggacctgatgccaccccaggccaaagccagagtgggagacccattggtcaggctcagcagggtgggaacaggcagagggacaagaggggaatggagaagtggagaggaaaaggaatcgagggacaggaagggggaggctctaggaaggttctgggttgggggtcagtgcatctcagggagaaccaaggaaggtgggcatggctggagaggaggaaaaggaaggagccccaggtgtcagggcagtaggctgggagtcagtgtggcaaagcgggggcaggacacagatacagtggcaggggcccagggctgggacatgagagaaggcagcgaggcggcagagggagaagagaggactcaggtggaggtggggtgggtcagctgtcagcatccctcagaggagaaatgtggagagctggaggccagcagtcactcacactcgctctgtcctcctgtccagtggatacagccctgggcgctctgctggcccaaggatgtccccactgcccctccatggcctctggccttcttcccattcatatttatttatttattgacttttatgaagtttccccttccatccgatccctactgcccatgttgtcctgaccatccctcccagccatccagctgtctgtctgtctgccacaaggaaataaaaatggcaagcagcataa

SEQ ID NO: 20258 - DNA, 3874 bp, Homo sapiens
  ENST00000498378
tttctcaagatggatgtctcctggcctgccttggtccctcaaagtgaaaaccggccattcccgccgggcctttggccgactcacccatggtgcgtggaccgtgggcgtccttgctctagcccatgcctactcctcctcttggtccctgtccctctgtgaggcatcgagttcctgaagacagcccatgagatgtggaaccctcccactcacccccacacttatctaccacccacccgaccaggccccctgtgccctacagctgagagaggacccagcagaagggagggcggctcactagcacacccctgcatggactgggtgccctgttctccatgtgaggcctaatgggaaggagttcattgccatgctttggcaaccagtacgtggctcctgcttgtcatggcagccagagggaaactgaggcacagaacctgctagaatctgggaaagttgaaaatactcccaggaaccttttctcctaacctaaccactgggcatttttgaggacgattcaacagtagaagggagggaccttgaggaaggtgcctgtcacatcatgatgcagacagataagggactcagagacggctgaggatgacatcagcgatgtgcagggaacccagcgcctggagcttcgggatgacggggccttcagcacccccacggggggttctgacaccctggtgggcacctccctggacacacccccgacctccgtgacaggcacctcagaggagcaagtgagctggtggggcagcgggcagacggtcctggagcaggaagcgggcagtgggggtggcacccgccgcctcccgggcagcccaaggcaagcacaggcaaccggggccgggccacggcacctgggggtggagccgctggtgcgggcatctcgagctaatctggtgggcgcaagctgggggtcagaggatagcctttccgtggccagtgacctgtacggcagcgcattcagcctgtacagaggacgggcgctctctatccacgtcagcgtccctcagagcgggttgcgcagggaggagcccgaccttcagcctcaactggccagcgaagccccacgccgccctgcccagccgcctccttccaaatccgcgctgctccccccaccgtcccctcgggtcgggaagcggtccccgccgggacccccggcccagcccgcggccacccccacgtcgccccaccgtcgcactcaggagcctgtgctgcccgaggacaccaccaccgaagagaagcgagggaagaagtccaagtcgtccgggccctccctggcgggcaccgcggaatcccgaccccagacgccactgagcgaggcctcaggccgcctgtcggcgttgggccgatcgcctaggctggtgcgcgccggctcccgcatcctggacaagctgcagttcttcgaggagcgacggcgcagcctggagcgcagcgactcgccgccggcgcccctgcggccctgggtgcccctgcgcaaggcccgctctctggagcagcccaagtcggagcgcggcgcaccgtggggcacccccggggcctcgcaggaagaactgcgggcgccaggcagcgtggccgagcggcgccgcctgttccagcagaaagcggcctcgctggacgagcgcacgcgtcagcgcagcccggcctcagacctcgagctgcgcttcgcccaggagctgggccgcatccgccgctccacgtcgcgggaggagctggtgcgctcgcacgagtccctgcgcgccacgctgcagcgtgccccatcccctcgagagcccggcgagcccccgctcttctctcggccctccacccccaagacatcgcgggccgtgagccccgccgccgcccagccgccctctccgagcagcgcggagaagccgggggacgagcctgggaggcccaggagccgcgggccggcgggcaggacagagccgggggaaggcccgcagcaggaggttaggcgtcgggaccaattcccgctgacccggagcagagccatccaggagtgcaggagccctgtgccgccccccgccgccgatcccccagaggccaggacgaaagcaccccccggtcggaagcgggagcccccggcgcaggccgtgcgcttcctgccctgggccacgccgggcctggagggcgctgctgtaccccagaccttggagaagaacagggcggggcctgaggcagagaagaggcttcgcagagggccggaggaggacggtccctgggggccctgggaccgccgaggggcccgcagccagggcaaaggtcgccgggcccggcccacctcccctgagctcgagtcttcggatgactcctacgtgtccgctggagaagagcccctagaggcccctgtgtttgagatccccctgcagaatgtggtggtggcaccaggggcagatgtgctgctcaagtgtatcatcactgccaaccccccgccccaagtgtcctggcacaaggatgggtcagcgctgcgcagcgagggccgcctcctcctccgggctgagggtgagcggcacaccctgctgctcagggaggccagggcagcagatgccgggagctatatggccaccgccaccaacgagctgggccaggccacctgtgccgcctcactgaccgtgagacccggtgggtctacatcccctttcagcagccccatcacctccgacgaggaatacctgagccccccagaggagttcccagagcctggggagacctggccgcgaacccccaccatgaagcccagtcccagccagaaccgccgttcttctgacactggctccaaggcaccccccaccttcaaggtctcacttatggaccagtcagtaagagaaggccaagatgtcatcatgagcatccgcgtgcagggggagcccaagcctgtggtctcctggctgagaaaccgccagcccgtgcgcccagaccagcggcgctttgcggaggaggctgagggtgggctgtgccggctgcggatcctggctgcagagcgtggcgatgctggtttctacacttgcaaagcggtcaatgagtatggtgctcggcagtgcgaggcccgcttggaggtccgaggcgagtgagctcagggggccacctgtgctccccccgctaccctccgagccgcgcccctgtctcaggcacctctcggacctcgctgtgtttcactgcctcctgcccacagacccaggcctgccggcccggacccgtcccagcctcccctccccaccccatgcagcccccagggggatagcccatgggcccctgtggaccctccctccccaagtggacacatggctgtgcaggccaggaggcccacagatggactgagtgctgggaaggggcggctgcgaggggtatcaaccccccgagtctctccctgaaggggagcaccgggcgagtgcatgtgctactgctgctacaggcctgtctatctgtttgtctgtctgtgtgtctgtgacagtcagggaaggatgcctcggagctgaggtggggtgagacagagtgggagagattacggcatggcatggaggggcccaaggagcaggggctgttgacaaaggccttaccaggaagggttaggacactgaccattctagaaatgggtttcgaatggcacaacactttctatttcacaaaagaccaaaagccagaggccccaggctctgtgctgatgaacagcctggctgagccctggccctggcaggtttagggcccatttggggccccctccttctctgtcagggctggggtgctctgtctgggaatgagggagttaaccaagtttggtgcaggagcaggggcagggggccactgtagtgagcgtggagaaatttggaaacacctatttcttaactcaaataaagtccagtttgtacct

SEQ ID NO: 20259 - DNA, 605 bp, Homo sapiens
  ENST00000435853
acagtgtgtgtgcgcgcatgtttgtggaatgagcaagtcgagatgctgctgaccttccagagaggccccgcgggaggagaaaaccggccattcccgccgggcctttggccgactcacccatgcgaagttttccgctcctgcagaaagcaaagttacgactcagagacggctgaggatgacatcagcgatgtgcagggaacccagcgcctggagcttcgggatgacggggccttcagcacccccacggggggttctgacaccctggtgggcacctccctggacacacccccgacctccgtgacaggcacctcagaggagcaagtgagctggtggggcagcgggcagacggtcctggagcaggaagcgggcagtgggggtggcacccgccgcctcccgggcagcccaagcagcgtccctcagagcgggttgcgcagggaggagcccgaccttcagcctcaactggccagcgaagccccacgccgccctgcccagccgcctccttccaaatccgcgctgctccccccaccgtcccctcgggtcgggaagcggtccccgccgggacccccggcccagcccgcggccacccccacgtcgccccaccgtcg

SEQ ID NO: 20260 - DNA, 546 bp, Homo sapiens
  ENST00000403148
ctcgcccggccgccggcccggccccctcccccgccatgaagaagctgtgggtgaagaagcgtttccagaaaaccggccattcccgccgggcctttggccgactcacccatggtgcgtggaccgtgggcgtccttgctctagcccatgcctactcctcctcttggtccctgtccctctgtgaggcatcgagttcctgaagacagcccatgagatgtggaaccctcccactcacccccacacttatctaccacccacccgaccaggccccctgtgccctacagctgagagaggacccagcagaagggagggcggctcactagcacacccctgcatggactgggtgccctgttctccatgtgaggcctaatgggaaggagttcattgccatgctttggcaaccacgaagttttccgctcctgcagaaagcaaagttacgactcagagacggctgaggatgacatcagcgatgtgcagggaacccagcgcctggagcttcgggatgacggggccttcagcacccccacggggggttctgacaccctggtg

SEQ ID NO: 20261 - DNA, 926 bp, Homo sapiens
  ENST00000431523
ggccgccggcccggccccctcccccgccatgaagaagctgtgggtgaagaagcgtttccagaaaaccggccattcccgccgggcctttggccgactcacccatgttttccgctcctgcagaaagcaaagttacgactcagagacggctgaggatgacatcagcgatgtgcagggaacccagcgcctggagcttcgggatgacggggccttcagcacccccacggggggttctgacaccctggtgggcacctccctggacacacccccgacctccgtgacaggcacctcagaggagcaagtgagctggtggggcagcgggcagacggtcctggagcaggaagcgggcagtgggggtggcacccgccgcctcccgggcagcccaagcagcgtccctcagagcgggttgcgcagggaggagcccgaccttcagcctcaactggccagcgaagccccacgccgccctgcccagccgcctccttccaaatccgcgctgctccccccaccgtcccctcgggtcgggaagcggtccccgccgggacccccggcccagcccgcggccacccccacgtcgccccaccgtcgcactcaggagcctgtgctgcccgaggacaccaccaccgaagagaagcgagggaagaagtccaagtcgtccgggccctccctggcgggcaccgcggaatcccgaccccagacgccactgagcgaggcctcaggccgcctgtcggcgttgggccgatcgcctaggctggtgcgcgccggctcccgcatcctggacaagctgcagttcttcgaggagcgacggcgcagcctggagcgcagcgactcgccgccggcgcccctgcggccctgggtgcccctgcgcaaggcccgctctctggagcagcccaagtcggagcgcggcgcaccgtggggcacccccggggcct

SEQ ID NO: 20262 - DNA, 3379 bp, Homo sapiens
  ENST00000396698
cccgccatgaagaagctgtgggtgaagaagcgtttccagaaaaccggccattcccgccgggcctttggccgactcacccatgactcagagacggctgaggatgacatcagcgatgtgcagggaacccagcgcctggagcttcgggatgacggggccttcagcacccccacggggggttctgacaccctggtgggcacctccctggacacacccccgacctccgtgacaggcacctcagaggagcaagtgagctggtggggcagcgggcagacggtcctggagcaggaagcgggcagtgggggtggcacccgccgcctcccgggcagcccaaggcaagcacaggcaaccggggccgggccacggcacctgggggtggagccgctggtgcgggcatctcgagctaatctggtgggcgcaagctgggggtcagaggatagcctttccgtggccagtgacctgtacggcagcgcattcagcctgtacagaggacgggcgctctctatccacgtcagcgtccctcagagcgggttgcgcagggaggagcccgaccttcagcctcaactggccagcgaagccccacgccgccctgcccagccgcctccttccaaatccgcgctgctccccccaccgtcccctcgggtcgggaagcggtccccgccgggacccccggcccagcccgcggccacccccacgtcgccccaccgtcgcactcaggagcctgtgctgcccgaggacaccaccaccgaagagaagcgagggaagaagtccaagtcgtccgggccctccctggcgggcaccgcggaatcccgaccccagacgccactgagcgaggcctcaggccgcctgtcggcgttgggccgatcgcctaggctggtgcgcgccggctcccgcatcctggacaagctgcagttcttcgaggagcgacggcgcagcctggagcgcagcgactcgccgccggcgcccctgcggccctgggtgcccctgcgcaaggcccgctctctggagcagcccaagtcggagcgcggcgcaccgtggggcacccccggggcctcgcaggaagaactgcgggcgccaggcagcgtggccgagcggcgccgcctgttccagcagaaagcggcctcgctggacgagcgcacgcgtcagcgcagcccggcctcagacctcgagctgcgcttcgcccaggagctgggccgcatccgccgctccacgtcgcgggaggagctggtgcgctcgcacgagtccctgcgcgccacgctgcagcgtgccccatcccctcgagagcccggcgagcccccgctcttctctcggccctccacccccaagacatcgcgggccgtgagccccgccgccgcccagccgccctctccgagcagcgcggagaagccgggggacgagcctgggaggcccaggagccgcgggccggcgggcaggacagagccgggggaaggcccgcagcaggaggttaggcgtcgggaccaattcccgctgacccggagcagagccatccaggagtgcaggagccctgtgccgccccccgccgccgatcccccagaggccaggacgaaagcaccccccggtcggaagcgggagcccccggcgcaggccgtgcgcttcctgccctgggccacgccgggcctggagggcgctgctgtaccccagaccttggagaagaacagggcggggcctgaggcagagaagaggcttcgcagagggccggaggaggacggtccctgggggccctgggaccgccgaggggcccgcagccagggcaaaggtcgccgggcccggcccacctcccctgagctcgagtcttcggatgactcctacgtgtccgctggagaagagcccctagaggcccctgtgtttgagatccccctgcagaatgtggtggtggcaccaggggcagatgtgctgctcaagtgtatcatcactgccaaccccccgccccaagtgtcctggcacaaggatgggtcagcgctgcgcagcgagggccgcctcctcctccgggctgagggtgagcggcacaccctgctgctcagggaggccagggcagcagatgccgggagctatatggccaccgccaccaacgagctgggccaggccacctgtgccgcctcactgaccgtgagacccggtgggtctacatcccctttcagcagccccatcacctccgacgaggaatacctgagccccccagaggagttcccagagcctggggagacctggccgcgaacccccaccatgaagcccagtcccagccagaaccgccgttcttctgacactggctccaaggcaccccccaccttcaaggtctcacttatggaccagtcagtaagagaaggccaagatgtcatcatgagcatccgcgtgcagggggagcccaagcctgtggtctcctggctgagaaaccgccagcccgtgcgcccagaccagcggcgctttgcggaggaggctgagggtgggctgtgccggctgcggatcctggctgcagagcgtggcgatgctggtttctacacttgcaaagcggtcaatgagtatggtgctcggcagtgcgaggcccgcttggaggtccgaggcgagtgagctcagggggccacctgtgctccccccgctaccctccgagccgcgcccctgtctcaggcacctctcggacctcgctgtgtttcactgcctcctgcccacagacccaggcctgccggcccggacccgtcccagcctcccctccccaccccatgcagcccccagggggatagcccatgggcccctgtggaccctccctccccaagtggacacatggctgtgcaggccaggaggcccacagatggactgagtgctgggaaggggcggctgcgaggggtatcaaccccccgagtctctccctgaaggggagcaccgggcgagtgcatgtgctactgctgctacaggcctgtctatctgtttgtctgtctgtgtgtctgtgacagtcagggaaggatgcctcggagctgaggtggggtgagacagagtgggagagattacggcatggcatggaggggcccaaggagcaggggctgttgacaaaggccttaccaggaagggttaggacactgaccattctagaaatgggtttcgaatggcacaacactttctatttcacaaaagaccaaaagccagaggccccaggctctgtgctgatgaacagcctggctgagccctggccctggcaggtttagggcccatttggggccccctccttctctgtcagggctggggtgctctgtctgggaatgagggagttaaccaagtttggtgcaggagcaggggcagggggccactgtagtgagcgtggagaaatttggaaacacctatttcttaactcaaataaagtccagtttgtacc

SEQ ID NO: 20263 - DNA, 583 bp, Homo sapiens
  ENST00000452101
cgccatgaagaagctgtgggtgaagaagcgtttccagaaaaccggccattcccgccgggcctttggccgactcacccatgcgaagttttccgctcctgcagaaagcaaagttacgactcagagacggctgaggatgacatcagcgatgtgcagggaacccagcgcctggagcttcgggatgacggggccttcagcacccccacggggggttctgacaccctggtgggcacctccctggacacacccccgacctccgtgacaggcacctcagaggagcaagtgagctggtggggcagcgggcagacggtcctggagcaggaagcgggcagtgggggtggcacccgccgcctcccgggcagcccaagcagcgtccctcagagcgggttgcgcagggaggagcccgaccttcagcctcaactggccagcgaagccccacgccgccctgcccagccgcctccttccaaatccgcgctgctccccccaccgtcccctcgggtcgggaagcggtccccgccgggacccccggcccagcccgcggccacccccacgtcgccccaccgtcgcactcaggagcctgtgctgc

SEQ ID NO: 20264 - DNA, 579 bp, Homo sapiens
  ENST00000420132
ccatgaagaagctgtgggtgaagaagcgtttccagaaaaccggccattcccgccgggcctttggccgactcacccatggtgcgtggaccgtgggcgtccttgctctagcccatgcctactcctcctcttggtccctgtccctctgtgaggcatcgagttcctgaagacagcccatgagatgtggaaccctcccactcacccccacacttatctaccacccacccgaccaggccccctgtgccctacagctgagagaggacccagcagaagggagggcggctcactagcacacccctgcatggactgggtgccctgttctccatgtgaggcctaatgggaaggagttcattgccatgctttggcaaccattttccgctcctgcagaaagcaaagttacgactcagagacggctgaggatgacatcagcgatgtgcagggaacccagcgcctggagcttcgggatgacggggccttcagcacccccacggggggttctgacaccctggtgggcacctccctggacacacccccgacctccgtgacaggcacctcagaggagcaagtgagctggtggggcag

SEQ ID NO: 20265 - DNA, 5132 bp, Homo sapiens
  ENST00000464989
tattgtaatagagggtgggcctgactcctaatgggaggcccaggtctgcggctggactggacacaagcaggtgtgtgtgtgtgtgtgtgcatgtgtgtgtgtggccagtggcagcaccagtaagtgccaaggataccagaaccactggggcagctggaataacaagcccaagtatgggggtccccagtgctgggcacatcccaggtatctccctccccacccattgccacaggacacctctggggactgggtgcctcacgccccttctgtcttgactgccctccatgccctgccccacaaacgctctgataacagtctgtccctgtctctctcctgctgctcctatggaagcgaagttttccgctcctgcagaaagcaaagttacgactcagagacggctgaggatgacatcagcgatgtgcagggaacccagcgcctggagcttcgggatgacggggccttcagcacccccacggggggttctgacaccctggtgggcacctccctggacacacccccgacctccgtgacaggcacctcagaggagcaagtgagctggtggggcagcgggcagacggtcctggagcaggaagcgggcagtgggggtggcacccgccgcctcccgggcagcccaaggcaagcacaggcaaccggggccgggccacggcacctgggggtggagccgctggtgcgggcatctcgagctaatctggtgggcgcaagctgggggtcagaggatagcctttccgtggccagtgacctgtacggcagcgcattcagcctgtacagaggacgggcgctctctatccacgtcagcgtccctcagagcgggttgcgcagggaggagcccgaccttcagcctcaactggccagcgaagccccacgccgccctgcccagccgcctccttccaaatccgcgctgctccccccaccgtcccctcgggtcgggaagcggtccccgccgggacccccggcccagcccgcggccacccccacgtcgccccaccgtcgcactcaggagcctgtgctgcccgaggacaccaccaccgaagagaagcgagggaagaagtccaagtcgtccgggccctccctggcgggcaccgcggaatcccgaccccagacgccactgagcgaggcctcaggccgcctgtcggcgttgggccgatcgcctaggctggtgcgcgccggctcccgcatcctggacaagctgcagttcttcgaggagcgacggcgcagcctggagcgcagcgactcgccgccggcgcccctgcggccctgggtgcccctgcgcaaggcccgctctctggagcagcccaagtcggagcgcggcgcaccgtggggcacccccggggcctcgcaggaagaactgcgggcgccaggcagcgtggccgagcggcgccgcctgttccagcagaaagcggcctcgctggacgagcgcacgcgtcagcgcagcccggcctcagacctcgagctgcgcttcgcccaggagctgggccgcatccgccgctccacgtcgcgggaggagctggtgcgctcgcacgagtccctgcgcgccacgctgcagcgtgccccatcccctcgagagcccggcgagcccccgctcttctctcggccctccacccccaagacatcgcgggccgtgagccccgccgccgcccagccgccctctccgagcagcgcggagaagccgggggacgagcctgggaggcccaggagccgcgggccggcgggcaggacagagccgggggaaggcccgcagcaggaggttaggcgtcgggaccaattcccgctgacccggagcagagccatccaggagtgcaggagccctgtgccgccccccgccgccgatcccccagaggccaggacgaaagcaccccccggtcggaagcgggagcccccggcgcaggccgtgcgcttcctgccctgggccacgccgggcctggagggcgctgctgtaccccagaccttggagaagaacagggcggggcctgaggcagagaagaggcttcgcagagggccggaggaggacggtccctgggggccctgggaccgccgaggggcccgcagccagggcaaaggtcgccgggcccggcccacctcccctgagctcgagtcttcggatgactcctacgtgtccgctggagaagagcccctagaggcccctgtgtttgagatccccctgcagaatgtggtggtggcaccaggggcagatgtgctgctcaagtgtatcatcactgccaaccccccgccccaagtgtcctggcacaaggatgggtcagcgctgcgcagcgagggccgcctcctcctccgggctgagggtgagcggcacaccctgctgctcagggaggccagggcagcagatgccgggagctatatggccaccgccaccaacgagctgggccaggccacctgtgccgcctcactgaccgtgagacccggtgggtctacatcccctttcagcagccccatcacctccgacgaggaatacctgagccccccagaggagttcccagagcctggggagacctggccgcgaacccccaccatgaagcccagtcccagccagaaccgccgttcttctgacactggctccaaggcaccccccaccttcaaggtctcacttatggaccagtcagtaagagaaggccaagatgtcatcatgagcatccgcgtgcagggggagcccaagcctgtggtctcctggctgagaaaccgccagcccgtgcgcccagaccagcggcgctttgcggaggaggctgagggtgggctgtgccggctgcggatcctggctgcagagcgtggcgatgctggtttctacacttgcaaagcggtcaatgagtatggtgctcggcagtgcgaggcccgcttggaggtccgaggtgagtacctgatttctccatgaatgcccacctggccctggccccttccttcccccactgtctgctctcacacagcctcagttagaggatgccaccactgaaagggccttaaggggcccctagtccagctgcttatattattgttgagtgaaccaaagcccagagacaggaagtgacctgcccaaagctgcacagcacattgttccgtgctcagcttactacacaacaccaccttccctgttgctccatcacggagccctggcggcagccagagaccctgcacctgccactggccaagctctctctacactcttctgagcctttgtcaccctgctctgcccaggaccctccctcatccccctccccctctcctctcgcccctttgcccaccctcccatcccattgctgtgcagaagctactgtgaggtagcggtggggagagtctggtggctggacccgttcggaggggcccttggggtggcttaggcttggagcatcacagggaccctagggtgccagggtgagcacagctgtgacgtgtgaagaggcctgggcccccagagcctggggcatatgtgcaggggccctctcaggcagcagaaatgccaggccctggctagggggccctcgagggccatgggttttcctccccaaaggccacaaccgtttatcttgccttccacctcacccttcgcctcaatggctcctcgcttcctctcctcgcttctcactcagcccccagcccctgaccttccccaaggctcagagctcagaccctgacagtcatggtccctctgctggcccccctgcctcagttcccctcctctgtgcctgccgttcctgtagttgccacttccttggtctccagattcttcagccctcctccccggcctgctttctctccagggcctggctctgcctcgcttctctgtattaacccatgtcttggtgcttctttctcttggggattccttccgacacccccaggctttggggtgctcctgatcccatgaatgcctggttgcccggggtctctgcctgcccaggaaccccgaggaaccagtctctggctagctgccggccctcgcagcccagagctgtccttgggggagccaagagtggcagtgctgccctgacggtgtgagaggcagccctctatgcagaagggccctagccaggtctgcgtgcctgtgcgtgcatgtgtgcgtgtgcgtgcgcatgcgtgcgtgtatgtgcatgcatgtgtgtgcatgtgtgtgcgtgtgtgcgtgcgtgtgcatgtgtgcgtatgggtgtgtgcatgcgtgtgtgtgtgcgcgcgtgtgcgtgcacgtgtgcgtgcatgtgtgcgtgtgcatgcgtgtgtgtgcatgtgtgtgtgtgcgcgtgcgtgcgcgtatgctgcactaacctgccgcttgctgactgaggtttttgtctgtacacaggcgagtgagctcagggggccacctgtgctccccccgctaccctccgagccgcgcccctgtctcaggcacctctcggacctcgctgtgtttcactgcctcctgcccacagacccaggcctgccggcccggacccgtcccagcctcccctccccaccccatgcagcccccagggggatagcccatgggcccctgtggaccctccctccccaagtggacacatggctgtgcaggccaggaggcccacagatggactgagtgctgggaaggggcggctgcgaggggtatcaaccccccgagtctctccctgaaggggagcaccgggcgagtgcatgtgctactgctgctacaggcctgtctatctgtttgtctgtctgtgtgtctgtgacagtcagggaaggatgcctcggagctgaggtggggtgagacagagtgggagagattacggcatggcatggaggggcccaaggagcaggggctgttgacaaaggccttaccaggaagggttaggacactgaccattctagaaatgggtttcgaatggcacaacactttctatttcacaaaagaccaaaagccagaggccccaggctctgtgctgatgaacagcctggctgagccctggccctggcaggtttagggcccatttggggccccctccttctctgtcagggctggggtgctctgtctgggaatgagggagttaaccaagtttggtgcaggagcaggggcagggggccactgtagtgagcgtggagaaatttggaaacacctatttcttaactcaaataaagtccagtttgtacct

SEQ ID NO: 20266 - DNA, 551 bp, Homo sapiens
  ENST00000451076
agagacggctgaggatgacatcagcgatgtgcagggaacccagcgcctggagcttcgggatgacggggccttcagcacccccacgggcacctcagaggagcaagtgagctggtggggcagcgggcagacggtcctggagcaggaagcgggcagtgggggtggcacccgccgcctcccgggcagcccaaggcaagcacaggcaaccggggccgggccacggcacctgggggtggagccgctggtgcgggcatctcgagctaatctggtgggcgcaagctgggggtcagaggatagcctttccgtggccagtgacctgtacggcagcgcattcagcctgtacagaggacgggcgctctctatccacgtcagcgtccctcagagcgggttgcgcagggaggagcccgaccttcagcctcaactggccagcgaagccccacgccgccctgcccagccgcctccttccaaatccgcgctgctccccccaccgtcccctcgggtcgggaagcggtccccgccgggacccccggcccagcccgcggccacccccacgt

SEQ ID NO: 20267 - DNA, 420 bp, Homo sapiens
  ENST00000409595
atctcgagctaatctggtgggcgcaagctgggggtcagaggatagcctttccgtggccagtgacctgtacggcagcgcattcagcctgtacagaggacgggcgctctctatccacgtagtcttcggatgactcctacgtgtccgctggagaagagcccctagaggcccctgtgtttgagatccccctgcagaatgtggtggtggcaccaggggcagatgtgctgctcaagtgtatcatcactgccaaccccccgccccaagtgtcctggcacaaggatgggtcagcgctgcgcagcgagggccgcctcctcctccgggctgagggtgagcggcacaccctgctgctcagggaggccagggcagcagatgccgggagctatatggccaccgccaccaacgagctgggccaggccacctgtg

SEQ ID NO: 20268 - DNA, 554 bp, Homo sapiens
  ENST00000497065
ttttcatctctctgcacattcctgttcccatgtgggcctttttctgggaggaacagaacctttccacacggcagctcccgggagagcaggagagagcaggggaacaagccagcaagcaggagagagaagagacagcgtccctcagagcgggttgcgcagggaggagcccgaccttcagcctcaactggccagcgaagccccacgccgccctgcccagccgcctccttccaaatccgcgctgctccccccaccgtcccctcgggtcgggaagcggtccccgccgggacccccggcccagcccgcggccacccccacgtcgccccaccgtcgcactcaggagcctgtgctgcccgaggacaccaccaccgaagagaagcgagggaagaagtccaagtcgtccgggccctccctggcgggcaccgcggaatcccgaccccagacgccactgagcgaggcctcaggccgcctgtcggcgttgggccgatcgcctaggctggtgcgcgccggctcccgcatcctggacaagctgcagttcttcgaggagcgacggcgca

SEQ ID NO: 20269 - DNA, 590 bp, Homo sapiens
  ENST00000491248
atgtgggcctttttctgggaggaacagaacctttccacacggcagctcccgggagagcaggagagagcaggggaacaagccagcaagcaggagagagaagagagtgagcagcgtccctcagagcgggttgcgcagggaggagcccgaccttcagcctcaactggccagcgaagccccacgccgccctgcccagccgcctccttccaaatccgcgctgctccccccaccgtcccctcgggtcgggaagcggtccccgccgggacccccggcccagcccgcggccacccccacgtcgccccaccgtcgcactcaggagcctgtgctgcccgaggacaccaccaccgaagagaagcgagggaagaagtccaagtcgtccgggccctccctggcgggcaccgcggaatcccgaccccagacgccactgagcgaggcctcaggccgcctgtcggcgttgggccgatcgcctaggctggtgcgcgccggctcccgcatcctggacaagctgcagttcttcgaggagcgacggcgcagcctggagcgcagcgactcgccgccggcgcccctgcggccctgggtgcccctgcgcaagg

SEQ ID NO: 20270 - DNA, 9854 bp, Homo sapiens
  ENST00000485813
cccgggagagcaggagagagcaggggaacaagccagcaagcaggagagagaagagagtgagcgtccctcagagcgggttgcgcagggaggagcccgaccttcagcctcaactggccagcgaagccccacgccgccctgcccagccgcctccttccaaatccgcgctgctccccccaccgtcccctcgggtcgggaagcggtccccgccgggacccccggcccagcccgcggccacccccacgtcgccccaccgtcgcactcaggagcctgtgctgcccgaggacaccaccaccgaagagaagcgagggaagaagtccaagtcgtccgggccctccctggcgggcaccgcggaatcccgaccccagacgccactgagcgaggcctcaggccgcctgtcggcgttgggccgatcgcctaggctggtgcgcgccggctcccgcatcctggacaagctgcagttcttcgaggagcgacggcgcagcctggagcgcagcgactcgccgccggcgcccctgcggccctgggtgcccctgcgcaaggcccgctctctggagcagcccaagtcggagcgcggcgcaccgtggggcacccccggggcctcgcaggaagaactgcgggcgccaggcagcgtggccgagcggcgccgcctgttccagcagaaagcggcctcgctggacgagcgcacgcgtcagcgcagcccggcctcagacctcgagctgcgcttcgcccaggagctgggccgcatccgccgctccacgtcgcgggaggagctggtgcgctcgcacgagtccctgcgcgccacgctgcagcgtgccccatcccctcgagagcccggcgagcccccgctcttctctcggccctccacccccaagacatcgcgggccgtgagccccgccgccgcccagccgccctctccgagcagcgcggagaagccgggggacgagcctgggaggcccaggagccgcgggccggcgggcaggacagagccgggggaaggcccgcagcaggaggttaggcgtcgggaccaattcccgctgacccggagcagagccatccaggagtgcaggagccctgtgccgccccccgccgccgatcccccagaggccaggacgaaagcaccccccggtcggaagcgggagcccccggcgcaggccgtgcgcttcctgccctgggccacgccgggcctggagggcgctgctgtaccccagaccttggagaagaacagggcggggcctgaggcagagaagaggcttcgcagagggccggaggaggacggtccctgggggccctgggaccgccgaggggcccgcagccagggcaaaggtcgccgggcccggcccacctcccctgagctcgagtcttcggatgactcctacgtgtccgctggagaagagcccctagaggcccctgtgtttgagatccccctgcagaatgtggtggtggcaccaggggcagatgtgctgctcaagtgtatcatcactgccaaccccccgccccaagtgtcctggcacaaggatgggtcagcgctgcgcagcgagggccgcctcctcctccgggctgagggtgagcggcacaccctgctgctcagggaggccagggcagcagatgccgggagctatatggccaccgccaccaacgagctgggccaggccacctgtgccgcctcactgaccgtgagacccggtgggtctacatcccctttcagcagccccatcacctccgacgaggaatacctgagccccccagaggagttcccagagcctggggagacctggccgcgaacccccaccatgaagcccagtcccagccagaaccgccgttcttctgacactggctccaaggcaccccccaccttcaaggtctcacttatggaccagtcagtaagagaaggccaagatgtcatcatgagcatccgcgtgcagggggagcccaagcctgtggtctcctggctgagaaaccgccagcccgtgcgcccagaccagcggcgctttgcggaggaggctgagggtgggctgtgccggctgcggatcctggctgcagagcgtggcgatgctggtttctacacttgcaaagcggtcaatgagtatggtgctcggcagtgcgaggcccgcttggaggtccgagcacaccctgaaagccggtccctggccgtgctggcccccctgcaggacgtggacgtgggggccggggagatggcgctgtttgagtgcctggtggcggggcccactgacgtggaggtggattggctgtgccgtggccgcctgctgcagcctgcactgctcaaatgcaagatgcatttcgatggccgcaaatgcaagctgctacttacatctgtacatgaggacgacagtggcgtctacacctgcaagctcagcacggccaaagatgagctgacctgcagtgcccggctgaccgtgcggccctcgttggcacccctgttcacacggctgctggaagatgtggaggtgttggagggccgagctgcccgtttcgactgcaagatcagtggcaccccgccccctgttgttacctggactcattttggctgccccatggaggagagtgagaacttgcggctgcggcaggacgggggtctgcactcactgcacattgcccatgtgggcagcgaggacgaggggctctatgcggtcagtgctgttaacacccatggccaggcccactgctcagcccagctgtatgtagaagagccccggacagccgcctcaggccccagctcgaagctggagaagatgccatccattcccgaggagccagagcagggtgagctggagcggctgtccattcctgacttcctgcggccactgcaggacctggaggtgggactggccaaggaggccatgctagagtgccaggtgaccggcctgccctaccccaccatcagctggttccacaatggccaccgcatccagagcagcgacgaccggcgcatgacacagtacagggatgtccatcgcttggtgttccctgccgtggggcctcagcacgccggtgtctacaagagcgtcattgccaacaagctgggcaaagctgcctgctatgcccacctgtatgtcacagatgtggtcccaggccctccagatggcgccccgcaggtggtggctgtgacggggaggatggtcacactcacatggaacccccccaggagtctggacatggccatcgacccggactccctgacgtacacagtgcagcaccaggtgctgggctcggaccagtggacggcactggtcacaggcctgcgggagccagggtgggcagccacagggctgcgtaagggggtccagcacatcttccgggtcctcagcaccactgtcaagagcagcagcaagccctcacccccttctgagcctgtgcagctgctggagcacggcccaaccctggaggaggcccctgccatgctggacaaaccagacatcgtgtatgtggtggagggacagcctgccagcgtcaccgtcacattcaaccatgtggaggcccaggtcgtctggaggagctgccgaggggccctcctagaggcacgggccggtgtgtacgagctgagccagccagatgatgaccagtactgtcttcggatctgccgggtgagccgccgggacatgggggccctcacctgcaccgcccgaaaccgtcacggcacacagacctgctcggtcacattggagctggcagaggcccctcggtttgagtccatcatggaggacgtggaggtgggggctggggaaactgctcgctttgcggtggtggtcgagggaaaaccactgccggacatcatgtggtacaaggacgaggtgctgctgaccgagagcagccatgtgagcttcgtgtacgaggagaatgagtgctccctggtggtgctcagcacgggggcccaggatggaggcgtctacacctgcaccgcccagaacctggcgggtgaggtctcctgcaaagcagagttggctgtgcattcagctcagacagctatggaggtcgagggggtcggggaggatgaggaccatcgaggaaggagactcagcgacttttatgacatccaccaggagatcggcaggggtgctttctcctacttgcggcgcatagtggagcgtagctccggcctggagtttgcggccaagttcatccccagccaggccaagccaaaggcatcagcgcgtcgggaggcccggctgctggccaggctccagcacgactgtgtcctctacttccatgaggccttcgagaggcgccggggactggtcattgtcaccgagctctgcacagaggagctgctggagcgaatcgccaggaaacccaccgtgtgtgagtctgagatccgggcctatatgcggcaggtgctagagggaatacactacctgcaccagagccacgtgctgcacctcgatgtcaagcctgagaacctgctggtgtgggatggtgctgcgggcgagcagcaggtgcggatctgtgactttgggaatgcccaggagctgactccaggagagccccagtactgccagtatggcacacctgagtttgtagcacccgagattgtcaatcagagccccgtgtctggagtcactgacatctggcctgtgggtgttgttgccttcctctgtctgacaggaatctccccgtttgttggggaaaatgaccggacaacattgatgaacatccgaaactacaacgtggccttcgaggagaccacattcctgagcctgagcagggaggcccggggcttcctcatcaaagtgttggtgcaggaccggctgagacctaccgcagaagagaccctagaacatccttggttcaaaactcaggcaaagggcgcagaggtgagcacggatcacctgaagctattcctctcccggcggaggtggcagcgctcccagatcagctacaaatgccacctggtgctgcgccccatccccgagctgctgcgggcccccccagagcgggtgtgggtgaccatgcccagaaggccaccccccagtggggggctctcatcctcctcggattctgaagaggaagagctggaagagctgccctcagtgccccgcccactgcagcccgagttctctggctcccgggtgtccctcacagacattcccactgaggatgaggccctggggaccccagagactggggctgccacccccatggactggcaggagcagggaagggctccctctcaggaccaggaggctcccagcccagaggccctcccctccccaggccaggagcccgcagctggggctagccccaggcggggagagctccgcaggggcagctcggctgagagcgccctgccccgggccgggccgcgggagctgggccggggcctgcacaaggcggcgtctgtggagctgccgcagcgccggagccccagcccgggagccacccgcctggcccggggaggcctgggtgagggcgagtatgcccagaggctgcaggccctgcgccagcggctgctgcggggaggccccgaggatggcaaggtcagcggcctcaggggtcccctgctggagagcctggggggccgtgctcgggacccccggatggcacgagctgcctccagcgaggcagcgccccaccaccagcccccactcgagaaccggggcctgcaaaagagcagcagcttctcccagggtgaggcggagccccggggccggcaccgccgagcgggggcgcccctcgagatccccgtggccaggcttggggcccgtaggctacaggagtctccttccctgtctgccctcagcgaggcccagccatccagccctgcacggcccagcgcccccaaacccagtacccctaagtctgcagaaccttctgccaccacacctagtgatgctccgcagccccccgcaccccagcctgcccaagacaaggctccagagcccaggccagaaccagtccgagcctccaagcctgcaccacccccccaggccctgcaaaccctagcgctgcccctcacaccctatgctcagatcattcagtccctccagctgtcaggccacgcccagggcccctcgcagggccctgccgcgccgccttcagagcccaagccccacgctgctgtctttgccagggtggcctccccacctccgggagcccccgagaagcgcgtgccctcagccgggggtcccccggtgctagccgagaaagcccgagttcccacggtgccccccaggccaggcagcagtctcagtagcagcatcgaaaacttggagtcggaggccgtgttcgaggccaagttcaagcgcagccgcgagtcgcccctgtcgctggggctgcggctgctgagccgttcgcgctcggaggagcgcggccccttccgtggggccgaggaggaggatggcatataccggcccagcccggcggggaccccgctggagctggtgcgacggcctgagcgctcacgctcggtgcaggacctcagggctgtcggagagcctggcctcgtccgccgcctctcgctgtcactgtcccagcggctgcggcggacccctcccgcgcagcgccacccggcctgggaggcccgcggcggggacggagagagctcggagggcgggagctcggcgcggggctccccggtgctggcgatgcgcaggcggctgagcttcaccctggagcggctgtccagccgattgcagcgcagtggcagcagcgaggactcggggggcgcgtcgggccgcagcacgccgctgttcggacggcttcgcagggccacgtccgagggcgagagtctgcggcgccttggccttccgcacaaccagttggccgcccaggccggcgccaccacgccttccgccgagtccctgggctccgaggccagcgccacgtcgggctcctcagccccaggggaaagccgaagccggctccgctggggcttctctcggccgcggaaggacaaggggttatcgccaccaaacctctctgccagcgtccaggaggagttgggtcaccagtacgtgcgcagtgagtcagacttccccccagtcttccacatcaaactcaaggaccaggtgctgctggagggggaggcagccaccctgctctgcctgccagcggcctgccctgcaccgcacatctcctggatgaaagacaagaagtccttgaggtcagagccctcagtgatcatcgtgtcctgcaaagatgggcggcagctgctcagcatcccccgggcgggcaagcggcacgccggtctctatgagtgctcggccaccaacgtactgggcagcatcaccagctcctgtaccgtggctgtggcccgagtcccaggaaagctagctcctccagaggtaccccagacctaccaggacacggcgctggtgctgtggaagccgggagacagccgggcaccttgcacgtatacgctggagcggcgagtggatggggagtctgtgtggcaccctgtgagctcaggcatccccgactgttactacaacgtgacccacctgccagttggcgtgactgtgaggttccgtgtggcctgtgccaaccgtgctgggcaggggcccttcagcaactcttctgagaaggtctttgtcaggggtactcaagattcttcagctgtgccatctgctgcccaccaagaggcccctgtcacctcaaggccagccagggcccggcctcctgactctcctacctcactggccccacccctagctcctgctgcccccacacccccgtcagtcactgtcagcccctcatctccccccacacctcctagccaggccttgtcctcgctcaaggctgtgggtccaccaccccaaacccctccacgaagacacaggggcctgcaggctgcccggccagcggagcccaccctacccagtacccacgtcaccccaagtgagcccaagcctttcgtccttgacactgggaccccgatcccagcctccactcctcaaggggttaaaccagtgtcttcctctactcctgtgtatgtggtgacttcctttgtgtctgcaccaccagcccctgagcccccagcccctgagccccctcctgagcctaccaaggtgactgtgcagagcctcagcccggccaaggaggtggtcagctcccctgggagcagtccccgaagctctcccaggcctgagggtaccactcttcgacagggtccccctcagaaaccctacaccttcctggaggagaaagccaggggccgctttggtgttgtgcgagcgtgccgggagaatgccacggggcgaacgttcgtggccaagatcgtgccctatgctgccgagggcaagcggcgggtcctgcaggagtacgaggtgctgcggaccctgcaccacgagcggatcatgtccctgcacgaggcctacatcacccctcggtacctcgtgctcattgctgagagctgtggcaaccgggaactcctctgtgggctcagtgacaggttccggtattctgaggatgacgtggccacttacatggtgcagctgctacaaggcctggactacctccacggccaccacgtgctccacctagacatcaagccagacaacctgctgctggcccctgacaatgccctcaagattgtggactttggcagtgcccagccctacaacccccaggcccttaggccccttggccaccgcacgggcacgctggagttcatggctccggagatggtgaagggagaacccatcggctctgccacggacatctggggagcgggtgtgctcacttacattatgctcagtggacgctccccgttctatgagccagacccccaggaaacggaggctcggattgtggggggccgctttgatgccttccagctgtaccccaatacatcccagagcgccaccctcttcttgcgaaaggttctctctgtacatccctggagccggccctccctgcaggactgcctggcccacccatggttgcaggacgcctacctgatgaagctgcgccgccagacgctcaccttcaccaccaaccggctcaaggagttcctgggcgagcagcggcggcgccgggctgaggctgccacccgccacaaggtgctgctgcgctcctaccctggcggcccctagaggcacggaccacagccaggcctcgggcttcaactggggttcccaccaatgccacgggacattccagggcccacgctgagccaggcgggcctggggcttcggttaccaccagcagcaacatctggctgggctcttacctcatagaccttcaaggacagagaccccagggcctggacctgatgccaccccaggccaaagccagagtgggagacccattggtcaggctcagcagggtgggaacaggcagagggacaagaggggaatggagaagtggagaggaaaaggaatcgagggacaggaagggggaggctctaggaaggttctgggttgggggtcagtgcatctcagggagaaccaaggaaggtgggcatggctggagaggaggaaaaggaaggagccccaggtgtcagggcagtaggctgggagtcagtgtggcaaagcgggggcaggacacagatacagtggcaggggcccagggctgggacatgagagaaggcagcgaggcggcagagggagaagagaggactcaggtggaggtggggtgggtcagctgtcagcatccctcagaggagaaatgtggagagctggaggccagcagtcactcacactcgctctgtcctcctgtccagtggatacagccctgggcgctctgctggcccaaggatgtccccactgcccctccatggcctctggccttcttcccattcatatttatttatttattgacttttatgaagtttccccttccatccgatccctactgcccatgttgtcctgaccatccctcccagccatccagctgtctgt

SEQ ID NO: 20271 - DNA, 3487 bp, Homo sapiens
  ENST00000462545
cacacatttgacaattcacctcgtgttgctctgtgacaccgctgttattgcttaagtcttgggttgcttttagcttgttctttgtctgtttgaaagcttgtgcccctccaggtgccttgcatggggcctggtacgccatacatgatggctgacgtgttaaagacatacacagtgcagtcctgtctttctccagaagccaacgctctaattgtggatgaagttgaggaacggccacactaacatggagtcaaggctgccctgacctgtttcgagaatgctccttctgacttccttttttccctaaggacattcaggaggcagaccctcttctccccaagtccctgctttctagaagcccctctgtctgggtttggctttctaggatgcaggccaccaggactctctctcccgctgtcatccctgcagggatcatggccccttaccccgttattcctgtgtccggcagagtcttcggatgactcctacgtgtccgctggagaagagcccctagaggcccctgtgtttgagatccccctgcagaatgtggtggtggcaccaggggcagatgtgctgctcaagtgtatcatcactgccaaccccccgccccaagtgtcctggcacaaggatgggtcagcgctgcgcagcgagggccgcctcctcctccgggctgagggtgagcggcacaccctgctgctcagggaggccagggcagcagatgccgggagctatatggccaccgccaccaacgagctgggccaggccacctgtgccgcctcactgaccgtgagacccggtgggtctacatcccctttcagcagccccatcacctccgacgaggaatacctgagccccccagaggagttcccagagcctggggagacctggccgcgaacccccaccatgaagcccagtcccagccagaaccgccgttcttctgacactggctccaaggcaccccccaccttcaaggtctcacttatggaccagtcagtaagagaaggccaagatgtcatcatgagcatccgcgtgcagggggagcccaagcctgtggtctcctggctgagaaaccgccagcccgtgcgcccagaccagcggcgctttgcggaggaggctgagggtgggctgtgccggctgcggatcctggctgcagagcgtggcgatgctggtttctacacttgcaaagcggtcaatgagtatggtgctcggcagtgcgaggcccgcttggaggtccgaggtgagtacctgatttctccatgaatgcccacctggccctggccccttccttcccccactgtctgctctcacacagcctcagttagaggatgccaccactgaaagggccttaaggggcccctagtccagctgcttatattattgttgagtgaaccaaagcccagagacaggaagtgacctgcccaaagctgcacagcacattgttccgtgctcagcttactacacaacaccaccttccctgttgctccatcacggagccctggcggcagccagagaccctgcacctgccactggccaagctctctctacactcttctgagcctttgtcaccctgctctgcccaggaccctccctcatccccctccccctctcctctcgcccctttgcccaccctcccatcccattgctgtgcagaagctactgtgaggtagcggtggggagagtctggtggctggacccgttcggaggggcccttggggtggcttaggcttggagcatcacagggaccctagggtgccagggtgagcacagctgtgacgtgtgaagaggcctgggcccccagagcctggggcatatgtgcaggggccctctcaggcagcagaaatgccaggccctggctagggggccctcgagggccatgggttttcctccccaaaggccacaaccgtttatcttgccttccacctcacccttcgcctcaatggctcctcgcttcctctcctcgcttctcactcagcccccagcccctgaccttccccaaggctcagagctcagaccctgacagtcatggtccctctgctggcccccctgcctcagttcccctcctctgtgcctgccgttcctgtagttgccacttccttggtctccagattcttcagccctcctccccggcctgctttctctccagggcctggctctgcctcgcttctctgtattaacccatgtcttggtgcttctttctcttggggattccttccgacacccccaggctttggggtgctcctgatcccatgaatgcctggttgcccggggtctctgcctgcccaggaaccccgaggaaccagtctctggctagctgccggccctcgcagcccagagctgtccttgggggagccaagagtggcagtgctgccctgacggtgtgagaggcagccctctatgcagaagggccctagccaggtctgcgtgcctgtgcgtgcatgtgtgcgtgtgcgtgcgcatgcgtgcgtgtatgtgcatgcatgtgtgtgcatgtgtgtgcgtgtgtgcgtgcgtgtgcatgtgtgcgtatgggtgtgtgcatgcgtgtgtgtgtgcgcgcgtgtgcgtgcacgtgtgcgtgcatgtgtgcgtgtgcatgcgtgtgtgtgcatgtgtgtgtgtgcgcgtgcgtgcgcgtatgctgcactaacctgccgcttgctgactgaggtttttgtctgtacacaggcgagtgagctcagggggccacctgtgctccccccgctaccctccgagccgcgcccctgtctcaggcacctctcggacctcgctgtgtttcactgcctcctgcccacagacccaggcctgccggcccggacccgtcccagcctcccctccccaccccatgcagcccccagggggatagcccatgggcccctgtggaccctccctccccaagtggacacatggctgtgcaggccaggaggcccacagatggactgagtgctgggaaggggcggctgcgaggggtatcaaccccccgagtctctccctgaaggggagcaccgggcgagtgcatgtgctactgctgctacaggcctgtctatctgtttgtctgtctgtgtgtctgtgacagtcagggaaggatgcctcggagctgaggtggggtgagacagagtgggagagattacggcatggcatggaggggcccaaggagcaggggctgttgacaaaggccttaccaggaagggttaggacactgaccattctagaaatgggtttcgaatggcacaacactttctatttcacaaaagaccaaaagccagaggccccaggctctgtgctgatgaacagcctggctgagccctggccctggcaggtttagggcccatttggggccccctccttctctgtcagggctggggtgctctgtctgggaatgagggagttaaccaagtttggtgcaggagcaggggcagggggccactgtagtgagcgtggagaaatttggaaacacctatttcttaactcaaataaagtccagtttgtacct

SEQ ID NO: 20272 - DNA, 567 bp, Homo sapiens
  ENST00000463218
tatatggccaccgccaccaacgagctgggccaggccacctgtgccgcctcactgaccgtgagacccggtgggtctacatcccctttcagcagccccatcacctccgacgaggaatacctgagccccccagaggagttcccagagcctggggagacctggccgcgaacccccaccatgaagcccagtcccagccagaaccgccgttcttctgacactggctccaaggcaccccccaccttcaaggtctcacttatggaccagtcagtaagagaaggccaagatgtcatcatgagcatccgcgtgcagggggagcccaagcctgtggtctcctggctgagaaaccgccagcccgtgcgcccagaccagcggcgctttgcggaggaggctgagggtgggctgtgccggctgcggatcctggctgcagagcgtggcgatgctggtttctacacttgcaaagcggtcaatgagtatggtgctcggcagtgcgaggcccgcttggaggtccgaggtgagtacctgatttctccatgaatgcccacctggccctggccccttccttcccccact

SEQ ID NO: 20273 - DNA, 1457 bp, Homo sapiens
  ENST00000396688
caacctcctccttcccctcctcaggcgccttcccctcccccagggccttctccgtgcagggcctcagctgggtcagccgagtgagtggggctgggcaggctggacaggctgggctcctgctccctggggagccacgctggggtgggcagtgggcaggcagcaggagggcctggtgccagggcagagccttcaggacaggcacaggctggggtctgtgtgcagagcctcggggtgggtctacatcccctttcagcagccccatcacctccgacgaggaatacctgagccccccagaggagttcccagagcctggggagacctggccgcgaacccccaccatgaagcccagtcccagccagaaccgccgttcttctgacactggctccaaggcaccccccaccttcaaggtctcacttatggaccagtcagtaagagaaggccaagatgtcatcatgagcatccgcgtgcagggggagcccaagcctgtggtctcctggctgagaaaccgccagcccgtgcgcccagaccagcggcgctttgcggaggaggctgagggtgggctgtgccggctgcggatcctggctgcagagcgtggcgatgctggtttctacacttgcaaagcggtcaatgagtatggtgctcggcagtgcgaggcccgcttggaggtccgaggcgagtgagctcagggggccacctgtgctccccccgctaccctccgagccgcgcccctgtctcaggcacctctcggacctcgctgtgtttcactgcctcctgcccacagacccaggcctgccggcccggacccgtcccagcctcccctccccaccccatgcagcccccagggggatagcccatgggcccctgtggaccctccctccccaagtggacacatggctgtgcaggccaggaggcccacagatggactgagtgctgggaaggggcggctgcgaggggtatcaaccccccgagtctctccctgaaggggagcaccgggcgagtgcatgtgctactgctgctacaggcctgtctatctgtttgtctgtctgtgtgtctgtgacagtcagggaaggatgcctcggagctgaggtggggtgagacagagtgggagagattacggcatggcatggaggggcccaaggagcaggggctgttgacaaaggccttaccaggaagggttaggacactgaccattctagaaatgggtttcgaatggcacaacactttctatttcacaaaagaccaaaagccagaggccccaggctctgtgctgatgaacagcctggctgagccctggccctggcaggtttagggcccatttggggccccctccttctctgtcagggctggggtgctctgtctgggaatgagggagttaaccaagtttggtgcaggagcaggggcagggggccactgtagtgagcgtggagaaatttggaaacacctatttcttaactcaa

SEQ ID NO: 20274 - DNA, 566 bp, Homo sapiens
  ENST00000496786
tttttggtggatgactccagctctgctttcctatccctcgagcgtttgggggtgcaagctgtagggctgtggccaacaggtgggtctacatcccctttcagcagccccatcacctccgacgaggaatacctgagccccccagaggagttcccagagcctggggagacctggccgcgaacccccaccatgaagcccagtcccagccagaaccgccgttcttctgacactggctccaaggcaccccccaccttcaaggtctcacttatggaccagtcagtaagagaaggccaagatgtcatcatgagcatccgcgtgcagggggagcccaagcctgtggtctcctggctgagaaaccgccagcccgtgcgcccagaccagcggcgctttgcggaggaggctgagggtgggctgtgccggctgcggatcctggctgcagagcgtggcgatgctggtttctacacttgcaaagcggtcaatgagtatggtgctcggcagtgcgaggcccgcttggaggtccgaggtgagtacctgatttctccatgaatgcccacctggccctggcccct

SEQ ID NO: 20275 - DNA, 1888 bp, Homo sapiens
  ENST00000475921
agctctgctttcctatccctcgagcgtttgggggtgcaagctgtagggctgtggccaacaggtgcccctggggtttgcacggcaggaagctgagaagggaaagggggaggggcaggctagatagtgccgcctcattggccctggaccgaggtcgggatgtgacttgtctgcggtgtgtgttcctctgcaccaggcccagctcacccaagaaatgggcgtcctagccatgctgctccagggttccatagacctgcttcccctgcttttggagcctgcagttggtagtttaggtctctagtccatgtcaggaatgtgggtgccctgctccagtggaattctcccaccaggcccaggagtggcccctctgctgcccgaaccctttgccccaggcctttccctatggtgtcccctcctgggaggatcagcagggtcggtgttggcagagccagtggcagaggaggttccaggggctcagggaggggaagaagctgggcgaggtcgcaggagcctgggggtgaagtcagggcagggccggcctgcggggagctgccgcaactcctgggctctgggcgacattccagccagctctcccaggctctctgctcgccttcctccctggtagctatctctgtctctctccaggtgggtctacatcccctttcagcagccccatcacctccgacgaggaatacctgagccccccagaggagttcccagagcctggggagacctggccgcgaacccccaccatgaagcccagtcccagccagaaccgccgttcttctgacactggctccaaggcaccccccaccttcaaggtctcacttatggaccagtcagtaagagaaggccaagatgtcatcatgagcatccgcgtgcagggggagcccaagcctgtggtctcctggctgagaaaccgccagcccgtgcgcccagaccagcggcgctttgcggaggaggctgagggtgggctgtgccggctgcggatcctggctgcagagcgtggcgatgctggtttctacacttgcaaagcggtcaatgagtatggtgctcggcagtgcgaggcccgcttggaggtccgaggcgagtgagctcagggggccacctgtgctccccccgctaccctccgagccgcgcccctgtctcaggcacctctcggacctcgctgtgtttcactgcctcctgcccacagacccaggcctgccggcccggacccgtcccagcctcccctccccaccccatgcagcccccagggggatagcccatgggcccctgtggaccctccctccccaagtggacacatggctgtgcaggccaggaggcccacagatggactgagtgctgggaaggggcggctgcgaggggtatcaaccccccgagtctctccctgaaggggagcaccgggcgagtgcatgtgctactgctgctacaggcctgtctatctgtttgtctgtctgtgtgtctgtgacagtcagggaaggatgcctcggagctgaggtggggtgagacagagtgggagagattacggcatggcatggaggggcccaaggagcaggggctgttgacaaaggccttaccaggaagggttaggacactgaccattctagaaatgggtttcgaatggcacaacactttctatttcacaaaagaccaaaagccagaggccccaggctctgtgctgatgaacagcctggctgagccctggccctggcaggtttagggcccatttggggccccctccttctctgtcagggctggggtgctctgtctgggaatgagggagttaaccaagtttggtgcaggagcaggggcagggggccactgtagtgagcgtggagaaatttggaaacacctatttcttaactcaaataaagtccagtttgtacct

SEQ ID NO: 20276 - DNA, 1086 bp, Homo sapiens
  ENST00000396686
tccctcgagcgtttgggggtgcaagctgtagggctgtggccaacaggtgggtctacatcccctttcagcagccccatcacctccgacgaggaatacctgagccccccagaggagttcccagagcctggggagacctggccgcgaacccccaccatgaagcccagtcccagccagaaccgccgttcttctgacactggctccaaggcaccccccaccttcaaggtctcacttatggaccagtcagtaagagaaggccaagatgtcatcatgagcatccgcgtgcagggggagcccaagcctgtggtctcctggctgagaaaccgccagcccgtgcgcccagaccagcggcgctttgcggaggaggctgagggtgggctgtgccggctgcggatcctggctgcagagcgtggcgatgctggtttctacacttgcaaagcggtcaatgagtatggtgctcggcagtgcgaggcccgcttggaggtccgaggcgagtgagctcagggggccacctgtgctccccccgctaccctccgagccgcgcccctgtctcaggcacctctcggacctcgctgtgtttcactgcctcctgcccacagacccaggcctgccggcccggacccgtcccagcctcccctccccaccccatgcagcccccagggggatagcccatgggcccctgtggaccctccctccccaagtggacacatggctgtgcaggccaggaggcccacagatggactgagtgctgggaaggggcggctgcgaggggtatcaaccccccgagtctctccctgaaggggagcaccgggcgagtgcatgtgctactgctgctacaggcctgtctatctgtttgtctgtctgtgtgtctgtgacagtcagggaaggatgcctcggagctgaggtggggtgagacagagtgggagagattacggcatggcatggaggggcccaaggagcaggggctgttgacaaaggccttaccaggaagggttaggacactgaccattctagaaatgggtttcgaatggcacaacactttctatttcacaaaagaccaaaagccagaggccccaggctctgtgctga

SEQ ID NO: 20277 - DNA, 1274 bp, Homo sapiens
  ENST00000396689
ccgaggtcgggatgtgacttgtctgcggtgggtctacatcccctttcagcagccccatcacctccgacgaggaatacctgagccccccagaggagttcccagagcctggggagacctggccgcgaacccccaccatgaagcccagtcccagccagaaccgccgttcttctgacactggctccaaggcaccccccaccttcaaggtctcacttatggaccagtcagtaagagaaggccaagatgtcatcatgagcatccgcgtgcagggggagcccaagcctgtggtctcctggctgagaaaccgccagcccgtgcgcccagaccagcggcgctttgcggaggaggctgagggtgggctgtgccggctgcggatcctggctgcagagcgtggcgatgctggtttctacacttgcaaagcggtcaatgagtatggtgctcggcagtgcgaggcccgcttggaggtccgaggcgagtgagctcagggggccacctgtgctccccccgctaccctccgagccgcgcccctgtctcaggcacctctcggacctcgctgtgtttcactgcctcctgcccacagacccaggcctgccggcccggacccgtcccagcctcccctccccaccccatgcagcccccagggggatagcccatgggcccctgtggaccctccctccccaagtggacacatggctgtgcaggccaggaggcccacagatggactgagtgctgggaaggggcggctgcgaggggtatcaaccccccgagtctctccctgaaggggagcaccgggcgagtgcatgtgctactgctgctacaggcctgtctatctgtttgtctgtctgtgtgtctgtgacagtcagggaaggatgcctcggagctgaggtggggtgagacagagtgggagagattacggcatggcatggaggggcccaaggagcaggggctgttgacaaaggccttaccaggaagggttaggacactgaccattctagaaatgggtttcgaatggcacaacactttctatttcacaaaagaccaaaagccagaggccccaggctctgtgctgatgaacagcctggctgagccctggccctggcaggtttagggcccatttggggccccctccttctctgtcagggctggggtgctctgtctgggaatgagggagttaaccaagtttggtgcaggagcaggggcagggggccactgtagtgagcgtggagaaatttggaaacacctatttcttaactcaaataaagtccagtttgtaccta

SEQ ID NO: 20278 - DNA, 2159 bp, Homo sapiens
  ENST00000485069
cttggaagccagcccgggcccagacccagactttgctgcaccatggatgcacttcttgctgcctgccccatccttgccccatccttgcccactcgcctcctccctgcagtggatgggggtgagggaccaggcccgggatggcatgggcctacccctcaaggtatcctccgggctcaggcccagtgtcactgtccctcccctcccagacagggatgtccatcgcttggtgttccctgccgtggggcctcagcacgccggtgtctacaagagcgtcattgccaacaagctgggcaaagctgcctgctatgcccacctgtatgtcacaggtgaggcaggcaccctcgtggtcagctgcacgcacagcctggcctctggcactacgtgggggctcagggaaaggggcctccacccagctcccttcccctccatcccctggggaccctcttgccttgcccctgcccctgcggctgagcccccaggccctagcctcctgccctgaggctcggtgatcctgtggggctgttgggcccttggacccagcagacattcgaactgcggctttcagatgtggtcccaggccctccagatggcgccccgcaggtggtggctgtgacggggaggatggtcacactcacatggaacccccccaggagtctggacatggccatcgacccggactccctgacgtacacagtgcagcaccaggtgctgggctcggaccagtggacggcactggtcacaggcctgcgggagccagggtgggcagccacagggctgcgtaagggggtccagcacatcttccgggtcctcagcaccactgtcaagagcagcagcaagccctcacccccttctgagcctgtgcagctgctggagcacggtgagcctgggtgctcctgtcgggtgggggtgggagctgctgggatggggaatgggggccctgtggtggaggctcaagggatggcctggacatggtaactggcaggagcagcctagccgggcgggaccttggcccatctgtacacttccttctccctcctgaaagcagcagggcacggtggctgaagctcaggctttgggatcgggcctgctggggtccaaccccacaacctcagctttgctgctctctggctgtgttcccctgacaaatcgctaaacctctctgagcttcagctttcccatctgtaaaaacggaactcaagtgttgatgaggggtgttagaggagtggtgggtgctgaggacctgatgtcaagcccagcacagagcctgcgctctcctcctcccaggcccaaccctggaggaggcccctgccatgctggacaaaccagacatcgtgtatgtggtggagggacagcctgccagcgtcaccgtcacattcaaccatgtggaggcccaggtcgtctggaggaggtgggcccctttcccacatgtggcagcccaggtctggcccagcctggccggaatgccctggggcaagatctgggtgacctccctgtcatgtgtcccctagctgccgaggggccctcctagaggcacgggccggtgtgtacgagctgagccagccagatgatgaccagtactgtcttcggatctgccgggtgagccgccgggacatgggggccctcacctgcaccgcccgaaaccgtcacggcacacagacctgctcggtcacattggagctggcaggtgggtgacagcgggccttcttcctagcctccctccaaggcccaaagctctctactcacacccccaggtacacaacctgcctgacactgctgcagatccaaacccatgtcctctggtcaggcctgtccatgtcatggctatacaaataccatattagtaataatgacaacaatcatactaacaagatttattggccagacgcggtggctcacacctgtaatctcagcactttgggaggccgacacaggtggattacctgaggtcaggagttcgtgaccagcctcgccaacatggtgaaaccccatctctactaaaaatacaaaaattagctgggtgtggcggcaggtgcctgtagtcccagctacttgggaggctgaggcaggagaatcacttgaacctgggaggcagaggttgcagtgagccgagattgctccattgcacgctagcctgggcaacaagagcaaaactctgtctc

SEQ ID NO: 20279 - DNA, 1085 bp, Homo sapiens
  ENST00000412982
tatgctcagtggacgctccccgttctatgagccagacccccaggaaacggaggctcggattgtggggggccgctttgatgccttccagctgtaccccaatacatcccagagcgccaccctcttcttgcgaaaggttctctctgtacatccctggagccggccctccctgcaggactgcctggcccacccatggttgcaggacgcctacctgatgaagctgcgccgccagacgctcaccttcaccaccaaccggctcaaggagttcctgggcgagcagcggcggcgccgggctgaggctgccacccgccacaagatgtctaaagcagctcctgccaaaaagccagtggctgtggccccagctcctggatgtaccctggacatcaatgacccacaggtccagagtgcggccattcgtatccaggcctcttaccggggccacaggtcccggaaggagctgcgcgagaaggggccgccgcgggtgctggagccgctgaaggacgtggtgctgatcgaaggcagcgcggccaagctcacttgccgcatttcggctttcccggacccattcatccgctggagtaaggacggcaaggagctacgtgacggtcccaagtaccgctacgtcttcgaggaccctgacgtggtggcactggtggtgcgcgacggcgagctggcagacctgggccagtacagcatcaacgtcaccaaccccttcggccagtgctccgactcggcgcgcatcctcgtggaagtcccgacgaagattcaaaagggacccgacaacactaaggcgcgcaaaggcaccaccgtgacgctgactgcggagatcctgggagagcctgcgcccgacgtaggctggaccaaggacggggaggacatcgaggaggatgacagggtgttcttcgagatcggcagcaccaccacgacgctgaccattcgccgggccacgcctcaggacagcggcaagtacgaggtgtacgtggagaacagcctgggcatggaccagagcttcgctcgcgtcgacgtggcctgaacggcacccccggaccttccgccctggcgccgagcccgggggtggtgggacccac

SEQ ID NO: 20280 - DNA, 408 bp, Homo sapiens
  ENST00000475104
ggggtttcgctcccctttccttccgctagtcccgacgaagattcaaaagggacccgacaacactaaggcgcgcaaaggcaccaccgtgacgctgactgcggagatcctgggagagcctgcgcccgacgtaggctggaccaaggacggggaggacatcgaggaggatgacagggtgttcttcgagatcggcagcaccaccacgacgctgaccattcgccgggccacgcctcaggacagcggcaagtacgaggtgtacgtggagaacagcctgggcatggaccagagcttcgctcgcgtcgacgtggcctgaacggcacccccggaccttccgccctggcgccgagcccgggggtggtgggacccacagccctccaccagcttgcttaataaagctgctctctgaccctc

SEQ ID NO: 20281 - DNA, 815 bp, Homo sapiens
  ENST00000617028
atgtctaaagcagctcctgccaaaaagccagtggctgtggccccagctcctggatgtaccctggacatcaatgacccacaggtccagagtgcggccattcgtatccaggcctcttaccggggccacaggtcccggaaggagctgcgcgagaaggggccgccgcgggtgctggagccgctgaaggacgtggtgctgatcgaaggcagcgcggccaagctcacttgccgcatttcggctttcccggacccattcatccgctggagtaaggacggcaaggagctacgtgacggtcccaagtaccgctacgtcttcgaggaccctgacgtggtggcactggtggtgcgcgacggcgagctggcagacctgggccagtacagcatcaacgtcaccaaccccttcggccagtgctccgactcggcgcgcatcctcgtggaagtcccgacgaagattcaaaagggacccgacaacactaaggcgcgcaaaggcaccaccgtgacgctgactgcggagatcctgggagagcctgcgcccgacgtaggctggaccaaggacggggaggacatcgaggaggatgacagggtgttcttcgagatcggcagcaccaccacgacgctgaccattcgccgggccacgcctcaggacagcggcaagtacgaggtgtacgtggagaacagcctgggcatggaccagagcttcgctcgcgtcgacgtggcctgaacggcacccccggaccttccgccctggcgccgagcccgggggtggtgggacccacagccctccaccagcttgcttaataaagctgctctctgaccctc

SEQ ID NO: 20282 - DNA, 2963 bp, Homo sapiens
  ENST00000245222
cgactgactagccgggcgataacggcagagagcatagagcgcaggaacaagcgcaacgtccaagagggaagggccagcacgtcgggggcctctctggccctacccaggccgtgttctcgatagctttccggaagaaagggatctgggagcgagatgcgtgtagctagcacgatgcgtcgcgcggtgacgctctggcccgacgccgacggcctctcagtggctcccggaggacccggcgggcccagtgttggagagctgaaggtcaggccaggacagtgagacctgactccttgctcctaccagcctactatggcttaagacccagggccagggtcccgttgatgtaacagagcagaggaccagcagatgaatggacaccttgaagcagaggagcagcaggaccagaggccagaccaggagctgaccgggagctggggccacgggcctaggagcaccctggtcagggctaaggccatggccccgcccccaccgccactggctgccagcaccccgctcctccatggcgagtttggctcctacccagcccgaggcccacgctttgccctcacccttacatcgcaggccctgcacatacagcggctgcgccccaaacctgaagccaggccccggggtggcctggtcccgttggccgaggtctcaggctgctgcaccctgcgaagccgcagcccctcagactcagcggcctacttctgcatctacacctaccctcggggccggcgcggggcccggcgcagagccactcgcaccttccgggcagatggggccgccacctacgaagagaaccgtgccgaggcccagcgctgggccactgccctcacctgtctgctccgaggactgccactgcccggggatggggagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacgggggatttgagccagccctgggcctcgacctgttgctcaactgctcactgttgctgtgccggggtggtggccacccactggacctgctctccgtgacgctggcctcgggctcccgctgtttctccttcctgtctgtggcctggggcttcgtgtcagatgtggatatccagagcgagcgcttcagggccttgggcagtgcccgcttcacactgggcacggtgctgggcctcgccacactgcacacctaccgcggacgcctctcctacctccccgccactgtggaacctgcctcgcccacccctgcccatagcctgcctcgtgccaagtcggagctgaccctaaccccagacccagccccgcccatggcccactcacccctgcatcgttctgtgtctgacctgcctcttcccctgccccagcctgccctggcctctcctggctcgccagaacccctgcccatcctgtccctcaacggtgggggcccagagctggctggggactggggtggggctggggatgctccgctgtccccggacccactgctgtcttcacctcctggctctcccaaggcagctctacactcacccgtctccgaaggggcccccgtaattcccccatcctctgggctcccacttcccacccctgatgcccgggtaggggcctccacctgcggcccgcccgaccacctgctgcctccgctgggcaccccgctgcccccagactgggtgacgctggagggggactttgtgctcatgttggccatctcgcccagccacctaggcgctgacctggtggcagctccgcatgcgcgcttcgacgacggcctggtgcacctgtgctgggtgcgtagcggcatctcgcgggctgcgctgctgcgccttttcttggccatggagcgtggtagccacttcagcctgggctgtccgcagctgggctacgccgcggcccgtgccttccgcctagagccgctcacaccacgcggcgtgctcacagtggacggggagcaggtggagtatgggccgctacaggcacagatgcaccctggcatcggtacactgctcactgggcctcctggctgcccggggcgggagccctgaaactaaacaagcttggtacccgccgggggcggggcctacattccaatggggcggagcctgagctagggggtgtggcctggctgctagagttgtggtggcaggggccctggccccgtctcaggattgcgctcgctttcatgggaccagacgtgatgctggaaggtgggcgtcgtcacggttaaagagaaatgggctcgtcccgagggtagtgcctgatcaatgagggcggggcctggcgtctgatctggggccgcccttacggggcagggctcagtcctgacgcttgccacctgctcctacccggccaggatggctgagggcggagtctattttacgcgtcgcccaatgacaggacctggaatgtactggctggggtaggcctcagtgagtcggccggtcagggcccgcagcctcgccccatccactccggtgcctccatttagctggccaatcagcccaggaggggcaggttccccggggccggcgctaggatttgcactaatgttcctctccccgcgggtgggggcggggaaattcatatcccctgttcgtctcatgcgcgtcctccgtccccaatctaaaaagcaattgaaaaggtctatgcaataaaggcagtcgcttcattcctctca

SEQ ID NO: 20283 - DNA, 1394 bp, Homo sapiens
  ENST00000601712
gtagctagcacgatgcgtcgcgcggtgacgctctggcccgacgccgacggcctctcagtggctcccggaggacccggcgggcccagtgttggagagctgaaggtcaggccaggacagtgagacctgactccttgctcctaccagcctactatggcttaagacccagggccagggtcccgttgatgtaacagagcagaggaccagcagatgaatggacaccttgaagcagaggagcagcaggaccagggctaaggccatggccccgcccccaccgccactggctgccagcaccccgctcctccatggcgagtttggctcctacccagcccgaggcccacgctttgccctcacccttacatcgcaggccctgcacatacagcggctgcgccccaaacctgaagccaggccccggggtggcctggtcccgttggccgaggtctcaggctgctgcaccctgcgaagccgcagcccctcagactcagcggcctacttctgcatctacacctaccctcggggccggcgcggggcccggcgcagagccactcgcaccttccgggcagatggggccgccacctacgaagagaaccgtgccgaggcccagcgctgggccactgccctcacctgtctgctccgaggactgccactgcccggggatggggagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacggggggtaggttgaggataccacgaagggagggatgagcccctcctggggtgatagggacccctatatctcccactcagccaaacccacagtcagtcaagtaaatcagcctgcctgtgggatgctcacccccagctcctggacatttttgcctgcctgcttcccagctgtatcccgagcgcccagaactctgcctggcatgggaggcactcagtgaattgtagggagcaaatgaaagatgaccaggaacctggccccgtaaggagtcgcctggaggtggccccacggctgtggtgggcctgggccatggccttcgtggtctcattgccagctgctttcctacctgtctctttccccaacccctgtttgctccttccttc

SEQ ID NO: 20284 - DNA, 2136 bp, Homo sapiens
  ENST00000600537
agctagcacgatgcgtcgcgcggtgacgctctggcccgacgccgacggcctctcagtggctcccggaggacccggcgggcccagtgttggagagctgaaggtcaggccaggacagtgagacctgactccttgctcctaccagcctactatggcttaagacccagggccagggtcccgttgatgtaacagagcagaggaccagcagatgaatggacaccttgaagcagaggagcagcaggaccaggccctgcacatacagcggctgcgccccaaacctgaagccaggccccggggtggcctggtcccgttggccgaggtctcaggctgctgcaccctgcgaagccgcagcccctcagactcagcggcctacttctgcatctacacctaccctcggggccggcgcggggcccggcgcagagccactcgcaccttccgggcagatggggccgccacctacgaagagaaccgtgccgaggcccagcgctgggccactgccctcacctgtctgctccgaggactgccactgcccggggatggggagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacgggggatttgagccagccctgggcctcgacctgttgctcaactgctcactgttgctgtgccggggtggtggccacccactggacctgctctccgtgacgctggcctcgggctcccgctgtttctccttcctgtctgtggcctggggcttcgtgtcagatgtggatatccagagcgagcgcttcagggccttgggcagtgcccgcttcacactgggcacggtgctgggcctcgccacactgcacacctaccgcggacgcctctcctacctccccgccactgtggaacctgcctcgcccacccctgcccatagcctgcctcgtgccaagtcggagctgaccctaaccccagacccagccccgcccatggcccactcacccctgcatcgttctgtgtctgacctgcctcttcccctgccccagcctgccctggcctctcctggctcgccagaacccctgcccatcctgtccctcaacggtgggggcccagagctggctggggactggggtggggctggggatgctccgctgtccccggacccactgctgtcttcacctcctggctctcccaaggcagctctacactcacccgtctccgaaggggcccccgtaattcccccatcctctgggctcccacttcccacccctgatgcccgggtaggggcctccacctgcggcccgcccgaccacctgctgcctccgctgggcaccccgctgcccccagactgggtgacgctggagggggactttgtgctcatgttggccatctcgcccagccacctaggcgctgacctggtggcagctccgcatgcgcgcttcgacgacggcctggtgcacctgtgctgggtgcgtagcggcatctcgcgggctgcgctgctgcgccttttcttggccatggagcgtggtagccacttcagcctgggctgtccgcagctgggctacgccgcggcccgtgccttccgcctagagccgctcacaccacgcggcgtgctcacagtggacggggagcaggtggagtatgggccgctacaggcacagatgcaccctggcatcggtacactgctcactgggcctcctggctgcccggggcgggagccctgaaactaaacaagcttggtacccgccgggggcggggcctacattccaatggggcggagcctgagctagggggtgtggcctggctgctagagttgtggtggcaggggccctggccccgtctcaggattgcgctcgctttcatggga

SEQ ID NO: 20285 - DNA, 2866 bp, Homo sapiens
  ENST00000598088
agtgttggaggtgaggaggcggggctggcagggctagtcggggcatctggaaatttccgaccccacgcttcgggcgtttccttatcaggttcaccgctccctgatctcgcgctgcacttcgtaggcgcagccgctgcttgggaagtcctacttaagagctgaaggtcaggccaggacagtgagacctgactccttgctcctaccagcctactatggcttaagacccagggccagggtcccgttgatgtaacagagcagaggaccagcagatgaatggacaccttgaagcagaggagcagcaggaccagaggccagaccaggagctgaccgggagctggggccacgggcctaggagcaccctggtcagggctaaggccatggccccgcccccaccgccactggctgccagcaccccgctcctccatggcgagtttggctcctacccagcccgaggcccacgctttgccctcacccttacatcgcaggccctgcacatacagcggctgcgccccaaacctgaagccaggccccggggtggcctggtcccgttggccgaggtctcaggctgctgcaccctgcgaagccgcagcccctcagactcagcggcctacttctgcatctacacctaccctcggggccggcgcggggcccggcgcagagccactcgcaccttccgggcagatggggccgccacctacgaagagaaccgtgccgaggcccagcgctgggccactgccctcacctgtctgctccgaggactgccactgcccggggatggggagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacgggggatttgagccagccctgggcctcgacctgttgctcaactgctcactgttgctgtgccggggtggtggccacccactggacctgctctccgtgacgctggcctcgggctcccgctgtttctccttcctgtctgtggcctggggcttcgtgtcagatgtggatatccagagcgagcgcttcagggccttgggcagtgcccgcttcacactgggcacggtgctgggcctcgccacactgcacacctaccgcggacgcctctcctacctccccgccactgtggaacctgcctcgcccacccctgcccatagcctgcctcgtgccaagtcggagctgaccctaaccccagacccagccccgcccatggcccactcacccctgcatcgttctgtgtctgacctgcctcttcccctgccccagcctgccctggcctctcctggctcgccagaacccctgcccatcctgtccctcaacggtgggggcccagagctggctggggactggggtggggctggggatgctccgctgtccccggacccactgctgtcttcacctcctggctctcccaaggcagctctacactcacccgtctccgaaggggcccccgtaattcccccatcctctgggctcccacttcccacccctgatgcccgggtaggggcctccacctgcggcccgcccgaccacctgctgcctccgctgggcaccccgctgcccccagactgggtgacgctggagggggactttgtgctcatgttggccatctcgcccagccacctaggcgctgacctggtggcagctccgcatgcgcgcttcgacgacggcctggtgcacctgtgctgggtgcgtagcggcatctcgcgggctgcgctgctgcgccttttcttggccatggagcgtggtagccacttcagcctgggctgtccgcagctgggctacgccgcggcccgtgccttccgcctagagccgctcacaccacgcggcgtgctcacagtggacggggagcaggtggagtatgggccgctacaggcacagatgcaccctggcatcggtacactgctcactgggcctcctggctgcccggggcgggagccctgaaactaaacaagcttggtacccgccgggggcggggcctacattccaatggggcggagcctgagctagggggtgtggcctggctgctagagttgtggtggcaggggccctggccccgtctcaggattgcgctcgctttcatgggaccagacgtgatgctggaaggtgggcgtcgtcacggttaaagagaaatgggctcgtcccgagggtagtgcctgatcaatgagggcggggcctggcgtctgatctggggccgcccttacggggcagggctcagtcctgacgcttgccacctgctcctacccggccaggatggctgagggcggagtctattttacgcgtcgcccaatgacaggacctggaatgtactggctggggtaggcctcagtgagtcggccggtcagggcccgcagcctcgccccatccactccggtgcctccatttagctggccaatcagcccaggaggggcaggttccccggggccggcgctaggatttgcactaatgttcctctccccgcgggtgggggcggggaaattcatatcccctgttcgtctcatgcgcgtcctccgtccccaatctaaaaagcaattgaaaaggtctatgcaataaaggcagtcgcttcattcctctca

SEQ ID NO: 20286 - DNA, 1493 bp, Homo sapiens
  ENST00000426514
atgaatggacaccttgaagcagaggagcagcaggaccagagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacgggggatttgagccagccctgggcctcgacctgttgctcaactgctcactgttgctgtgccggggtggtggccacccactggacctgctctccgtgacgctggcctcgggctcccgctgtttctccttcctgtctgtggcctggggcttcgtgtcagatgtggatatccagagcgagcgcttcagggccttgggcagtgcccgcttcacactgggcacggtgctgggcctcgccacactgcacacctaccgcggacgcctctcctacctccccgccactgtggaacctgcctcgcccacccctgcccatagcctgcctcgtgccaagtcggagctgaccctaaccccagacccagccccgcccatggcccactcacccctgcatcgttctgtgtctgacctgcctcttcccctgccccagcctgccctggcctctcctggctcgccagaacccctgcccatcctgtccctcaacggtgggggcccagagctggctggggactggggtggggctggggatgctccgctgtccccggacccactgctgtcttcacctcctggctctcccaaggcagctctacactcacccgtctccgaaggggcccccgtaattcccccatcctctgggctcccacttcccacccctgatgcccgggtaggggcctccacctgcggcccgcccgaccacctgctgcctccgctgggcaccccgctgcccccagactgggtgacgctggagggggactttgtgctcatgttggccatctcgcccagccacctaggcgctgacctggtggcagctccgcatgcgcgcttcgacgacggcctggtgcacctgtgctgggtgcgtagcggcatctcgcgggctgcgctgctgcgccttttcttggccatggagcgtggtagccacttcagcctgggctgtccgcagctgggctacgccgcggcccgtgccttccgcctagagccgctcacaccacgcggcgtgctcacagtggacggggagcaggtggagtatgggccgctacaggcacagatgcaccctggcatcggtacactgctcactgggcctcctggctgcccggggcgggagccctga

SEQ ID NO: 20287 - DNA, 1542 bp, Homo sapiens
  ENST00000597434
atctctgggcctttgttacgcgtgttagagtctctgtctttgcagctaaagacctcctccctcacgccccttttcttttgtgaattcaatggatgagacaggcccactctcccttaacaaagatggcgacaacggcgctgtctatggggccgcgacgtcgtctccgctgcgcgtcggccctcacccacgatggcggccagtctcccgaagcgcgaggccccgcccagctctcggcctctcccgcggccggtccctgcaccaagctcgcgagctgactggctccaccccccgcgccctcgtattggtgcggcccaggccggctgcacggccattggctgagcggatgcacaccctccccccacccctaggtctgatgggggctgttggtgctgacttgcgggaccgcctggaggaggacccggcgtaggccagaccaggagctgaccgggagctggggccacgggcctaggagcaccctggtcagggctaaggccatggccccgcccccaccgccactggctgccagcaccccgctcctccatggcgagtttggctcctacccagcccgaggcccacgctttgccctcacccttacatcgcaggccctgcacatacagcggctgcgccccaaacctgaagccaggccccggggtggcctggtcccgttggccgaggtctcaggctgctgcaccctgcgaagccgcagcccctcagactcagcggcctacttctgcatctacacctaccctcggggccggcgcggggcccggcgcagagccactcgcaccttccgggcagatggggccgccacctacgaagagaaccgtgccgaggcccagcgctgggccactgccctcacctgtctgctccgaggactgccactgcccggggatggggagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacgggggcccgcgggaggactcagactccagcacttccagcagcgcctgccctctatggacgacagcccggagctgcccacgggctgcagccagtatgccagggagctgccctcttcttccacaacagctggctctggggttctcaagatttattcaggatcgtgttaacggaggcggtgggaggatagggtccctgacgtgccggggacacacacagagaaccctccccgcccccgcaagggaggggggaggctcgctttttcttaaaaatataaatgtatttatctgca

SEQ ID NO: 20288 - DNA, 565 bp, Homo sapiens
  ENST00000601704
gagcggatgcacaccctccccccacccctaggtctgatgggggctgttggtgctgacttgcgggaccgcctggaggaggacccggcgtgtgaggaggaggccagaccaggagctgaccgggagctggggccacgggcctaggagcaccctggtcagggctaaggccatggccccgcccccaccgccactggctgccagcaccccgctcctccatggcgagtttggctcctacccagcccgaggcccacgctttgccctcacccttacatcgcaggccctgcacatacagcggctgcgccccaaacctgaagccaggccccggggtggcctggtcccgttggccgaggtctcaggctgctgcaccctgcgaagccgcagcccctcagactcagcggcctacttctgcatctacacctaccctcggggccggcgcggggcccggcgcagagccactcgcaccttccgggcagatggggccgccacctacgaagagaaccgtgccgaggcccagcgctgggccactgccctcacctgtctgctccgaggactgccactgcccggggat

SEQ ID NO: 20289 - DNA, 713 bp, Homo sapiens
  ENST00000593308
cgtgtgaggagggtgcgggggtcggggcagggaccggagtctaggggactgagggaccaagaggaacagagactcaggcccgggactggggcaccggggtgggagatggaaatggaaaacctgggccaggactgaacccagccaggcctgggactgggttctggaaataagagtgcggatggcggtttgggggcccagggccagacacgcaggcctatggattggggaccaatggatggagacccaggtccaggtctcggggacccagggacagagacccaggcccaagactggaggacatctagggctctgtgcttgaacctgatttgaggttcccataatggggccagggcaggtttgggggtgaagcagacgtcctggacccgagagagccgctggggataggggggcagatgtagttcctaaggaggccagaccaggagctgaccgggagctggggccacgggcctaggagcaccctggtcagggctaaggccatggccccgcccccaccgccactggctgccagcaccccgctcctccatggcgagtttggctcctacccagcccgaggcccacgctttgccctcacccttacatcgcaggccctgcacatacagcggctgcgccccaaacctgaagccaggccccggggtggcctggtcccgttggccgaggtctcaggctgctgcaccctgcgaagccgcagcccc

SEQ ID NO: 20290 - DNA, 618 bp, Homo sapiens
  ENST00000599033
gggactgagggaccaagaggaacagagactcaggcccgggactggggcaccggggtgggagatggaaatggaaaacctgggccaggactgaacccagccaggcctgggactgggttctggaaataagagtgcggatggcggtttgggggcccagggccagacacgcaggcctatggattggggaccaatggatggagacccaggtccaggtctcggggacccagggacagagacccaggcccaagactggaggacatctagggctctgtgcttgaacctgatttgaggttcccataatggggccagggcaggtttgggggtgaagcagacgtcctggacccgagagagccgctggggataggggggcagatgtagttcctaagggccctgcacatacagcggctgcgccccaaacctgaagccaggccccggggtggcctggtcccgttggccgaggtctcaggctgctgcaccctgcgaagccgcagcccctcagactcagcggcctacttctgcatctacacctaccctcggggccggcgcggggcccggcgcagagccactcgcaccttccgggcagatggggccgccacctacgaagagaaccgtgccgaggcc

SEQ ID NO: 20291 - DNA, 2683 bp, Homo sapiens
  ENST00000599748
ggggaacaaaggtgagcgaaaggaggaggcagaatccgggcagagggcagggagagggcctgtggggaagggacctcagtcctgctcccacccgctccctggagagcaggcggccagacacccagaggccagaccaggagctgaccgggagctggggccacgggcctaggagcaccctggtcagggctaaggccatggccccgcccccaccgccactggctgccagcaccccgctcctccatggcgagtttggctcctacccagcccgaggcccacgctttgccctcacccttacatcgcaggccctgcacatacagcggctgcgccccaaacctgaagccaggccccggggtggcctggtcccgttggccgaggtctcaggctgctgcaccctgcgaagccgcagcccctcagactcagcggcctacttctgcatctacacctaccctcggggccggcgcggggcccggcgcagagccactcgcaccttccgggcagatggggccgccacctacgaagagaaccgtgccgaggcccagcgctgggccactgccctcacctgtctgctccgaggactgccactgcccggggatggggagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacgggggatttgagccagccctgggcctcgacctgttgctcaactgctcactgttgctgtgccggggtggtggccacccactggacctgctctccgtgacgctggcctcgggctcccgctgtttctccttcctgtctgtggcctggggcttcgtgtcagatgtggatatccagagcgagcgcttcagggccttgggcagtgcccgcttcacactgggcacggtgctgggcctcgccacactgcacacctaccgcggacgcctctcctacctccccgccactgtggaacctgcctcgcccacccctgcccatagcctgcctcgtgccaagtcggagctgaccctaaccccagacccagccccgcccatggcccactcacccctgcatcgttctgtgtctgacctgcctcttcccctgccccagcctgccctggcctctcctggctcgccagaacccctgcccatcctgtccctcaacggtgggggcccagagctggctggggactggggtggggctggggatgctccgctgtccccggacccactgctgtcttcacctcctggctctcccaaggcagctctacactcacccgtctccgaaggggcccccgtaattcccccatcctctgggctcccacttcccacccctgatgcccgggtaggggcctccacctgcggcccgcccgaccacctgctgcctccgctgggcaccccgctgcccccagactgggtgacgctggagggggactttgtgctcatgttggccatctcgcccagccacctaggcgctgacctggtggcagctccgcatgcgcgcttcgacgacggcctggtgcacctgtgctgggtgcgtagcggcatctcgcgggctgcgctgctgcgccttttcttggccatggagcgtggtagccacttcagcctgggctgtccgcagctgggctacgccgcggcccgtgccttccgcctagagccgctcacaccacgcggcgtgctcacagtggacggggagcaggtggagtatgggccgctacaggcacagatgcaccctggcatcggtacactgctcactgggcctcctggctgcccggggcgggagccctgaaactaaacaagcttggtacccgccgggggcggggcctacattccaatggggcggagcctgagctagggggtgtggcctggctgctagagttgtggtggcaggggccctggccccgtctcaggattgcgctcgctttcatgggaccagacgtgatgctggaaggtgggcgtcgtcacggttaaagagaaatgggctcgtcccgagggtagtgcctgatcaatgagggcggggcctggcgtctgatctggggccgcccttacggggcagggctcagtcctgacgcttgccacctgctcctacccggccaggatggctgagggcggagtctattttacgcgtcgcccaatgacaggacctggaatgtactggctggggtaggcctcagtgagtcggccggtcagggcccgcagcctcgccccatccactccggtgcctccatttagctggccaatcagcccaggaggggcaggttccccggggccggcgctaggatttgcactaatgttcctctccccgcgggtgggggcggggaaattcatatcccctgttcgtctcatgcgcgtcctccgtccccaatctaaaaagcaattgaaaaggtctatgcaataaaggcagtcgcttcattcctctca

SEQ ID NO: 20292 - DNA, 3085 bp, Homo sapiens
  ENST00000599029
gaaaggaggaggcagaatccgggcagagggcagggagagggcctgtggggaagggacctcagtcctgctcccacccgctccctggagagcaggcggccagacacccaggtcagtgctcagggaccagctcttggcccctgccccttgcaggcgctcgcatgtggctcctctcggaccccgtagtccctgtcatatcccttctctccagctgtctccatgcctgcctcgtacccctcctatttgctctcccttccactctgtcttgcctttctcgttggggtgaaaaagtcttactctcttaagtatctttcatcgcctgagtttcacctcattgaccctgtttgtctcctctcagtgtttctctggctctcagaccctatctctattgcgtttgtgattgttttgctgttttacccactgcaccgtatggggggtgggggtgtcggggaggtgtgtctttcagtctttgcatgtctgtttctgcatatccaatcccactatccattccccttcctgtgccttcttttcccccaaagcccgttatcatcacccaaccacctgtatatttcaatcctttctcttgtttatctattcctatgaaggcaaggatttggggctattttgtctcctgctgtgtttgctaggcctagcaccgtgattggcacataaagggtactgaatacttactggggaataaatgattggatgtttgcatgcccgggtctccggccccctctgggatgctggcctctgtcccgcatcctcaaggtctgcccacacctgtctgagcctgtctgtctctgatgctcctgtctcacctgccactgcccctcattgtctcctcctgtccacagcccctgcccctccctgcccctgccatggggtcctgaattctcaccccttctctcctcccttcccacagaggccagaccaggagctgaccgggagctggggccacgggcctaggagcaccctggtcagggctaaggccatggccccgcccccaccgccactggctgccagcaccccgctcctccatggcgagtttggctcctacccagcccgaggcccacgctttgccctcacccttacatcgcaggccctgcacatacagcggctgcgccccaaacctgaagccaggccccggggtggcctggtcccgttggccgaggtctcaggctgctgcaccctgcgaagccgcagcccctcagactcagcggcctacttctgcatctacacctaccctcggggccggcgcggggcccggcgcagagccactcgcaccttccgggcagatggggccgccacctacgaagagaaccgtgccgaggcccagcgctgggccactgccctcacctgtctgctccgaggactgccactgcccggggatggggagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacgggggatttgagccagccctgggcctcgacctgttgctcaactgctcactgttgctgtgccggggtggtggccacccactggacctgctctccgtgacgctggcctcgggctcccgctgtttctccttcctgtctgtggcctggggcttcgtgtcagatgtggatatccagagcgagcgcttcagggccttgggcagtgcccgcttcacactgggcacggtgctgggcctcgccacactgcacacctaccgcggacgcctctcctacctccccgccactgtggaacctgcctcgcccacccctgcccatagcctgcctcgtgccaagtcggagctgaccctaaccccagacccagccccgcccatggcccactcacccctgcatcgttctgtgtctgacctgcctcttcccctgccccagcctgccctggcctctcctggctcgccagaacccctgcccatcctgtccctcaacggtgggggcccagagctggctggggactggggtggggctggggatgctccgctgtccccggacccactgctgtcttcacctcctggctctcccaaggcagctctacactcacccgtctccgaaggggcccccgtaattcccccatcctctgggctcccacttcccacccctgatgcccgggtaggggcctccacctgcggcccgcccgaccacctgctgcctccgctgggcaccccgctgcccccagactgggtgacgctggagggggactttgtgctcatgttggccatctcgcccagccacctaggcgctgacctggtggcagctccgcatgcgcgcttcgacgacggcctggtgcacctgtgctgggtgcgtagcggcatctcgcgggctgcgctgctgcgccttttcttggccatggagcgtggtagccacttcagcctgggctgtccgcagctgggctacgccgcggcccgtgccttccgcctagagccgctcacaccacgcggcgtgctcacagtggacggggagcaggtggagtatgggccgctacaggcacagatgcaccctggcatcgcccgcgggaggactcagactccagcacttccagcagcgcctgccctctatggacgacagcccggagctgcccacgggctgcagccagtatgccagggagctgccctcttcttccacaacagctggctctggggttctcaagatttattcaggatcgtgttaacggaggcggtgggaggatagggtccctgacgtgccggggacacacacagagaaccctccccgcccccgcaagggaggggggaggctcgctttttcttaaaaatataaatgtatttatctgca

SEQ ID NO: 20293 - DNA, 1786 bp, Homo sapiens
  ENST00000598574
agtcctgctcccacccgctccctggagagcaggcggccagacacccaggtcagtgctcagggaccagctcttggcccctgccccttgcaggcgctcgcatgtggctcctctcggaccccgtagtccctgtcatatcccttctctccagctgtctccatgcctgcctcgtacccctcctatttgctctcccttccactctgtcttgcctttctcgttggggtgaaaaagtcttactctcttaagtatctttcatcgcctgagtttcacctcattgaccctgtttgtctcctctcagtgtttctctggctctcagaccctatctctattgcgtttgtgattgttttgctgttttacccactgcaccgtatggggggtgggggtgtcggggaggtgtgtctttcagtctttgcatgtctgtttctgcatatccaatcccactatccattccccttcctgtgccttcttttcccccaaagcccgttatcatcacccaaccacctgtatatttcaatcctttctcttgtttatctattcctatgaaggcaaggatttggggctattttgtctcctgctgtgtttgctaggcctagcaccgtgattggcacataaagggtactgaatacttactggggaataaatgattggatgtttgcatgcccgggtctccggccccctctgggatgctggcctctgtcccgcatcctcaaggtctgcccacacctgtctgagcctgtctgtctctgatgctcctgtctcacctgccactgcccctcattgtctcctcctgtccacagcccctgcccctccctgcccctgccatggggtcctgaattctcaccccttctctcctcccttcccacagaggccagaccaggagctgaccgggagctggggccacgggcctaggagcaccctggtcagggctaaggccatggccccgcccccaccgccactggctgccagcaccccgctcctccatggcgagtttggctcctacccagcccgaggcccacgctttgccctcacccttacatcgcaggccctgcacatacagcggctgcgccccaaacctgaagccaggccccggggtggcctggtcccgttggccgaggtctcaggctgctgcaccctgcgaagccgcagcccctcagactcagcggcctacttctgcatctacacctaccctcggggccggcgcggggcccggcgcagagccactcgcaccttccgggcagatggggccgccacctacgaagagaaccgtgccgaggcccagcgctgggccactgccctcacctgtctgctccgaggactgccactgcccggggatgggggtgaggtgctgggcagctgctctatcctggagccaccttggtgtctctgcagaatttcctccataggcagctgtgtctttatttttctgtgtgtctgggtgatgtatctctctggatccgttaggagtgatacacagggatgggctacagaaggaacaaaaagacaagaggaccggatgtggtggctcatgtctgtaatcctagcaatttgggaggctgaggcgggtggatcacctgaggtcaggagttcgagaccagcctggctaacatggtgaaaccccatgtctactaaaaatacaaaaaattagccgggtgtggtgctgcgcacctgtaatcccagctacaggagggtgaggcaggagaatcgcttgaacccaggaggcagaggttgcagtgagctgagatcgtgccattgcactccagcttgggcaacaagagcaaaactctgtctc

SEQ ID NO: 20294 - DNA, 2492 bp, Homo sapiens
  ENST00000340932
cgactgactagccgggcgataacggcagagagcatagagcgcaggaacaagcgcaacgtccaagagggaagggccagcacgtcgggggcctctctggccctacccaggccgtgttctcgatagctttccggaagaaagggatctgggagcgagatgcgtgtagctagcacgatgcgtcgcgcggtgacgctctggcccgacgccgacggcctctcagtggctcccggaggacccggcgggcccagtgttggagagctgaaggtcaggccaggacagtgagacctgactccttgctcctaccagcctactatggcttaagacccagggccagggtcccgttgatgtaacagagcagaggaccagcagatgaatggacaccttgaagcagaggagcagcaggaccagagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacgggggatttgagccagccctgggcctcgacctgttgctcaactgctcactgttgctgtgccggggtggtggccacccactggacctgctctccgtgacgctggcctcgggctcccgctgtttctccttcctgtctgtggcctggggcttcgtgtcagatgtggatatccagagcgagcgcttcagggccttgggcagtgcccgcttcacactgggcacggtgctgggcctcgccacactgcacacctaccgcggacgcctctcctacctccccgccactgtggaacctgcctcgcccacccctgcccatagcctgcctcgtgccaagtcggagctgaccctaaccccagacccagccccgcccatggcccactcacccctgcatcgttctgtgtctgacctgcctcttcccctgccccagcctgccctggcctctcctggctcgccagaacccctgcccatcctgtccctcaacggtgggggcccagagctggctggggactggggtggggctggggatgctccgctgtccccggacccactgctgtcttcacctcctggctctcccaaggcagctctacactcacccgtctccgaaggggcccccgtaattcccccatcctctgggctcccacttcccacccctgatgcccgggtaggggcctccacctgcggcccgcccgaccacctgctgcctccgctgggcaccccgctgcccccagactgggtgacgctggagggggactttgtgctcatgttggccatctcgcccagccacctaggcgctgacctggtggcagctccgcatgcgcgcttcgacgacggcctggtgcacctgtgctgggtgcgtagcggcatctcgcgggctgcgctgctgcgccttttcttggccatggagcgtggtagccacttcagcctgggctgtccgcagctgggctacgccgcggcccgtgccttccgcctagagccgctcacaccacgcggcgtgctcacagtggacggggagcaggtggagtatgggccgctacaggcacagatgcaccctggcatcggtacactgctcactgggcctcctggctgcccggggcgggagccctgaaactaaacaagcttggtacccgccgggggcggggcctacattccaatggggcggagcctgagctagggggtgtggcctggctgctagagttgtggtggcaggggccctggccccgtctcaggattgcgctcgctttcatgggaccagacgtgatgctggaaggtgggcgtcgtcacggttaaagagaaatgggctcgtcccgagggtagtgcctgatcaatgagggcggggcctggcgtctgatctggggccgcccttacggggcagggctcagtcctgacgcttgccacctgctcctacccggccaggatggctgagggcggagtctattttacgcgtcgcccaatgacaggacctggaatgtactggctggggtaggcctcagtgagtcggccggtcagggcccgcagcctcgccccatccactccggtgcctccatttagctggccaatcagcccaggaggggcaggttccccggggccggcgctaggatttgcactaatgttcctctccccgcgggtgggggcggggaaattcatatcccctgttcgtctcatgcgcgtcctccgtccccaatctaaaaagcaattgaaaaggtctatgcaataaaggcagtcgcttcattcctctcag

SEQ ID NO: 20295 - DNA, 6917 bp, Homo sapiens
  ENST00000392056
tccttcgcctgcactttccgtctttcttctctgggcgcccaccaacaatggatggcaactccctgctctcggtaccaagcaacttggagtcatcacggatgtatgacgttttggaaccgcagcagggcagaggctgtggcagctcaggaagcggcccggggaactccatcacagcctgtaagaaggttcttcgcagcaatagcctgctggagtcaacagactactggttgcagaatcagaggatgccctgccaaattggttttgtagaagacaagtctgaaaactgtgcttctgtctgctttgtgaatcttgatgtgaacaaggatgaatgcagcacagagcacctgcaacagaaactggtcaacgtttcaccagatcttccaaaacttatcagttccatgaatgtccaacaaccaaaagaaaatgaaattgttgtcctaagtgggttagcctctggaaatctccaggcagattttgaagtttcacagtgcccttggctgccagatatctgcttggtccaatgtgcaagagggaacagaccaaacagtaccaactgcatcatctttgaaatcaacaaatttctgattggtctggaactggtgcaggagcgacagctccacctggaaacaaacatcttgaaactggaggatgacacgaactgttccttatcttcaatcgaggaagactttctcaccgcttctgagcacttggaggaggaaagcgaggtggatgaatctaggaacgattatgaaaatataaatgtctcagccaatgttttggaaagtaaacagctaaagggagccacccaggtggaatggaattgcaacaaggaaaagtggctttatgctttggaagacaaatacatcaacaaatatcccacaccattgattaaaacagaacgatctccagaaaacctaacaaagaacacagccttgcagagtctagatccctcagccaagccatcacagtggaaaagagaagctgtggggaatgggagacaagccacacattattatcattcagaagcttttaaaggtcaaatggaaaaatcacaggcactgtatattccaaaagatgcttatttctccatgatggataaagatgtaccttctgcatgtgctgtggcagagcagagaagcaacctaaacccaggagaccatgaagacacaagaaacgctctccctcctagacaagatggagaagtcaccactggcaagtatgctacaaatttagcagaatccgtgctgcaggatgcatttattagattatctcaatctcagtccacattaccccaggaatctgcagtcagtgtttctgtaggaagttctctgcttcccagttgctattccacaaaagatacagtggtttctcggtcatggaatgagctccccaaaatcgtcgttgttcagagtccagatggcagtgatgctgccccacagccaggcatctcctcctggcctgagatggaagtctctgttgaaacctcaagcatcctctctggagagaactccagcagacaaccccagagtgctctagaagtggcgttagcttgtgcagccactgtgattggaactatttccagtccacaggccacagaaagactcaaaatggagcaagtggtctcgaactttcccccagggagcagtggtgcactgcaaactcaagcaccccaaggactcaaggaaccttccatcaatgagtactcctttccatctgctttgtgtggcatgactcaggtggccagtgccgtggctgtctgtggtctgggtgaaagagaagaggtgacatgctcagtggctccaagtggtagcctcccgcctgcagctgaggcttctgaagccatgcccccactttgtggtttagcaagcatggagcttggcaaggaagccattgccaagggattgctcaaggaggctgctctggttttaacaaggcctaatacctacagcagcattggagactttctggactccatgaacaggagaatcatggaaactgcttcaaagtctcagaccctgtgctcagaaaatgtcgtcaggaatgaactggcacataccctgtccaatgttatcctgaggcattccattgatgaagttcaccacaaaaatatgataatcgaccccaatgacaacaggcattcatctgaaattctggacaccttaatggaaagtacaaatcaactgcttttagatgtgatatgcttcacgttcaagaagatgagtcatattgtacggcttggtgaatgtcctgctgtcctttctaaggagaccatcagaaggagggagacagaaccaagctgccagccatctgatccgggtgctagtcaagcttggacaaaagccactgaatcctccagcagctctccacttagcaattcacacaacacgagtcttgtcatcaacaatcttgtggatggcatgtattcaaaacaagacaagggtggagtgaggccaggcctcttcaagaaccccacgctgcagtcacaattatcacgtagtcacagagtgcccgattcttcaactgctacaacatcctccaaggaaatatatctgaaaggaatagcaggagaggatacaaaaagccctcatcacagtgagaatgaatgcagagcctcttccgaaggacaaaggtccccaacggtcagccagtccagaagtggttcccaggaggctgaggagagtatccacccaaacacccaagaaaagtacaactgtgccacatctcgcatcaacgaagttcaagtcaacctgtccttgttaggggatgacctgctgcttcctgctcaatccacgcttcaaacaaagcatccagacatctactgcattacagactttgcggaagaattagcagacacggtcgtctccatggcaactgaaattgcagcgatttgccttgacaactccagtggaaaacaaccctggttttgtgcatggaaaagagggagtgagtttctgatgacacccaacgtaccctgccgatccttgaagaggaagaaagagagccaggggagcgggaccgctgtgaggaaacacaagcctccccggctcagtgagatcaagaggaagacggacgagcaccctgagcttaaagaaaagctgatgaacagggttgtggatgagtccatgaaccttgaagatgtcccagattctgtcaatctttttgccaatgaagtggcagccaagatcatgaacctaacggagttctctatggtggacggcatgtggcaggcgcagggctatccccggaatcggttactgagtggcgacaggtggagccggctgaaggcctccagctgcgaaagcattcctgaggaagactccgaggccagggcctatgtcaacagcctgggcttaatgagcacgctgagccagccggtcagcagggccagctctgtctccaagcagtcgagctgtgagagcatcaccgatgagttttccaggttcatggtgaaccagatggaaaatgaagggagaggatttgagttactgctggattactatgctggcaagaacgccagcagcattctgaactcagccatgcaacaggcgtgccggaaaagtgaccacctcagtgtgaggcctagctgtccctctaagcagtccagcacagagagcatcactgaggagttctacaggtacatgctgagggacatcgaaagagacagcagagaaagtgcctcctccagacggagcagccaggattggacagccggcctgctgtctccttctctgcgatccccagtgtgccacagacagtcgtccatgccagacagcagatccccatgctccaggctgacagtgaatgtgcccatcaaagccaactctttagatggctttgctcagaactgcccacaagatttcctaagcgtgcagccggtcagtagcgcgtcctcatccggtctctgcaaatctgactcttgcttgtatcggagaggtgggactgaccacatcaccaacatgttaattcatgaaacgtgggctagctccattgaggctctcatgcgcaagaacaaaatcattgtggatgatgcagaggaagctgacactgagcctgtttctggtggctctccctcgcaagcagagaagtgtgcaaatagattagctgcgagcaggatgtgcagtgggccaactctgcttgttcaggagtctctcgattgcccgaggaaagactctgttaccgaatgtaaacagcccccagtgtcatctttgagcaaaactgcttctcttacaaaccacagccctttagattctaaaaaagaaacttcctcgtgccaggaccctgtaccaataaaccacaaaaggcgatcactttgctcgagggaagtgcctttgattcagattgaaacagatcagagagaagcctgtgctggggaacctgaacccttcctttccaaaagcagcctcctagaggaagcagaagggcattcgaatgacaaaaacatcccagatgtggtgagaggtggagacacagccgtgagcgcttgtcaaatccatagtgacagccttgataccagagatgtaccagaggctgaagcctccacagaagccagagcccccgatgaggcccccaaccctccaagcagcagcgaggagagcacaggcagctggacccagcttgccaatgaggaagacaacccagatgacacaagtagctttctccagctcagtgagcgatccatgagcaatggcaacagtagtgccactagcagtcttggcattatggatctggacatttatcaggaaagcatgccatcttctcccatgattaatgaattagtagaagaaaagaagattcttaaaggacagtcagaaagcacagaggcacctgcatctggaccgcctacgggaacagccagcccccagaggagcctgctggtgatcaactttgacctggagccagagtgtccagatgccgagctccgagccactctgcagtggatagctgcctctgaactggggattcccaccatctactttaagaaatctcaggaaaacagaattgaaaagtttctagatgtcgtgcagctggttcatcggaagtcctggaaagtgggtgatatcttccatgcagttgtccagtactgcaaaatgcatgaggagcagaaggatgggagactgagtctctttgactggctcttggaactgggataataaggcagtctgccgtatagatcattccttccctttattccaacttagattacagtggtttgttctaaatgctctaaacattctcaaaacatcacatcacattagcagaactataaaaaaaaatctgctactcagatccactgcatacagaataagtcagaggaaaagcaaaatataggtctgtccaaattcatacaacttgtgggtgagttccaaagagcttggattagaagggctggacaaagagagaattcaatggggcccaaattagaatgcttataatgagacccaatctccaggaaaacaacactcacataagtttaatcatataaaatgatttgtaatgtctctaattagatgaatcaactagaaacaaactcagtggtcaaaataatttttaagagtattccgtaacctatattttacttttctgattatattaaggggctgccagcccggagaaatacttaagatatgggtgagaaatccccagacttttatacaaaagatttccactttcaaatcaatgtcagtagacattgataaaagtatagcagcatcctctactgaggtgatttcatttattccctgcagcccactgataaatatctcacttctcccaaatagtatgtggactcccagctaagcagaaaactattgtcattcaactgaagaagaggaagataaaagattgtcttgtttccatcactgtattacttgtgtaacatgattacataattcttatcctaagagaaagctttcatatttaaaaaaaagtcttttcagataaaatctgcttgtgtcttgaataatatgaaatacaaactttcactttattttattgtaaattataaagagattattgtcttaaataatatattgagttagcttcaagcttcctaaaatatgaagagattgttgtctaaagtcacatattgacattgagctcagtggcctgtttcatcacgtatgtgctgctacctgtacagcagacatgccgctccagtgacatttataatgacagaagcagggtaatggtcttgtgtttgacatgatcagttaggatcatagactttccctgactcgtagatattagccttgaattgggggaaaagaagactttgacacattttagttattttaataacagagatttactcttttgaaaaataaaggtatctaatgtctccctaataagtcttctttccttccaactaaatgacctacacggacttttattttcttgatcaaagaggtgtttattaaggacttctggataactatacttttactctatttttaaagatcacaaagtaattttaaatgtgaacaggttcccataccatgaatgctggcctcaccttctctatcatccacattttgaaatgcaaagaaagctcccttgtaagccatacttccttccccactcccatcctaggatacttgcccagtgctcattaggcatttcttattcagatagtccaaatttaggttattatgcttaatttgacacattaactaaatgcccagttttaaaatatatccatcaattcacgctgaaatgtgcttctttgtgctatcaaatggaatagaatacacttattttttaaacaatcccagaatactgtgtgtagacttttgttgtgctcaaataaatgtttacttatcttacaaagctcaaatactggattgtaaccatgtgatgaagttatctatgttgtacctaacattgcaaattaatcaataaatctctgttgtcagattgtt

SEQ ID NO: 20296 - DNA, 6804 bp, Homo sapiens
  ENST00000344657
gtctttcttctctgggcgcccaccaacaatggatggcaactccctgctctcggtaccaagcaacttggagtcatcacggatgtatgacgttttggaaccgcagcagggcagaggctgtggcagctcaggaagcggcccggggaactccatcacagcctgtaagaaggttcttcgcagcaatagcctgctggagtcaacagactactggttgcagaatcagaggatgccctgccaaattggttttgtagaagacaagtctgaaaactgtgcttctgtctgctttgtgaatcttgatgtgaacaaggatgaatgcagcacagagcacctgcaacagaaactggtcaacgtttcaccagatcttccaaaacttatcagttccatgaatgtccaacaaccaaaagaaaatgaaattgttgtcctaagtgggttagcctctggaaatctccaggcagattttgaagtttcacagtgcccttggctgccagatatctgcttggtccaatgtgcaagagggaacagaccaaacagtaccaactgcatcatctttgaaatcaacaaatttctgattggtctggaactggtgcaggagcgacagctccacctggaaacaaacatcttgaaactggaggatgacacgaactgttccttatcttcaatcgaggaagactttctcaccgcttctgagcacttggaggaggaaagcgaggtggatgaatctaggaacgattatgaaaatataaatgtctcagccaatgttttggaaagtaaacagctaaagggagccacccaggtggaatggaattgcaacaaggaaaagtggctttatgctttggaagacaaatacatcaacaaatatcccacaccattgattaaaacagaacgatctccagaaaacctaacaaagaacacagccttgcagagtctagatccctcagccaagccatcacagtggaaaagagaagctgtggggaatgggagacaagccacacattattatcattcagaagcttttaaaggtcaaatggaaaaatcacaggcactgtatattccaaaagatgcttatttctccatgatggataaagatgtaccttctgcatgtgctgtggcagagcagagaagcaacctaaacccaggagaccatgaagacacaagaaacgctctccctcctagacaagatggagaagtcaccactggcaagtatgctacaaatttagcagaatccgtgctgcaggatgcatttattagattatctcaatctcagtccacattaccccaggaatctgcagtcagtgtttctgtaggaagttctctgcttcccagttgctattccacaaaagatacagtggtttctcggtcatggaatgagctccccaaaatcgtcgttgttcagagtccagatggcagtgatgctgccccacagccaggcatctcctcctggcctgagatggaagtctctgttgaaacctcaagcatcctctctggagagaactccagcagacaaccccagagtgctctagaagtggcgttagcttgtgcagccactgtgattggaactatttccagtccacaggccacagaaagactcaaaatggagcaagtggtctcgaactttcccccagggagcagtggtgcactgcaaactcaagcaccccaaggactcaaggaaccttccatcaatgagtactcctttccatctgctttgtgtggcatgactcaggtggccagtgccgtggctgtctgtggtctgggtgaaagagaagaggtgacatgctcagtggctccaagtggtagcctcccgcctgcagctgaggcttctgaagccatgcccccactttgtggtttagcaagcatggagcttggcaaggaagccattgccaagggattgctcaaggaggctgctctggttttaacaaggcctaatacctacagcagcattggagactttctggactccatgaacaggagaatcatggaaactgcttcaaagtctcagaccctgtgctcagaaaatgtcgtcaggaatgaactggcacataccctgtccaatgttatcctgaggcattccattgatgaagttcaccacaaaaatatgataatcgaccccaatgacaacaggcattcatctgaaattctggacaccttaatggaaagtacaaatcaactgcttttagatgtgatatgcttcacgttcaagaagatgagtcatattgtacggcttggtgaatgtcctgctgtcctttctaaggagaccatcagaaggagggagacagaaccaagctgccagccatctgatccgggtgctagtcaagcttggacaaaagccactgaatcctccagcagctctccacttagcaattcacacaacacgagtcttgtcatcaacaatcttgtggatggcatgtattcaaaacaagacaagggtggagtgaggccaggcctcttcaagaaccccacgctgcagtcacaattatcacgtagtcacagagtgcccgattcttcaactgctacaacatcctccaaggaaatatatctgaaaggaatagcaggagaggatacaaaaagccctcatcacagtgagaatgaatgcagagcctcttccgaaggacaaaggtccccaacggtcagccagtccagaagtggttcccaggaggctgaggagagtatccacccaaacacccaagaaaagtacaactgtgccacatctcgcatcaacgaagttcaagtcaacctgtccttgttaggggatgacctgctgcttcctgctcaatccacgcttcaaacaaagcatccagacatctactgcattacagactttgcggaagaattagcagacacggtcgtctccatggcaactgaaattgcagcgatttgccttgacaactccagtggaaaacaaccctggttttgtgcatggaaaagagggagtgagtttctgatgacacccaacgtaccctgccgatccttgaagaggaagaaagagagccaggggagcgggaccgctgtgaggaaacacaagcctccccggctcagtgagatcaagaggaagacggacgagcaccctgagcttaaagaaaagctgatgaacagggttgtggatgagtccatgaaccttgaagatgtcccagattctgtcaatctttttgccaatgaagtggcagccaagatcatgaacctaacggagttctctatggtggacggcatgtggcaggcgcagggctatccccggaatcggttactgagtggcgacaggtggagccggctgaaggcctccagctgcgaaagcattcctgaggaagactccgaggccagggcctatgtcaacagcctgggcttaatgagcacgctgagccagccggtcagcagggccagctctgtctccaagcagtcgagctgtgagagcatcaccgatgagttttccaggttcatggtgaaccagatggaaaatgaagggagaggatttgagttactgctggattactatgctggcaagaacgccagcagcattctgaactcagccatgcaacaggcgtgccggaaaagtgaccacctcagtgtgaggcctagctgtccctctaagcagtccagcacagagagcatcactgaggagttctacaggtacatgctgagggacatcgaaagagacagcagagaaagtgcctcctccagacggagcagccaggattggacagccggcctgctgtctccttctctgcgatccccagtgtgccacagacagtcgtccatgccagacagcagatccccatgctccaggctgacagtgaatgtgcccatcaaagccaactctttagatggctttgctcagaactgcccacaagatttcctaagcgtgcagccggtcagtagcgcgtcctcatccggtctctgcaaatctgactcttgcttgtatcggagaggtgggactgaccacatcaccaacatgttaattcatgaaacgtgggctagctccattgaggctctcatgcgcaagaacaaaatcattgtggatgatgcagaggaagctgacactgagcctgtttctggtggctctccctcgcaagcagagaagtgtgcaaatagattagctgcgagcaggatgtgcagtgggccaactctgcttgttcaggagtctctcgattgcccgaggaaagactctgttaccgaatgtaaacagcccccagtgtcatctttgagcaaaactgcttctcttacaaaccacagccctttagattctaaaaaagaaacttcctcgtgccaggaccctgtaccaataaaccacaaaaggcgatcactttgctcgagggaagtgcctttgattcagattgaaacagatcagagagaagcctgtgctggggaacctgaacccttcctttccaaaagcagcctcctagaggaagcagaagggcattcgaatgacaaaaacatcccagatgtggtgagaggtggagacacagccgtgagcgcttgtcaaatccatagtgacagccttgataccagagatgtaccagaggctgaagcctccacagaagccagagcccccgatgaggcccccaaccctccaagcagcagcgaggagagcacaggcagctggacccagcttgccaatgaggaagacaacccagatgacacaagtagctttctccagctcagtgagcgatccatgagtgaattagtagaagaaaagaagattcttaaaggacagtcagaaagcacagaggcacctgcatctggaccgcctacgggaacagccagcccccagaggagcctgctggtgatcaactttgacctggagccagagtgtccagatgccgagctccgagccactctgcagtggatagctgcctctgaactggggattcccaccatctactttaagaaatctcaggaaaacagaattgaaaagtttctagatgtcgtgcagctggttcatcggaagtcctggaaagtgggtgatatcttccatgcagttgtccagtactgcaaaatgcatgaggagcagaaggatgggagactgagtctctttgactggctcttggaactgggataataaggcagtctgccgtatagatcattccttccctttattccaacttagattacagtggtttgttctaaatgctctaaacattctcaaaacatcacatcacattagcagaactataaaaaaaaatctgctactcagatccactgcatacagaataagtcagaggaaaagcaaaatataggtctgtccaaattcatacaacttgtgggtgagttccaaagagcttggattagaagggctggacaaagagagaattcaatggggcccaaattagaatgcttataatgagacccaatctccaggaaaacaacactcacataagtttaatcatataaaatgatttgtaatgtctctaattagatgaatcaactagaaacaaactcagtggtcaaaataatttttaagagtattccgtaacctatattttacttttctgattatattaaggggctgccagcccggagaaatacttaagatatgggtgagaaatccccagacttttatacaaaagatttccactttcaaatcaatgtcagtagacattgataaaagtatagcagcatcctctactgaggtgatttcatttattccctgcagcccactgataaatatctcacttctcccaaatagtatgtggactcccagctaagcagaaaactattgtcattcaactgaagaagaggaagataaaagattgtcttgtttccatcactgtattacttgtgtaacatgattacataattcttatcctaagagaaagctttcatatttaaaaaaaagtcttttcagataaaatctgcttgtgtcttgaataatatgaaatacaaactttcactttattttattgtaaattataaagagattattgtcttaaataatatattgagttagcttcaagcttcctaaaatatgaagagattgttgtctaaagtcacatattgacattgagctcagtggcctgtttcatcacgtatgtgctgctacctgtacagcagacatgccgctccagtgacatttataatgacagaagcagggtaatggtcttgtgtttgacatgatcagttaggatcatagactttccctgactcgtagatattagccttgaattgggggaaaagaagactttgacacattttagttattttaataacagagatttactcttttgaaaaataaaggtatctaatgtctccctaataagtcttctttccttccaactaaatgacctacacggacttttattttcttgatcaaagaggtgtttattaaggacttctggataactatacttttactctatttttaaagatcacaaagtaattttaaatgtgaacaggttcccataccatgaatgctggcctcaccttctctatcatccacattttgaaatgcaaagaaagctcccttgtaagccatacttccttccccactcccatcctaggatacttgcccagtgctcattaggcatttcttattcagatagtccaaatttaggttattatgcttaatttgacacattaactaaatgcccagttttaaaatatatccatcaattcacgctgaaatgtgcttctttgtgctatcaaatggaatagaatacacttattttttaaacaatcccagaatactgtgtgtagacttttgttgtgctcaaataaatgtttacttatcttacaaagctcaaatactggattgtaaccatgtgatgaagttatctatgttgtacctaacattgcaaattaatcaataaatctctgttgtca

SEQ ID NO: 20297 - DNA, 544 bp, Homo sapiens
  ENST00000490603
ccgatgaggcccccaaccctccaagcagcagcgaggagagcacaggcagctggacccagcttgccaatgaggaagacaacccagatgacacaagtagctttctccagctcagtgagcgatccatgagcaatggcaacagtagtgccactagcagtcttggcattatggatctggacatttatcaggaaagcatgccatcttctcccatgattaatgaattagtagaagaaaagaagattcttaaaggacagtcagaaagcacagaggcacctgcatctggaccgcctacgggaacagccagcccccagaggagcctgctggtgatcaactttgacctggagccagagtgtccagatgccgagctccgagccactctgcagtggatagctgcctctgaactggggattcccaccatctactttaagaaatctcaggaaaacagaattgaaaaggtatcatgtaccaggtttggaaaacaagaaagctttgtgttttcatcaccactggaaactcagtaaatgctcagtaaacccctgtccatttg

SEQ ID NO: 20298 - DNA, 2986 bp, Homo sapiens
  ENST00000357154
gggagcgcgccgggcgcagggagctgagtggacggctcgagacggcggcgcgtgcagcagctccagaaagcagcgagttggcagagcagggctgcatttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgaagtagaggatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacctgggtcttaaggatttaggaaaaatatgcatgctttaattgcatttccaaagtagcatcttgctagacctagttgagtcaggataacagagagataccacatggcaagaaaaacaaagtgacaattgtagagtcctcaattgtgtttacattaatagtggtgtttttacctatgaaattattctggatctaataggacattttacaaaatggcaagtatggaaaaccatggattctgaaagttaaaaatttagttgttctccccaatgtgtattttaatttggatggcagtctcatgcagattttttaaaagattctttaataacatgatttgtttgcctttctagatttctttatctttctgaccagcaacttagggagcagaatttaaattaggaagacaaagggaaagattcatttaaaccatatttttacaaagtttgtcatttgccccaaggtcaaattttaaattcttaattttcattttatttcccattttaggtaaaagtttgcatttaatcttagaattatgttatttttgttagtagtgtggaaacttagagaacttattgtatggtgccttgcaaaaatagagatagaaagattttagcatgcataccaatatagtatattacgcaatatataagcacacctaattaacagattaatatcagtaaaggtattgctgctggaatgaagaaaatgggatacgtttgtttctttttttctattgttacataattgccatgtggacttgtttatgattattgtgtagagtagcatttaagatttaactgtagcaaaaattactttaaccgctgtatttaagttagcatgttaattaattgtgtagacattttggcacaccatcacttttaactatatcataccaatggttttgtgcccataataaaaatggaaaaacctgttgaatgttacgtattggtatctttaatttcaacagtgggtaaactggtttcccagtatacaattcattgaaagcaaaattgattaattatttccatttaatttatacacactcaatacaaaatttaatgttgactttacgtaataaagtataatgcattttcttttttactgtttatgtatagtttacaaaataaagaatcttgtaaccaaa

SEQ ID NO: 20299 - DNA, 2936 bp, Homo sapiens
  ENST00000357545
gagacggcggcgcgtgcagcagctccagaaagcagcgagttggcagagcagggctgcatttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacctgggtcttaaggatttaggaaaaatatgcatgctttaattgcatttccaaagtagcatcttgctagacctagttgagtcaggataacagagagataccacatggcaagaaaaacaaagtgacaattgtagagtcctcaattgtgtttacattaatagtggtgtttttacctatgaaattattctggatctaataggacattttacaaaatggcaagtatggaaaaccatggattctgaaagttaaaaatttagttgttctccccaatgtgtattttaatttggatggcagtctcatgcagattttttaaaagattctttaataacatgatttgtttgcctttctagatttctttatctttctgaccagcaacttagggagcagaatttaaattaggaagacaaagggaaagattcatttaaaccatatttttacaaagtttgtcatttgccccaaggtcaaattttaaattcttaattttcattttatttcccattttaggtaaaagtttgcatttaatcttagaattatgttatttttgttagtagtgtggaaacttagagaacttattgtatggtgccttgcaaaaatagagatagaaagattttagcatgcataccaatatagtatattacgcaatatataagcacacctaattaacagattaatatcagtaaaggtattgctgctggaatgaagaaaatgggatacgtttgtttctttttttctattgttacataattgccatgtggacttgtttatgattattgtgtagagtagcatttaagatttaactgtagcaaaaattactttaaccgctgtatttaagttagcatgttaattaattgtgtagacattttggcacaccatcacttttaactatatcataccaatggttttgtgcccataataaaaatggaaaaacctgttgaatgttacgtattggtatctttaatttcaacagtgggtaaactggtttcccagtatacaattcattgaaagcaaaattgattaattatttccatttaatttatacacactcaatacaaaatttaatgttgactttacgtaataaagtataatgcattttcttttttactgtttatgtatagtttacaaaataaagaatcttgtaacc

SEQ ID NO: 20300 - DNA, 2900 bp, Homo sapiens
  ENST00000504953
tcctctggctccagccaagcgtcctatccggagccaactgtagctgggatccagcgagaggaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacctgggtcttaaggatttaggaaaaatatgcatgctttaattgcatttccaaagtagcatcttgctagacctagttgagtcaggataacagagagataccacatggcaagaaaaacaaagtgacaattgtagagtcctcaattgtgtttacattaatagtggtgtttttacctatgaaattattctggatctaataggacattttacaaaatggcaagtatggaaaaccatggattctgaaagttaaaaatttagttgttctccccaatgtgtattttaatttggatggcagtctcatgcagattttttaaaagattctttaataacatgatttgtttgcctttctagatttctttatctttctgaccagcaacttagggagcagaatttaaattaggaagacaaagggaaagattcatttaaaccatatttttacaaagtttgtcatttgccccaaggtcaaattttaaattcttaattttcattttatttcccattttaggtaaaagtttgcatttaatcttagaattatgttatttttgttagtagtgtggaaacttagagaacttattgtatggtgccttgcaaaaatagagatagaaagattttagcatgcataccaatatagtatattacgcaatatataagcacacctaattaacagattaatatcagtaaaggtattgctgctggaatgaagaaaatgggatacgtttgtttctttttttctattgttacataattgccatgtggacttgtttatgattattgtgtagagtagcatttaagatttaactgtagcaaaaattactttaaccgctgtatttaagttagcatgttaattaattgtgtagacattttggcacaccatcacttttaactatatcataccaatggttttgtgcccataataaaaatggaaaaacctgttgaatgttacgtattggtatctttaatttcaacagtgggtaaactggtttcccagtatacaattcattgaaagcaaaattgattaattatttccatttaatttatacacactcaatacaaaatttaatgttgactttacgtaataaagtataatgcattttcttttttactgtttatgtatagtttacaaaataaagaatcttgtaacc

SEQ ID NO: 20301 - DNA, 2908 bp, Homo sapiens
  ENST00000511531
tcctctggctccagccaagcgtcctatccggagccaactgtagctgggatccagcgagaggaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgaagtagaggatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacctgggtcttaaggatttaggaaaaatatgcatgctttaattgcatttccaaagtagcatcttgctagacctagttgagtcaggataacagagagataccacatggcaagaaaaacaaagtgacaattgtagagtcctcaattgtgtttacattaatagtggtgtttttacctatgaaattattctggatctaataggacattttacaaaatggcaagtatggaaaaccatggattctgaaagttaaaaatttagttgttctccccaatgtgtattttaatttggatggcagtctcatgcagattttttaaaagattctttaataacatgatttgtttgcctttctagatttctttatctttctgaccagcaacttagggagcagaatttaaattaggaagacaaagggaaagattcatttaaaccatatttttacaaagtttgtcatttgccccaaggtcaaattttaaattcttaattttcattttatttcccattttaggtaaaagtttgcatttaatcttagaattatgttatttttgttagtagtgtggaaacttagagaacttattgtatggtgccttgcaaaaatagagatagaaagattttagcatgcataccaatatagtatattacgcaatatataagcacacctaattaacagattaatatcagtaaaggtattgctgctggaatgaagaaaatgggatacgtttgtttctttttttctattgttacataattgccatgtggacttgtttatgattattgtgtagagtagcatttaagatttaactgtagcaaaaattactttaaccgctgtatttaagttagcatgttaattaattgtgtagacattttggcacaccatcacttttaactatatcataccaatggttttgtgcccataataaaaatggaaaaacctgttgaatgttacgtattggtatctttaatttcaacagtgggtaaactggtttcccagtatacaattcattgaaagcaaaattgattaattatttccatttaatttatacacactcaatacaaaatttaatgttgactttacgtaataaagtataatgcattttcttttttactgtttatgtatagtttacaaaataaagaatcttgtaac

SEQ ID NO: 20302 - DNA, 2947 bp, Homo sapiens
  ENST00000506886
acaaagcagataaggattcctaggctaggagctacctcgtcctctggctccagccaagcgtcctatccggagccaactgtagctgggatccagcgagaggaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgaagtagaggatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacctgggtcttaaggatttaggaaaaatatgcatgctttaattgcatttccaaagtagcatcttgctagacctagttgagtcaggataacagagagataccacatggcaagaaaaacaaagtgacaattgtagagtcctcaattgtgtttacattaatagtggtgtttttacctatgaaattattctggatctaataggacattttacaaaatggcaagtatggaaaaccatggattctgaaagttaaaaatttagttgttctccccaatgtgtattttaatttggatggcagtctcatgcagattttttaaaagattctttaataacatgatttgtttgcctttctagatttctttatctttctgaccagcaacttagggagcagaatttaaattaggaagacaaagggaaagattcatttaaaccatatttttacaaagtttgtcatttgccccaaggtcaaattttaaattcttaattttcattttatttcccattttaggtaaaagtttgcatttaatcttagaattatgttatttttgttagtagtgtggaaacttagagaacttattgtatggtgccttgcaaaaatagagatagaaagattttagcatgcataccaatatagtatattacgcaatatataagcacacctaattaacagattaatatcagtaaaggtattgctgctggaatgaagaaaatgggatacgtttgtttctttttttctattgttacataattgccatgtggacttgtttatgattattgtgtagagtagcatttaagatttaactgtagcaaaaattactttaaccgctgtatttaagttagcatgttaattaattgtgtagacattttggcacaccatcacttttaactatatcataccaatggttttgtgcccataataaaaatggaaaaacctgttgaatgttacgtattggtatctttaatttcaacagtgggtaaactggtttcccagtatacaattcattgaaagcaaaattgattaattatttccatttaatttatacacactcaatacaaaatttaatgttgactttacgtaataaagtataatgcattttcttttttactgtttatgtatagtttacaaaataaagaatcttgtaac

SEQ ID NO: 20303 - DNA, 2007 bp, Homo sapiens
  ENST00000535728
acacatattctccacgccatggaggccactgcttgaggatgggggaggagtagtataagcagttcaatactgtcttttttaccatcttcagtgcttcttggtgatatgaagtaaaaccaggatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacctgggtcttaaggatttaggaaaaatatgcatgctttaattgcatttccaaagtagcatcttgctagacctagttgagtcaggataacagagagataccacatggcaagaaaaacaaagtgacaattgtagagtcctcaattgtgtttacattaatagtggtgtttttacctatgaaattattctggatctaataggacattttacaaaatggcaagtatggaaaaccatggattctgaaagttaaaaatttagttgttctccccaatgtgtattttaatttggatggcagtctcatgcagattttttaaaagattctttaataacatgatttgtttgcctttctagatttctttatctttctgaccagcaacttagg

SEQ ID NO: 20304 - DNA, 1963 bp, Homo sapiens
  ENST00000510741
gcatttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagaggattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacctgggtcttaaggatttaggaaaaatatgcatgctttaattgcatttccaaagtagcatcttgctagacctagttgagtcaggataacagagagataccacatggcaagaaaaacaaagtgacaattgtagagtcctcaattgtgtttacattaatagtggtgtttttacctatgaaattattctggatctaataggacattttacaaaatggcaagtatggaaaaccatggattctgaaagttaaaaatttagttgttctccccaatgtgtattttaatttggatggcagtctcatgcagattttttaaaagattctttaataacatgatttgtttgcc

SEQ ID NO: 20305 - DNA, 2180 bp, Homo sapiens
  ENST00000502330
cgcgccgggcgcagggagctgagtggacggctcgagacggcggcgcgtgcagcagctccagaaagcagcgagttggcagagcagggctgcatttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgaagtagaggatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacctgggtcttaaggatttaggaaaaatatgcatgctttaattgcatttccaaagtagcatcttgctagacctagttgagtcaggataacagagagataccacatggcaagaaaaacaaagtgacaattgtagagtcctcaattgtgtttacattaatagtggtgtttttacctatgaaattattctggatctaataggacattttacaaaatggcaagtatggaaaaccatggattctgaaagttaaaaatttagttgttctccccaatgtgtattttaatttggatggcagtctcatgcagattttttaaaagattctttaataacatgatttgtttgcc

SEQ ID NO: 20306 - DNA, 1700 bp, Homo sapiens
  ENST00000511905
gtgcccgctcgggctgctgcggctggggcttgcttccttatacccacctctcctcctctgggtctgcgtgtgtatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcagggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacctgggtcttaaggatttaggaaaaatatgcatgctttaattgca

SEQ ID NO: 20307 - DNA, 1457 bp, Homo sapiens
  ENST00000512681
tttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagactgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacct

SEQ ID NO: 20308 - DNA, 1768 bp, Homo sapiens
  ENST00000511269
gctaatgcatgttttccagggtcgctcctggcttcgtaccccttatttgacactgacatgcccccccaccccccgttgtgtctcctctcccagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaattt

SEQ ID NO: 20309 - DNA, 1510 bp, Homo sapiens
  ENST00000507370
atttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgctt

SEQ ID NO: 20310 - DNA, 1749 bp, Homo sapiens
  ENST00000502821
atttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagactaagaagaaaaacgattatttgacaggacagtagtgatgatcacacaagatcacatccacatgtcttctgggctcagtcaggatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtg

SEQ ID NO: 20311 - DNA, 1588 bp, Homo sapiens
  ENST00000505187
gcatttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaac

SEQ ID NO: 20312 - DNA, 1456 bp, Homo sapiens
  ENST00000512648
ctcgagacggcggcgcgtgcagcagctccagaaagcagcgagttggcagagcagggctgcatttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaaggtaaaagatgagacccttacagacgcaaatagttgacctgcatgtcaaattttacttattttttaagaaaataaaacagtacactatgctcattcattttgtgtatgtttttgtaattcaagtgttgaataaaagagcaaataagaagcatgttgaacaaataactctgccagagatacaacacatgctaaataagatgaaaaatagtaattaatattttgtattaatgccactacattatagtttccattatgagccaccaagaagcacacagaaatattaagaacttagatactgaaagtaatcattaaaattaatttgctatctgctttgcccacaatgtaaaataaatggattttttatcactatacggtggagttttaatgttctattttgtgatcttattaaatgagttgaatgaa

SEQ ID NO: 20313 - DNA, 563 bp, Homo sapiens
  ENST00000510403
gcatttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcaggcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacac

SEQ ID NO: 20314 - DNA, 565 bp, Homo sapiens
  ENST00000515143
aattttctggatgataaacaatggctcaccacaatctctcagtatgacaaggaagtcggacagtggaacaaattccgagacgatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattgga

SEQ ID NO: 20315 - DNA, 565 bp, Homo sapiens
  ENST00000511226
gtgcccgctcgggctgctgcggctggggcttgcttccttatacccacctctcctcctctgggtctgcgtgtgtatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcagggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagt

SEQ ID NO: 20316 - DNA, 1032 bp, Homo sapiens
  ENST00000507086
gagtggacggctcgagacggcggcgcgtgcagcagctccagaaagcagcgagttggcagagcagggctgcatttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgaagtagaggatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacagtgcaaactagaatatcaggcatgtgtcttaggaaaacagatctcagtcaaatgtgaaggacattgcccatgtccttcagataagcccaccagtacaagcagaaatgttaagagagtactctgagtgctatggaaccctatcaagaaacaaagtttatttcattattgtgctatgattataagttaactgatttaaggaaaaagtattattgattaagaattaatgtatgccattttccaagtgacaaataatttagttttaacgtttaattttgtatgatggaatttttttatatcctctgaattatggaatggattttcaatgagaaacagattaacatcagtgtattaatatactcttgcaacatgcatgcttctccgtaactaatatagtgtattcataaatggtaagttcttctgtaattttgtttaattggagccatggaaaaataaaattaagtcagtttattggcaagtgttgcataattatttataataaaaattaagttttactcatttggattatttgaaatacattcttggattaaattaatgtgtctg

SEQ ID NO: 20317 - DNA, 1032 bp, Homo sapiens; identical to SEQ ID NO: 20316
  ENST00000502741

SEQ ID NO: 20318 - DNA, 556 bp, Homo sapiens
  ENST00000509854
gtgcccgctcgggctgctgcggctggggcttgcttccttatacccacctctcctcctctgggtctgcgtgtgtatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaacta

SEQ ID NO: 20319 - DNA, 524 bp, Homo sapiens
  ENST00000515316
atttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcaggctctctccttccacgatttggggatttttgtgtgatgtgaatattgccataactgccttcctttggattagtacttgccagctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattat

SEQ ID NO: 20320 - DNA, 505 bp, Homo sapiens
  ENST00000506697
gtaaagcctgcggggaggggacacgcttgcctctgcttgtctcctcctccctctaccctcgtcgttgctaatgcatgttttccagggtcgctcctggcttcgtaccccttatttgacactgacatgcccccccaccccccgttgtgtctcctctcccagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgaagtagaggatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccgga

SEQ ID NO: 20321 - DNA, 505 bp, Homo sapiens; identical to SEQ ID NO: 20320
  ENST00000512042

SEQ ID NO: 20322 - DNA, 3061 bp, Homo sapiens
  ENST00000421836
ggggggagcgcgccgggcgcagggagctgagtggacggctcgagacggcggcgcgtgcagcagctccagaaagcagcgagttggcagagcagggctgcatttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagactaagaagaaaaacgattatttgacaggacagtagtgatgatcacacaagatcacatccacatgtcttctgggctcagtcaggatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacctgggtcttaaggatttaggaaaaatatgcatgctttaattgcatttccaaagtagcatcttgctagacctagttgagtcaggataacagagagataccacatggcaagaaaaacaaagtgacaattgtagagtcctcaattgtgtttacattaatagtggtgtttttacctatgaaattattctggatctaataggacattttacaaaatggcaagtatggaaaaccatggattctgaaagttaaaaatttagttgttctccccaatgtgtattttaatttggatggcagtctcatgcagattttttaaaagattctttaataacatgatttgtttgcctttctagatttctttatctttctgaccagcaacttagggagcagaatttaaattaggaagacaaagggaaagattcatttaaaccatatttttacaaagtttgtcatttgccccaaggtcaaattttaaattcttaattttcattttatttcccattttaggtaaaagtttgcatttaatcttagaattatgttatttttgttagtagtgtggaaacttagagaacttattgtatggtgccttgcaaaaatagagatagaaagattttagcatgcataccaatatagtatattacgcaatatataagcacacctaattaacagattaatatcagtaaaggtattgctgctggaatgaagaaaatgggatacgtttgtttctttttttctattgttacataattgccatgtggacttgtttatgattattgtgtagagtagcatttaagatttaactgtagcaaaaattactttaaccgctgtatttaagttagcatgttaattaattgtgtagacattttggcacaccatcacttttaactatatcataccaatggttttgtgcccataataaaaatggaaaaacctgttgaatgttacgtattggtatctttaatttcaacagtgggtaaactggtttcccagtatacaattcattgaaagcaaaattgattaattatttccatttaatttatacacactcaatacaaaatttaatgttgactttacgtaataaagtataatgcattttcttttttactgtttatgtatagtttacaaaataaagaatcttgtaaccaaa

SEQ ID NO: 20323 - DNA, 2797 bp, Homo sapiens
  ENST00000541354
gtgcccgctcgggctgctgcggctggggcttgcttccttatacccacctctcctcctctgggtctgcgtgtgtatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcagggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacctgggtcttaaggatttaggaaaaatatgcatgctttaattgcatttccaaagtagcatcttgctagacctagttgagtcaggataacagagagataccacatggcaagaaaaacaaagtgacaattgtagagtcctcaattgtgtttacattaatagtggtgtttttacctatgaaattattctggatctaataggacattttacaaaatggcaagtatggaaaaccatggattctgaaagttaaaaatttagttgttctccccaatgtgtattttaatttggatggcagtctcatgcagattttttaaaagattctttaataacatgatttgtttgcctttctagatttctttatctttctgaccagcaacttagggagcagaatttaaattaggaagacaaagggaaagattcatttaaaccatatttttacaaagtttgtcatttgccccaaggtcaaattttaaattcttaattttcattttatttcccattttaggtaaaagtttgcatttaatcttagaattatgttatttttgttagtagtgtggaaacttagagaacttattgtatggtgccttgcaaaaatagagatagaaagattttagcatgcataccaatatagtatattacgcaatatataagcacacctaattaacagattaatatcagtaaaggtattgctgctggaatgaagaaaatgggatacgtttgtttctttttttctattgttacataattgccatgtggacttgtttatgattattgtgtagagtagcatttaagatttaactgtagcaaaaattactttaaccgctgtatttaagttagcatgttaattaattgtgtagacattttggcacaccatcacttttaactatatcataccaatggttttgtgcccataataaaaatggaaaaacctgttgaatgttacgtattggtatctttaatttcaacagtgggtaaactggtttcccagtatacaattcattgaaagcaaaattgattaattatttccatttaatttatacacactcaatacaaaatttaatgttgactttacgtaataaagtataatgcattttcttttttactgtttatgtatagtttacaaaataaagaatcttgtaaccaaa

SEQ ID NO: 20324 - DNA, 4837 bp, Homo sapiens
  ENST00000576479
gcgctgctctcgttcgcttggctcagctcagctcagctcagcgcagctccgcggccgccaagccgaggcgggcacggtctccgagtcgcggacgccagctccgagctccctctctccgccgcgcctccgccaggtcgcgccttcgtcgggaccacttcgggcaggagtcgcgtggcgaaggcctgcggccgcggcacaaagttgggggccgcgaagatgaggctgtccccggcgcccctgaagctgagccggactccggcactgctggccctggcgctgcccctggccgcggcgctggccttctccgacgagaccctggacaaagtgcccaagtcagagggctactgcagccgtatcctgcgcgcccagggcacgcggcgcgagggctacaccgagttcagcctccgcgtggagggcgaccccgacttctacaagccgggaaccagctaccgcgtaacactttcagctgctcctccctcctacttcagaggattcacattaattgccctcagagagaacagagagggtgataaggaagaagaccatgctgggaccttccagatcatagacgaagaagaaactcagtttatgagcaattgccctgttgcagtcactgaaagcactccacggaggaggacccggatccaggtgttttggatagcaccaccagcgggaacaggctgcgtgattctgaaggccagcatcgtacaaaaacgcattatttattttcaagatgagggctctctgaccaagaaactttgtgaacaagattccacatttgatggggtgactgacaaacccatcttagactgctgtgcctgcggaactgccaagtacagactcacattttatgggaattggtccgagaagacacacccaaaggattaccctcgtcgggccaaccactggtctgcgatcatcggaggatcccactccaagaattatgtactgtgggaatatggaggatatgccagcgaaggcgtcaaacaagttgcagaattgggctcacccgtgaaaatggaggaagaaattcgacaacagagtgatgaggtcctcaccgtcatcaaagccaaagcccaatggccagcctggcagcctctcaacgtgagagcagcaccttcagctgaattttccgtggacagaacgcgccatttaatgtccttcctgaccatgatgggccctagtcccgactggaacgtaggcttatctgcagaagatctgtgcaccaaggaatgtggctgggtccagaaggtggtgcaagacctgattccctgggacgctggcaccgacagcggggtgacctatgagtcacccaacaaacccaccattccccaggagaaaatccggcccctgaccagcctggaccatcctcagagtcctttctatgacccagagggtgggtccatcactcaagtagccagagttgtcatcgagagaatcgcacggaagggtgaacaatgcaatattgtacctgacaatgtcgatgatattgtagctgacctggctccagaagagaaagatgaagatgacacccctgaaacctgcatctactccaactggtccccatggtccgcctgcagctcctccacctgtgacaaaggcaagaggatgcgacagcgcatgctgaaagcacagctggacctcagcgtcccctgccctgacacccaggacttccagccctgcatgggccctggctgcagtgacgaagacggctccacctgcaccatgtccgagtggatcacctggtcgccctgcagcatctcctgcggcatgggcatgaggtcccgggagaggtatgtgaagcagttcccggaggacggctccgtgtgcacgctgcccactgaggaaacggagaagtgcacggtcaacgaggagtgctctcccagcagctgcctgatgaccgagtggggcgagtgggacgagtgcagcgccacctgcggcatgggcatgaagaagcggcaccgcatgatcaagatgaaccccgcagatggctccatgtgcaaagccgagacatcacaggcagagaagtgcatgatgccagagtgccacaccatcccatgcttgctgtccccatggtccgagtggagtgactgcagcgtgacctgcgggaagggcatgcgaacccgacagcggatgctcaagtctctggcagaacttggagactgcaatgaggatctggagcaggtggagaagtgcatgctccctgaatgccccattgactgtgagctcaccgagtggtcccagtggtcggaatgtaacaagtcatgtgggaaaggccacgtgattcgaacccggatgatccaaatggagcctcagtttggaggtgcaccctgcccagagactgtgcagcgaaaaaagtgccgcatccgaaaatgccttcgaaatccatccatccaaaagctacgctggagggaggcccgagagagccggcggagtgagcagctgaaggaagagtctgaaggggagcagttcccaggttgtaggatgcgcccatggacggcctggtcagaatgcaccaaactgtgcggaggtggaattcaggaacgttacatgactgtaaagaagagattcaaaagctcccagtttaccagctgcaaagacaagaaggagatcagagcatgcaatgttcatccttgttagcaagggtacgagttccccagggctgcactctagattccagagtcaccaatggctggattatttgcttgtttaagacaatttaaattgtgtacgctagttttcatttttgcagtgtggttcgcccagtagtcttgtggatgccagagacatcctttctgaatacttcttgatgggtacaggctgagtggggcgccctcacctccagccagcctcttcctgcagaggagtagtgtcagccaccttgtactaagctgaaacatgtccctctggagcttccacctggccagggaggacggagactttgacctactccacatggagaggcaaccatgtctggaagtgactatgcctgagtcccagggtgcggcaggtaggaaacattcacagatgaagacagcagattccccacattctcatctttggcctgttcaatgaaaccattgtttgcccatctcttcttagtggaactttaggtctcttttcaagtctcctcagtcatcaatagttcctggggaaaaacagagctggtagacttgaagaggagcattgatgttgggtggcttttgttctttcactgagaaattcggaatacatttgtctcacccctgatattggttcctgatgcccccccaacaaaaataaataaataaattatggctgctttatttaaatataaggtagctagtttttacacctgagataaataataagcttagagtgtatttttcccttgcttttgggggttcagaggagtatgtacaattcttctgggaagccagccttctgaactttttggtactaaatccttattggaaccaagacaaaggaagcaaaattggtctctttagagaccaatttgcctaaattttaaaatcttcctacacacatctagacgttcaagtttgcaaatcagtttttagcaagaaaacatttttgctatacaaacattttgctaagtctgcccaaagcccccccaatgcattccttcaacaaaatacaatctctgtactttaaagttattttagtcatgaaattttatatgcagagagaaaaagttaccgagacagaaaacaaatctaagggaaaggaatattatgggattaagctgagcaagcaattctggtggaaagtcaaacctgtcagtgctccacaccagggctgtggtcctcccagacatgcataggaatggccacaggtttacactgccttcccagcaattataagcacaccagattcagggagactgaccaccaagggatagtgtaaaaggacattttctcagttgggtccatcagcagtttttcttcctgcatttattgttgaaaactattgtttcatttcttcttttataggccttattactgcttaatccaaatgtgtaccattggtgagacacatacaatgctctgaatacactacgaatttgtattaaacacatcagaatatttccaaatacaacatagtatagtcctgaatatgtacttttaacacaagagagactattcaataaaaactcactgggtctttcatgtctttaagctaagtaagtgttcagaaggttcttttttatattgtcctccacctccatcattttcaataaaagatagggcttttgctcccttgttcttggagggaccattattacatctctgaactacctttgtatccaacatgttttaaatccttaaatgaattgctttctcccaaaaaaagcacaatataaagaaacacaagatttaattatttttctacttggggggaaaaaagtcctcatgtagaagcacccacttttgcaatgttgttctaagctatctatctaactctcagcccatgataaagttccttaagctggtgattcctaatcaaggacaagccaccctagtgtctcatgtttgtatttggtcccagttgggtacattttaaaatcctgattttggagacttaaaaccaggttaatggctaagaatgggtaacatgactcttgttggattgttattttttgtttgcaatggggaatttataagaagcatcaagtctctttcttaccaaagtcttgttaggtggtttatagttcttttggctaacaaatcattttggaaataaagattttttactacaaaaatgaaatttgtttggacttccacttgagacagtaaagagagtattagacacccagtaaaaactgccatataaagaa

SEQ ID NO: 20325 - DNA, 1005 bp, Homo sapiens
  ENST00000591785
ctgaaagtcctccaaagccttcttgagtcatagagggagcatagaatgggtgatgacctggcaccaatcctgcctctgctgcttaccaaccacacgggctgaagtcagcctgcctctttggagcctcagtttcttcttctgtaaaatagcatgacacagcacctgctttgcatccctcataggcttgttgagatgttcaaaggagagcgtgaccatatcttgtttcagacatgtgatacactcatgcccatctgtgtcttgccagccattgactgtgagctcaccgagtggtcccagtggtcggaatgtaacaagtcatgtgggaaaggccacgtgattcgaacccggatgatccaaatggagcctcagtttggaggtgcaccctgcccagagactgtgcagcgaaaaaagtgccgcatccgaaaatgccttcgaaatccatccatccaaaagctacgctggagggaggcccgagagagccggcggagtgagcagctgaaggaagagtctgaaggggagcagttcccaggttgtaggatgcgcccatggacggcctggtcagaatgcaccaaactgtgcggaggtggaattcaggaacgttacatgactgtaaagaagagattcaaaagctcccagtttaccagctgcaaagacaagaaggagatcagagcatgcaatgttcatccttgttagcaagggtacgagttccccagggctgcactctagattccagagtcaccaatggctggattatttgcttgtttaagacaatttaaattgtgtacgctagttttcatttttgcagtgtggttcgcccagtagtcttgtggatgccagagacatcctttctgaatacttcttgatgggtacaggctgagtggggcgccctcacctccagccagcctcttcctgcagaggagtagtgtcagccaccttgtactaagctgaaacatgtccctctggagcttccacctggccagggaggacggagactttgacctactc

SEQ ID NO: 20326 - DNA, 1869 bp, Homo sapiens
  ENST00000290902
gacagggaggggaggggagggataggacagacagacaaagaaaggggtgcggcagcactgccaggggaagagggtgatccgacccggggaaggtcgctgggcagggcgagttgggaaagcggcagcccccgccgcccccgcagccccttctcctcctttctcccacgtcctatctgcctctcgctggaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgccgccggccagcctcttgggggagagtccatctgttccgccagagccctggccaaatacagcatcaccttcacgggcaagtggagccagacggccttccccaagcagtaccccctgttccgcccccctgcgcagtggtcttcgctgctgggggccgcgcatagctccgactacagcatgtggaggaagaaccagtacgtcagtaacgggctgcgcgactttgcggagcgcggcgaggcctgggcgctgatgaaggagatcgaggcggcgggggaggcgctgcagagcgtgcacgcggtgttttcggcgcccgccgtccccagcggcaccgggcagacgtcggcggagctggaggtgcagcgcaggcactcgctggtctcgtttgtggtgcgcatcgtgcccagccccgactggttcgtgggcgtggacagcctggacctgtgcgacggggaccgttggcgggaacaggcggcgctggacctgtacccctacgacgccgggacggacagcggcttcaccttctcctcccccaacttcgccaccatcccgcaggacacggtgaccgagataacgtcctcctctcccagccacccggccaactccttctactacccgcggctgaaggccctgcctcccatcgccagggtgacactggtgcggctgcgacagagccccagggccttcatccctcccgccccagtcctgcccagcagggacaatgagattgtagacagcgcctcagttccagaaacgccgctggactgcgaggtctccctgtggtcgtcctggggactgtgcggaggccactgtgggaggctcgggaccaagagcaggactcgctacgtccgggtccagcccgccaacaacgggagcccctgccccgagctcgaagaagaggctgagtgcgtccctgataactgcgtctaagaccagagccccgcagcccctggggccccccggagccatggggtgtcgggggctcctgtgcaggctcatgctgcaggcggccgagggcacagggggtttcgcgctgctcctgaccgcggtgaggccgcgccgaccatctctgcactgaagggccctctggtggccggcacgggcattgggaaacagcctcctcctttcccaaccttgcttcttaggggcccccgtgtcccgtctgctctcagcctcctcctcctgcaggataaagtcatccccaaggctccagctactctaaattatgtctccttataagttattgctgctccaggagattgtccttcatcgtccaggggcctggctcccacgtggttgcagatacctcagacctggtgctctaggctgtgctgagcccactctcccgagggcgcatccaagcgggggccacttgagaagtgaataaatggggcggtttcggaagcgtcagtgtttccatgttatggatctctctgcgtttgaataaagactatctctgttgctcacaaa

SEQ ID NO: 20327 - DNA, 886 bp, Homo sapiens
  ENST00000509697
gccgggacggacagcggcttcaccttctcctcccccaacttcgccaccatcccgcaggacacggtgaccgagataacgtcctcctctcccagccacccggccaactccttctactacccgcggctgaaggccctgcctcccatcgccagggtgacactggtgcggctgcgacagagccccagggccttcatccctcccgccccagtcctgcccagcagggacaatgagattgtagacagcgcctcaggtaacggacatacaggtcacatgggacacacagcagccccgaaccctgccacagggcgaccaccaaacccgaacctaaggctctgagaaattccaagtagggattcgtagtgcgtactgcaagatggtgcctagaagatttaggattctgttgattcacacactgaagatgtgactcttgcacattatttgcagttgaaagcatcttacagggccacagcccagaggaaagaatgaaaggaggctccagacagtacctgagagactctgtcctgtcagacacgcacccacaggtgacctgtgtgtcacagctgacaaggaagcttgctaggatggccctgtgtggccaccgggtgacagctatgctgcagggcacctgtgggggtctcgggacccagccaccacacagctcggggctctgctcacaggcgccttggcctggggcggggcaggtgctgatgagcattctcctagctcttccaggcacctgctggacagggcaggctgggaacgctggggccgagtggcagttccctccctactcagctgggtggcagccactggcctcacggagcgcctgtggtctggagcgcattgctgggtcgtgggtcagggcctgttggctctgggtctctgggtc

SEQ ID NO: 20328 - DNA, 525 bp, Homo sapiens
  ENST00000507466
agggtgtcacggtccgacgtgactgggggccatggttccctgcgggcggcggggagggatttcctggggcgccccctggaatccaagcccgaccgcagtgtctgaccatggtccgcggcgcggccgggtggtcctgcaggggccgcgcatagctccgactacagcatgtggaggaagaaccagtacgtcagtaacgggctgcgcgactttgcggagcgcggcgaggcctgggcgctgatgaaggagatcgaggcggcgggggaggcgctgcagagcgtgcacgcggtgttttcggcgcccgccgtccccagcggcaccgggcagacgtcggcggagctggaggtgcagcgcaggcactcgctggtctcgtttgtggtgcgcatcgtgcccagccccgactggttcgtgggcgtggacagcctggacctgtgcgacggggaccgttggcgggaacaggcggcgctggacctgtacccctacgacgccgggacggacagcggcttcaccttctcctcccccaacttc

SEQ ID NO: 20329 - DNA, 597 bp, Homo sapiens
  ENST00000503765
gatgcctgcgccgggagccaggagcttccccagccacttccagcatgtagactgaagtcaggccacgcacagggctctccaggtcacaccctgcgcaagaaggtgtagcacgctggctctaatttcgagaaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgccgccggccagcctcttgggggagagtccatctgttccgccagagccctggccaaatacagcatcaccttcacgggcaagtggagccagacggccttccccaagcagtaccccctgttccgcccccctgcgcagtggtcttcgctgctgggggccgcgcatagctccgactacagcatgtggaggaagaaccagtacgtcagtaacgggctgcgcgactttgcggagcgcggcgaggcctgggcgctgatgaagga

SEQ ID NO: 20330 - DNA, 551 bp, Homo sapiens
  ENST00000504909
gttacccctggtcgctcgcaggcgcacgggcgatctaaccccgcgccgtccattccgctgatgggggtctcggaagcaccgcaggagagctttgcggagcagggagggggtcgcgggtgctcggggccgtcctcagagcccaaagtgccgcagccctctcggctttccaccccgaggctgccacgacggtgccagcgcgcggctgctcccctctgtgctcccaggtgatggaaaaccccagcccggccgccgccctgggcaaggccctctgcgctctcctcctggccactctcggcgccgccggccagcctcttgggggagagtccatctgttccgccagagccctggccaaatacagcatcaccttcacgggcaagtggagccagacggccttccccaagcagtaccccctgttccgcccccctgcgcagtggtcttcgctgctgggggccgcgcatagctccgactacagcatgtggaggaagaaccagtacgtcagtaacgggctgcgcgactttgcggagcgcggcgaggcctgggcgctgatgaag

SEQ ID NO: 20331 - DNA, 851 bp, Homo sapiens
  ENST00000512888
agacagacaaagaaaggggtgcggcagcactgccaggggaagagggtgatccgacccggggaaggtcgctgggcagggcgagttgggaaagcggcagcccccgccgcccccgcagccccttctcctcctttctcccacgtcctatctgcctctcgctggaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgccgccggccagcctcttgggggagagtccatctgttccgccagagccctggccaaatacagcatcaccttcacgggcaagtggagccagacggccttccccaagcagtaccccctgttccgcccccctgcgcagtggtcttcgctgctgggtaagtacagccccctcctcgcctcctgctccaccaggagggctgcggcgccggagccccccgcacagctgcacggcggcgcttcccagtctggggcgtgctgacgtcgggagactctaacaccagaatgtttgccgagcgcctgcggtgtgcggttccggggatgcggtgggggcagggggcgctcacggggagggcgcaggtgggtcgcggcaggggcagccacagggtgtcacggtccgacgtgactgggggccatggttccctgcgggcggcggggagggatttcctggggcgccccctggaatccaagcccgaccgcagtg

SEQ ID NO: 20332 - DNA, 505 bp, Homo sapiens
  ENST00000512150
cacaccctgcgcaagaaggtgtagcacgctggctctaatttcgagaaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgccgccggccagcctcttgggggagagtccatctgttccgccagagccctggccaaatacagcatcaccttcacgggcaagtggagccagacggccttccccaagcagtaccccctgttccgcccccctgcgcagtggtcttcgctgctgggtaagtacagccccctcctcgcctcctgctccaccaggagggctgcggcgccggagccccccgcacagctgcacggcggcgcttcccagtctggggcg

SEQ ID NO: 20333 - DNA, 571 bp, Homo sapiens
  ENST00000515004
ctgagccgccggctgcggggttggagccgccggctgcggggttggagccgccggctgcggggttggagacgccggctgcggggttggagccgccggctgcggggttggagccgccggctgcggggttggaaccgccggctgtgagtttcctcactgcttggaggaagatgagaattctcagaggtccttatgctgccctttttgctgcagtcttgacatcttaacgtggatagaaaaaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgccgccggccagcctcttgggggagagtccatctgttccgccagagccctggccaaatacagcatcaccttcacgggcaagtggagccagacggccttccccaagcagtaccccctgttccgcc

SEQ ID NO: 20334 - DNA, 571 bp, Homo sapiens
  ENST00000502483
gagccctgagccgccggctgcggggttggagccgccggctgcggggttggagccgccggctgcggggttggagacgccggctgcggggttggagccgccggctgcggggttggagccgccggctgcggggttggaaccgccggctgtgagtttcctcactgcttggaggaagatgagaattctcagaggtccttatgctgccctttttgctgcagtcttgacatcttaacgtggatagaaaaaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgccgccggccagcctcttgggggagagtccatctgttccgccagagccctggccaaatacagcatcaccttcacgggcaagtggagccagacggccttccccaagcagtacccc

SEQ ID NO: 20335 - DNA, 307 bp, Homo sapiens
  ENST00000514490
agcatgtagactgaagtcaggccacgcacagggctctccaggtcacaccctgcgcaagaaggtgtagcacgctggctctaatttcgagaaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgcc

SEQ ID NO: 20336 - DNA, 549 bp, Homo sapiens
  ENST00000509233
agagaaacccaagagcagctgcatgagccctcccaggcctacccccgcagccggcactccctgcagcaaagaaaaccatctggccactgggccctgagcccggcgcccggaggaggacctctgccccgctgagcagctctgctccccaggctggccctgggcctctcgcggcctgacccgctccccttggcatcaagcaccaggagggacggggtggcccggccagggcgtgggtgttccccggcccctctgagcaccagcacctgtttcctcactgcttggaggaagatgagaattctcagaggtccttatgctgccctttttgctgcagtcttgacatcttaacgtggatagaaaaaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctct

SEQ ID NO: 20337 - DNA, 556 bp, Homo sapiens
  ENST00000511679
gtgtgtttgtgaactggcgatgtgatcgagggcacgggtgctgggcttccccctcatgggtaaaaccagagctactgtatgccagccgtggaggcatggacggcccctgagctcggacagcagacggacagaccgttgacgcgttggcaccgtggccagagtccgttcaagaaaggtcggcagagagggctgagaacgcggcaggcacatcctccaagggccctgctggaacccctggagcaggaggaagcggtgattctccaggccttggtttcctcactgcttggaggaagatgagaattctcagaggtccttatgctgccctttttgctgcagtcttgacatcttaacgtggatagaaaaaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgc

SEQ ID NO: 20338 - DNA, 557 bp, Homo sapiens
  ENST00000511672
aagagccccgggaagagctgcatgcacacggctggagagaggctctgcacccgagcacagcctgctgcgactcctcatagacccggaaaactgattagaaggcagagggcctcctccctccctgcgtggtttgggggctgttcctgatagcacagatgccctgatcacaaacacctgcctgcattgctgaccacaggcctggcctggagaaacccacagcctcttcagggaagcgagcaaggggcttggaagtgcctgaagccagtgggctggggactcacggccgggacactcagggcagtttcctcactgcttggaggaagatgagaattctcagaggtccttatgctgccctttttgctgcagtcttgacatcttaacgtggatagaaaaaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgc

SEQ ID NO: 20339 - DNA, 462 bp, Homo sapiens
  ENST00000506266
gtgaactggcgatgtgatcgagggcacgggtgctgggcttccccctcatgggtaaaaccagagctactgtatgccagccgtggaggcatggacggcccctgagctcggacagcagacggacagaccgttgacgcgttggcaccgtggccagagtccgttcaagaaaggtcggcagagagggctgagaacgcggcaggcacatcctccaagggccctgctggaacccctggagcaggaggaagcggtgattctccaggccttggtttcctcactgcttggaggaagatgagaattctcagaggtccttatgctgccctttttgctgcagtcttgacatcttaacgtggatagaaaaaggccgtgcagcatcgaagacaggaggaactggagcctcattggccggcccggggcgccggcctcgggcttaaataggagctccgggctctggctgggacccgaccg

SEQ ID NO: 20340 - DNA, 581 bp, Homo sapiens
  ENST00000504871
agtccctctggggtggcccaagcagggcacagggcagggagccaggctcttcggggccccaccccaggctggccctgcaccccatcctgccttctctccccactgtgggcccagaacttgccccgtgggggccgggaagcacccaccatccccacccctagctgctctcagccagagcccagctggacttgcaggattgattttccagcaaaaaacaacagcagagaaacccaagagcagctgcatgagccctcccaggcctacccccgcagccggcactccctgcagcaaagaaaaccatctggccactgggccctgagcccggcgcccggaggaggacctctgccccgctgagcagctctgctccccaggctggccctgggcctctcgcggcctgacccgctccccttggcatcaagcaccaggagggacggggtggcccggccagggcgtgggtgttccccggcccctctgagcaccagcacctggccgtgcagcatcgaagacaggaggaactggagcctcattggccggcccggggcgccggcctcgggcttaaataggagctccgggctctggct

SEQ ID NO: 20341 - DNA, 559 bp, Homo sapiens
  ENST00000502657
gatgtgatcgagggcacgggtgctgggcttccccctcatgggtaaaaccagagctactgtatgccagccgtggaggcatggacggcccctgagctcggacagcagacggacagaccgttgacgcgttggcaccgtggccagagtccgttcaagaaaggtcggcagagagggctgagaacgcggcaggcacatcctccaagggccctgctggaacccctggagcaggaggaagcggtgattctccaggccttggacctaattatggagagagagacacggagggagctcctgtgaccctcaagtcccctcatcatgtccccgtcctgttggctttccgagtttagctcccatgtttggaccatggaggtttatgtcttctatctcagtcatcgtccctgccacatgcccaaccagacatgctgacatcacaggccctacttagccctgtttcctctccccttggcctcaccttgatgtcaggggggtgtcctctggtctgactcagaggcagtgactggcttccttctagtaccttctctggataatgagtatggatgac

SEQ ID NO: 20342 - DNA, 1736 bp, Homo sapiens
  ENST00000400762
ggttctgacactgagggctccggggcaggggcagggcccgctggcttggcgtgcgcgtgcgtgcacaggtgtgtgggtgtctgcctggtgggcgggcggcgtgtgcgtgtgcgcatgtgtgtttgtgaactggcgatgtgatcgagggcacgggtgctgggcttccccctcatgggtaaaaccagagctactgtatgccagccgtggaggcatggacggcccctgagctcggacagcagacggacagaccgttgacgcgttggcaccgtggccagagtccgttcaagaaaggtcggcagagagggctgagaacgcggcaggcacatcctccaagggccctgctggaacccctggagcaggaggaagcggtgattctccaggccttggccacagggacaggccaggcctcacagccaagagccccgggaagagctgcatgcacacggctggagagaggctctgcacccgagcacagcctgctgcgactcctcatagacccggaaaactgattagaaggcagagggcctcctccctccctgcgtggtttgggggctgttcctgatagcacagatgccctgatcacaaacacctgcctgcattgctgaccacaggcctggcctggagaaacccacagcctcttcagggaagcgagcaaggggcttggaagtgcctgaagccagtgggctggggactcacggccgggacactcagggcaggccgtgcgccgtttctcctggaataactggaggtgatttcatggaacctggaggctgggcttcaggctggggggagaggctccagactgggtcttctccgtggctctgccccccgctctccttgcttgagtggtgggggccctgcatcctctcatgcccacccccacctttctcgccaaattgtcggaggcttttgtcacctggagacactgttcctgccagctccggtcttggaaaacatggcctctcctctcctgccctggccccggcccctcctgccagctggacgtgggcatttctgcacccagtagaaccccacagccaggaaagatgcctggaaggctagagaagaggcgtgatggggggaccccatgtgtggcgacagagcagcacacccagctattctcagccaccatgtgggagagaaatgacgcctctgtcgagctccccatggccggagctgctccatacagcatcctaaccttcacccccaactactcagttgccatggcaaagggaatattttgactccctttttttaaaatttccaggtgattattgctagaggagtgggaagttactaatttttgtatatttatcttgtattaaaatgtttttactgatttttaattttaattttaatattttttgagatggagtttcactcttctggcctaggctggagtgcagtggtgtgatttcggctcgctgcaacctccacccatgggttcaagcgattctcgtgcctcagacccccgagtagctgggattacaggcatgcaccaccacgcccggctaattttgtgtttttagtagagacaggatttcactatgttggtcaggctggtctcgaactcctgatctcaggtgatctgcccaccttggcctcccaaagtgctgggattacaggcgtgagccaccgcacctggcctgatttttaatttttaaatgagggagcagaggcataactaggtttacaatcatgtcatcaacaaaataaattgtcttatttttctgata

SEQ ID NO: 20343 - DNA, 520 bp, Homo sapiens
  ENST00000505653
cccacagcctcttcagggaagcgagcaaggggcttggaagtgcctgaagccagtgggctggggactcacggccgggacactcagggccgtgcgccgtttctcctggaataactggaggtgatttcatggaacctggaggctgggcttcaggctggggggagaggctccagactgggtcttctccgtggctctgccccccgctctccttgcttgagtggtgggggccctgcatcctctcatgcccacccccacctttctcgccaaattgtcggaggcttttgtcacctggagacactgttcctgccagctccggtcttggaaaacatggcctctcctctcctgccctggccccggcccctcctgccagctggacgtgggcatttctgcacccagtagaaccccacagccaggaaagatgcctggaaggctagagaagaggcgtgatggggggaccccatgtgtggcgacagagcagcacacccagctattctcagccaccatgtgggagagaaatgacgcc

SEQ ID NO: 20344 - DNA, 234 bp, Homo sapiens
  ENST00000515553
acagccaagagccccgggaagagctgcatgcacacggctggagagaggctctgcacccgagcacagcctgctgcgactcctcatagacccggaaaactgattagaaggcagaggccgtgcgccgtttctcctggaataactggaggtgatttcatggaacctggaggctgggcttcaggctggggggagaggctccagactgggtcttctccgtggctctgccccccgctctcc

SEQ ID NO: 20345 - DNA, 633 bp, Homo sapiens
  ENST00000510542
gggtcgggacagtccctctggggtggcccaagcagggcacagggcagggagccaggctcttcggggccccaccccaggctggccctgcaccccatcctgccttctctccccactgtgggcccagaacttgccccgtgggggccgggaagcacccaccatccccacccctagctgctctcagccagagcccagctggacttgcaggattgattttccagcaaaaaacaacagcagagaaacccaagagcagctgcatgagccctcccaggcctacccccgcagccggcactccctgcagcaaagaaaaccatctggccactgggccctgagcccggcgcccggaggaggacctctgccccgctgagcagctctgctccccaggctggccctgggcctctcgcggcctgacccgctccccttggcatcaagcaccaggagggacggggtggcccggccagggcgtgggtgttccccggcccctctgagcaccagcacctgccacagggacaggccaggcctcacagccaagagccccgggaagagctgcatgcacacggctggagagaggctctgcacccgagcacagcctgctgcgactcctcatagacccggaaaactgattagaaggcagag

SEQ ID NO: 20346 - DNA, 2156 bp, Homo sapiens
  ENST00000617421
ggttctgacactgagggctccggggcaggggcagggcccgctggcttggcgtgcgcgtgcgtgcacaggtgtgtgggtgtctgcctggtgggcgggcggcgtgtgcgtgtgcgcatgtgtgtttgtgaactggcgatgtgatcgagggcacgggtgctgggcttccccctcatgggtaaaaccagagctactgtatgccagccgtggaggcatggacggcccctgagctcggacagcagacggacagaccgttgacgcgttggcaccgtggccagagtccgttcaagaaaggtcggcagagagggctgagaacgcggcaggcacatcctccaagggccctgctggaacccctggagcaggaggaagcggtgattctccaggccttggtttcctcactgcttggaggaagatgagaattctcagaggtccttatgctgccctttttgctgcagtcttgacatcttaacgtggatagaaaaaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgccgccggccagcctcttgggggagagtccatctgttccgccagagccctggccaaatacagcatcaccttcacgggcaagtggagccagacggccttccccaagcagtaccccctgttccgcccccctgcgcagtggtcttcgctgctgggggccgcgcatagctccgactacagcatgtggaggaagaaccagtacgtcagtaacgggctgcgcgactttgcggagcgcggcgaggcctgggcgctgatgaaggagatcgaggcggcgggggaggcgctgcagagcgtgcacgcggtgttttcggcgcccgccgtccccagcggcaccgggcagacgtcggcggagctggaggtgcagcgcaggcactcgctggtctcgtttgtggtgcgcatcgtgcccagccccgactggttcgtgggcgtggacagcctggacctgtgcgacggggaccgttggcgggaacaggcggcgctggacctgtacccctacgacgccgggacggacagcggcttcaccttctcctcccccaacttcgccaccatcccgcaggacacggtgaccgagataacgtcctcctctcccagccacccggccaactccttctactacccgcggctgaaggccctgcctcccatcgccagggtgacactggtgcggctgcgacagagccccagggccttcatccctcccgccccagtcctgcccagcagggacaatgagattgtagacagcgcctcagttccagaaacgccgctggactgcgaggtctccctgtggtcgtcctggggactgtgcggaggccactgtgggaggctcgggaccaagagcaggactcgctacgtccgggtccagcccgccaacaacgggagcccctgccccgagctcgaagaagaggctgagtgcgtccctgataactgcgtctaagaccagagccccgcagcccctggggccccccggagccatggggtgtcgggggctcctgtgcaggctcatgctgcaggcggccgagggcacagggggtttcgcgctgctcctgaccgcggtgaggccgcgccgaccatctctgcactgaagggccctctggtggccggcacgggcattgggaaacagcctcctcctttcccaaccttgcttcttaggggcccccgtgtcccgtctgctctcagcctcctcctcctgcaggataaagtcatccccaaggctccagctactctaaattatgtctccttataagttattgctgctccaggagattgtccttcatcgtccaggggcctggctcccacgtggttgcagatacctcagacctggtgctctaggctgtgctgagcccactctcccgagggcgcatccaagcgggggccacttgagaagtgaataaatggggcggtttcggaagcgtcagtgtttccatgttatggatctctctgcgtttgaataaagactatctctgttgctc

SEQ ID NO: 20347 - DNA, 1802 bp, Homo sapiens
  ENST00000431380
gatgcctgcgccgggagccaggagcttccccagccacttccagcatgtagactgaagtcaggccacgcacagggctctccaggtcacaccctgcgcaagaaggtgtagcacgctggctctaatttcgagaaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgccgccggccagcctcttgggggagagtccatctgttccgccagagccctggccaaatacagcatcaccttcacgggcaagtggagccagacggccttccccaagcagtaccccctgttccgcccccctgcgcagtggtcttcgctgctgggggccgcgcatagctccgactacagcatgtggaggaagaaccagtacgtcagtaacgggctgcgcgactttgcggagcgcggcgaggcctgggcgctgatgaaggagatcgaggcggcgggggaggcgctgcagagcgtgcacgcggtgttttcggcgcccgccgtccccagcggcaccgggcagacgtcggcggagctggaggtgcagcgcaggcactcgctggtctcgtttgtggtgcgcatcgtgcccagccccgactggttcgtgggcgtggacagcctggacctgtgcgacggggaccgttggcgggaacaggcggcgctggacctgtacccctacgacgccgggacggacagcggcttcaccttctcctcccccaacttcgccaccatcccgcaggacacggtgaccgagataacgtcctcctctcccagccacccggccaactccttctactacccgcggctgaaggccctgcctcccatcgccagggtgacactggtgcggctgcgacagagccccagggccttcatccctcccgccccagtcctgcccagcagggacaatgagattgtagacagcgcctcagttccagaaacgccgctggactgcgaggtctccctgtggtcgtcctggggactgtgcggaggccactgtgggaggctcgggaccaagagcaggactcgctacgtccgggtccagcccgccaacaacgggagcccctgccccgagctcgaagaagaggctgagtgcgtccctgataactgcgtctaagaccagagccccgcagcccctggggccccccggagccatggggtgtcgggggctcctgtgcaggctcatgctgcaggcggccgagggcacagggggtttcgcgctgctcctgaccgcggtgaggccgcgccgaccatctctgcactgaagggccctctggtggccggcacgggcattgggaaacagcctcctcctttcccaaccttgcttcttaggggcccccgtgtcccgtctgctctcagcctcctcctcctgcaggataaagtcatccccaaggctccagctactctaaattatgtctccttataagttattgctgctccaggagattgtccttcatcgtccaggggcctggctcccacgtggttgcagatacctcagacctggtgctctaggctgtgctgagcccactctcccgagggcgcatccaagcgggggccacttgagaagtgaataaatggggcggtttcggaagcgtcagtgtttccatgttatggatctctctgcgtttgaataaagactatctctgttgctc

SEQ ID NO: 20348 - DNA, 1581 bp, Homo sapiens
  ENST00000237623
ggatgtctgcagcagcatttaaattctgggagggcttggttgtcagcagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaataagaatttggtggtgtcaattgcttatttgttttcccacggttgtccagcaattaataaaacataaccttttttactgcctatataatgtttttaaa

SEQ ID NO: 20349 - DNA, 1473 bp, Homo sapiens
  ENST00000395080
aattctgggagggcttggttgtcagcagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgt

SEQ ID NO: 20350 - DNA, 557 bp, Homo sapiens
  ENST00000504310
agcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagcactaaagatgtacctacccctccacaacagatgaaactgtgccagccaaacaacaaatgggcattgtccccagaagcttggacaaaaaggcacacagagttcaattccagttgaacagaataaaggccaaaatagagctgccttgggggtcactgcaattagactgcttaatgaagacattaaaagaagtattctgtgttcgtttgtgtgtggaggggtgtgtgtgtctgtttttcaactgatttgaaaatacaggtgttgaatcctaataataaaccagaaaaattaacatctccagagaagatagaggtcatactatttgaggcaagaattagcgtctttttaataaacgaaaatatggc

SEQ ID NO: 20351 - DNA, 719 bp, Homo sapiens
  ENST00000513981
agcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagcactaaagatgtacctacccctccacaacagatgaaactgtgccagccaaacaacaaatgggcattgtccccagaagcttggacaaaaaggcacacagagttcaattccagttgaacagaataaaggccaaaatagagctgccttgggggtcactgcaattagactgcttaatgaagacattaaaagaagtattctgtctttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctg

SEQ ID NO: 20352 - DNA, 760 bp, Homo sapiens
  ENST00000509334
agcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagcactaaagatgtacctacccctccacaacagatgaaactgtgccagccaaacaacaaatgggcattgtccccagaagcttggacaaaaaggcacacagagttcaattccagttgaacagaataaaggccaaaatagagctgccttgggggtcactgcaattagactgcttaatgaagacattaaaagaagtattctgtctttacaacaaatacccagatgctgtggccacatggctaaaccctgacccatctcagaagcagaatctcctagccccacagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgag

SEQ ID NO: 20353 - DNA, 825 bp, Homo sapiens
  ENST00000508233
agcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaag

SEQ ID NO: 20354 - DNA, 1196 bp, Homo sapiens
  ENST00000360804
agcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaaga

SEQ ID NO: 20355 - DNA, 1664 bp, Homo sapiens
  ENST00000509659
gcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagcactaaagatgtacctacccctccacaacagatgaaactgtgccagccaaacaacaaatgggcattgtccccagaagcttggacaaaaaggcacacagagttcaattccagttgaacagaataaaggccaaaatagagctgccttgggggtcactgcaattagactgcttaatgaagacattaaaagaactttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgt

SEQ ID NO: 20356 - DNA, 568 bp, Homo sapiens
  ENST00000508002
agcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagaatgctgtgtcctctgaagaaaccaatgactttaaacaagaggtaagttctcattttcaatcagaggcccatcatgccttgaagagatgaaagaaggcattgcctggattctcttctgatgaaatttcattagcaagttttccagctaattggcagtctaaaacttgctcataaataaaacatgtatttactaaatatcagaaatactaggtttcctcggataagtttagcattacagaagatgtttattaatgcctgttatttgaaacattaatctgcttgcaatttatttaagg

SEQ ID NO: 20357 - DNA, 252 bp, Homo sapiens
  ENST00000505146
aggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacaggtatttttaaacttctcataattaaactacagtgatgaaagatagccacactcaggccattt

SEQ ID NO: 20358 - DNA, 1558 bp, Homo sapiens
  ENST00000614857
ctccctgtgttggtggaggatgtctgcagcagcatttaaattctgggagggcttggttgtcagcagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatatggatgatgaagatgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaataagaatttggtggtgtcaattgcttatttgttttcccacggttgtccagcaattaataaaacataaccttttttactgcct

SEQ ID NO: 20359 - DNA, 1539 bp, Homo sapiens
  ENST00000587013
cgtagaccaccacctctttagaaccttgagaccagtccctgtccctgccccgtcccctcctcatagcattagagaccaatggcgcagatgggtggaaaagtgggggatcccctctggatcttaagaaaatgggggctggggggttgctctctggagctagtgccgggctctaggacccagcaggcaagtaagcccgcctcgctcttacccctcccccaagccgccccttccccccccacccgtcttccaggttccccctccctcccccctcgccccggctcccggtgcccgtctccagcgccgccggagccagccagggagccggaacgaaaaggaggaggaggaggccgcgtcgccgccgctcggagcccggccggagcctcgcagacaaccttggagtgtacactgaagccaggcttggtttacaacaaggtgaatcccatctttcaccactggagcctgggtgactgcaagtttggactgacgtttcagagccctgcagaggctgatgagttccagaagagcctgctggctgcgctggccgcactgggtcgaggctcactcaccccctcctcctcctcctcctcctcctctccttcccaggatactgcagagaccccctgccctctgacgtcccacgtggacagcgactcctcctccagtcacagccgccaggagactcctcccagcgccgctgcggcccccatcatcacgatggagtcagcttcaggcttcgggccgaccacgcccccccagcgccgccgctcctccgctcagagctaccctccgcttctaccgttcacggggattccggaaccctcagagcccctggcaggggcagggggcctggggtggggcggccgcggctacgaggattaccggcgctccgggccacccgcgcccctcgccctgtccacctgcgtcgtgcgcttcgccaagaccggcgcgttgaggggcgctgccctgggtcccccagcggcactacctgcccctttgaccgaggctgcgcccccagcgccccccgctcgcccaccccccggcccgggcccatcctctgcgcctgccaaggcctccccggaagcggaggaggcagcgcgctgcgtgcattgccgcgcgctcttccgtcgcagagcagacgggcgtggcggccgctgcgcagaggccccggacccgggtcgcctcctggtgcgccgtctaagctgcctgtggtgcgccgagagcttgctctaccactgcctgtcggacgccgagggcgacttctcggacccgtgcgcctgcgagccgggccacccgcgccccgccgcgcgctgggccgcgctggccgcgctctccctggcagtgccctgcctctgctgctacgcgcccctgcgcgcgtgccactgggtcgcagcgcgatgcggctgcgccggctgcgggggtcgccacgaggaggctgcgcggtgaggacggcctggtgggtcccctagccggcccgaggacccaaaattgagggtccaggaccccggactccgttcggacctaaaacccaaacctaggcac

SEQ ID NO: 20360 - DNA, 1366 bp, Homo sapiens
  ENST00000586301
ctctggatgtgtcttcggtcgcccgtttctgacttcctctgcctccgtctccctctgagcctctctttctggccatttctggttctctccctgttccctgcccatctcccgttgctgggtgactcagtacatggtgcgggtccgagctgtggtgatggcccgagatgactccagtgggggctggctgcctgtggggggcgggggcctcagccaggtgagcgtgtgtcgggtccgaggggccaggcccgaggggggggcccgccaggggcactacgtcatccacggggaacgcctccgggaccagaaaacaaccttggagtgtacactgaagccaggcttggtttacaacaaggtgaatcccatctttcaccactggagcctgggtgactgcaagtttggactgacgtttcagagccctgcagaggctgatgagttccagaagagcctgctggctgcgctggccgcactgggtcgaggctcactcaccccctcctcctcctcctcctcctcctctccttcccaggatactgcagagaccccctgccctctgacgtcccacgtggacagcgactcctcctccagtcacagccgccaggagactcctcccagcgccgctgcggcccccatcatcacgatggagtcagcttcaggcttcgggccgaccacgcccccccagcgccgccgctcctccgctcagagctaccctccgcttctaccgttcacggggattccggaaccctcagagcccctggcaggggcagggggcctggggtggggcggccgcggctacgaggattaccggcgctccgggccacccgcgcccctcgccctgtccacctgcgtcgtgcgcttcgccaagaccggcgcgttgaggggcgctgccctgggtcccccagcggcactacctgcccctttgaccgaggctgcgcccccagcgccccccgctcgcccaccccccggcccgggcccatcctctgcgcctgccaaggcctccccggaagcggaggaggcagcgcgctgcgtgcattgccgcgcgctcttccgtcgcagagcagacgggcgtggcggccgctgcgcagaggccccggacccgggtcgcctcctggtgcgccgtctaagctgcctgtggtgcgccgagagcttgctctaccactgcctgtcggacgccgagggcgacttctcggacccgtgcgcctgcgagccgggccacccgcgccccgccgcgcgctgggccgcgctggccgcgctctccctggcagtgccctgcctctgctgctacgcgcccctgcgcgcgtgccactgggtcgcagcgcgatgcggctgcgccggctgcgggggtcgccacgaggaggctgcgcggtgagga

SEQ ID NO: 20361 - DNA, 646 bp, Homo sapiens
  ENST00000587947
agaaagggcagacatggagaagaagatagaggtgagagagaagagatggcatgaggaagaaaggagctgtgtggaagacggtggccatggggttgaaggtacatggtgcgggtccgagctgtggtgatggcccgagatgactccagtgggggctggctgcctgtggggggcgggggcctcagccaggtgagcgtgtgtcgggtccgaggggccaggcccgaggggggggcccgccaggggcactacgtcatccacggggaacgcctccgggaccagaaaacaaccttggagtgtacactgaagccaggcttggtttacaacaaggtgaatcccatctttcaccactggagcctgggtgactgcaagtttggactgacgtttcagagccctgcagaggctgatgagttccagaagagcctgctggctgcgctggccgcactgggtcgaggctcactcaccccctcctcctcctcctcctcctcctctccttcccaggatactgcagagaccccctgccctctgacgtcccacgtggacagcgactcctcctccagtcacagccgccaggagactcctcccagcgccgctgcggcccccatcatcacgatggagtcagcttcaggcttcgggccgaccacgccccccc

SEQ ID NO: 20362 - DNA, 4778 bp, Homo sapiens
  ENST00000338502
aagttggaggggagatgagggttgagggaacattccatgggagagcagggtttgagctcatgactgtgttgtccctgtccttccccccacctcctgcaggtacatggtgcgggtccgagctgtggtgatggcccgagatgactccagtgggggctggctgcctgtggggggcgggggcctcagccaggtgagcgtgtgtcgggtccgaggggccaggcccgaggggggggcccgccaggggcactacgtcatccacggggaacgcctccgggaccagaaaacaaccttggagtgtacactgaagccaggcttggtttacaacaaggtgaatcccatctttcaccactggagcctgggtgactgcaagtttggactgacgtttcagagccctgcagaggctgatgagttccagaagagcctgctggctgcgctggccgcactgggtcgaggctcactcaccccctcctcctcctcctcctcctcctctccttcccaggatactgcagagaccccctgccctctgacgtcccacgtggacagcgactcctcctccagtcacagccgccaggagactcctcccagcgccgctgcggcccccatcatcacgatggagtcagcttcaggcttcgggccgaccacgcccccccagcgccgccgctcctccgctcagagctaccctccgcttctaccgttcacggggattccggaaccctcagagcccctggcaggggcagggggcctggggtggggcggccgcggctacgaggattaccggcgctccgggccacccgcgcccctcgccctgtccacctgcgtcgtgcgcttcgccaagaccggcgcgttgaggggcgctgccctgggtcccccagcggcactacctgcccctttgaccgaggctgcgcccccagcgccccccgctcgcccaccccccggcccgggcccatcctctgcgcctgccaaggcctccccggaagcggaggaggcagcgcgctgcgtgcattgccgcgcgctcttccgtcgcagagcagacgggcgtggcggccgctgcgcagaggccccggacccgggtcgcctcctggtgcgccgtctaagctgcctgtggtgcgccgagagcttgctctaccactgcctgtcggacgccgagggcgacttctcggacccgtgcgcctgcgagccgggccacccgcgccccgccgcgcgctgggccgcgctggccgcgctctccctggcagtgccctgcctctgctgctacgcgcccctgcgcgcgtgccactgggtcgcagcgcgatgcggctgcgccggctgcgggggtcgccacgaggaggctgcgcggtgaggacggcctggtgggtcccctagccggcccgaggacccaaaattgagggtccaggaccccggactccgttcggacctaaaacccaaacctaggcacatccggaacttggagcttgagtttggattgagagatctcagacctggaacctggaacccaaacctaggactgagagaccccagccccagcttcattggggtgtctgtctaagaagtcccaggcgtcctgagttctggcgttcccccacccccacaccccacgaggaggctccaggcgtccccatactttgcatctcagaaaggccagggagcacatagatcccgaaaagggcaggtccctgttgaaatgaacaacctagaacccggtcacgcctggcaccatgtccctcagattacagccccacaattagtcaggacttgcccataactggctctgcctttattcaactcccagatcagatcttgagaccataggacctggagtcacccacaaacagttcctgaatattcacctaagacctggtgcccccacatctgagacattctcatagtcccaggacccctgagacagcaggacccctgagaaagtttcaaacagagtttgaaactctgttatgctctggaatctccagatgctgcccctcaaatctacccacgacttagtgcccacagacctggcctccagtccgggaacactgaagtctaagatgtccagggaactcccagacaccctgggaccccagactcttaagatgcactgagtgctcggatatactgaaacacgagctgttctcttaccaaaatgacttgggagacccatcccagagcccccaagatccagatatcagacaccaagatgctctggaagccagggatcaaagacctccataggtccacccacccccaagccagggttctcaggagctttggatatcatttataggactcagaggtgcctggggtcctcagatgtgcgactgaaggccaccaacacctcaggacccgagatactggtctcgagttctcaaatagccctctcttgcagtccctcctggacctggattttgagaccccaaatgtcctggaatcttcagcttctttctacccacagattcccaaccccttaagggctgggagtccagctcccagaagaggggatgctcatggtgacccagacctctgatgcccttggccctcagcccttgagtgaccctaaggtactttaggagcactggatccaataccccaaaggtgccactgacccccaaatgcaaggctcaagaccctacaacattgggattgttcctgatccaagaccttcatccctccataccagaggcgttcagattcgaggtgccccaagaccccagcaccctcagaccccagatttctttggattcaaacctctctagtctgatgaaccccaagttgcctctacacctgattcccccatccccacttgtcggacctcagagacctgctgccccttgaatcctgtcatccataggcccctaaaaccccaaggttccagcctctggaattctggtcccaaggatcccagcccaagcccccagcaatcctcagaattacccctttatcttagggtgggatccctaccatttggaactcattgtaggaccacccagggtggggcacagtggctcatgccttgtaatcccagcactttgggaggccaagggaggaggatcgcttaaggccaggagtttgagaccagcctgggcaatgtagtgagaccgtctctaaaaaaaaaaaaaaaggaccaagtaggagctccctcactgtcacgtctaggacccagcattgtcacagatgattatgcagggtcttcattaagtgaaggcacacagcccagggtttcgaggagctggaagtcacaccagtctgctggccacactgtgccctcagaagaagtgtgtgcaatggaaactttcaggctagttatggctctgctgtcccacagcccccagtcttgcagaccttccttcaagcacaaccttaattcctagtccaggttcaagtcccaccttttatgttctccccctccattaaccccttctcttcctatttatttatttatttatttatttattttgagacagagtctcgctgtatcacccaggctggagtgcagtggcacaatctcggctcaccacaacctccccctcccgggttcaagccattcgtctgcctcagcctcccgagtagctgggataacaggcatgtgccaccacacccagctaattttttgtattttgagtagagacagggtttcaccatgttggccaggatggtctcaaactcctgacctcatgatccacctgcctcagcctcccaaagtgctgggattacaggcatgagccactgcacctggctctcttccactttagagtgagaagttgcttcaggaagtttgaaagcctgtttcatggcccactgagtctcttctgtgcaaaggggggtgccacaggcttttttcccccaagtgaaatggggcttccagtggatcgaagatctggtgtcctgtatgggggcctcaaggtcttggagcaagacagtctcaatgttgtatgggcttgggacctgcatctggccccaagcatctggaactgtgcacttaacctttcttcattacccagacttggatggccttgttggggttcaagggataggtcctctgtctcttcctttaaattattaactatttattacatccggaacctgtgagattcagcactcccaaccagaccctgggatgggtgagagaaaagcgggggtgtctctcccctccccactctgcccagctctcatcactgtcagacccaccagagctgagggcggagggattgggggctggggcagcctgggtccccatgcccctctctgtgcctcggtctccccccttccatggtgggcgggggggaagctccattcttaacctacctcgttttggggaggggtgggacgggggaccagagtgctgtacggtgctgtgggatctgcagatgaagcggtgggggctaaggaaaggtcccctggccgccacttcccagcagcgcctctcccaggtcccccagtcctgctccctgctgagacccacctctgatccatgattccccttcattgcccccaaatcaggggtacatggagggccgccctgggagccaggcagacctcagaccctggagcccccaggcccaatttcccagccgcttgcccctcagatcggatgcttggcccccagatttgggggaggcaccccaacatatatcttcctgatcttgtttctaagccagtctgtgacctcaatattgttagtgtcagtgcaggctgaagtggtgggggaggatgggggccaaagacccagccttgtcatcgggggagggggcacgagatctgctccaagaaatgtctgtgacaaagtctca

SEQ ID NO: 20363 - DNA, 543 bp, Homo sapiens
  ENST00000587564
gtacatggtgcgggtccgagctgtggtgatggcccgagatgactccagtgggggctggctgcctgtggggggcgggggcctcagccaggtgagcgtgtgtcgggtccgaggggccaggcccgaggggggggcccgccaggggcactacgtcatccacggggaacgcctccgggaccagaaaacaaccttggagtgtacactgaagccaggcttggtttacaacaaggtgaatcccatctttcaccactggagcctgggtgactgcaagtttggactgacgtttcagagccctgcagaggctgatgagttccagaagagcctgctggctgcgctggccgcactgggtcgaggctcactcaccccctcctcctcctcctcctcctcctctccttcccaggatactgcagagaccccctgccctctgacgctctcccagtacttcaggcatatgctgtgcccttgacagtggccctaaccgcatccttatgaataggtactcttaggatccccgttttacagaggaggaaactgaggctcaaagag

SEQ ID NO: 20364 - DNA, 478 bp, Homo sapiens
  ENST00000586958
gtacatggtgcgggtccgagctgtggtgatggcccgagatgactccagtgggggctggctgcctgtggggggcgggggcctcagccagacaaccttggagtgtacactgaagccaggcttggtttacaacaaggtgaatcccatctttcaccactggagcctgggtgactgcaagtttggactgacgtttcagagccctgcagaggctgatgagttccagaagagcctgctggctgcgctggccgcactgggtcgaggctcactcaccccctcctcctcctcctcctcctcctctccttcccaggatactgcagagaccccctgccctctgacgctctcccagtacttcaggcatatgctgtgcccttgacagtggccctaaccgcatccttatgaataggtactcttaggatccccgttttacagaggaggaaactgaggctcaaagagtcccacgtggacagcgactcctcctcca

SEQ ID NO: 20365 - DNA, 560 bp, Homo sapiens
  ENST00000590962
gtgaatcccatctttcaccactggagcctgggtgactgcaagtttggactgacgtttcagagccctgcagaggctgatgagttccagaagagcctgctggctgcgctggccgcactgggtcgaggctcactcaccccctcctcctcctcctcctcctcctctccttcccaggatactgcagagaccccctgccctctgacggtgagtgtccaggatgcctctctgctgggggagggtaggggttttgtttttattctatgaacattcttgagcacctactgtgtagcaggcaccatgccacacaccgggtacacaaaattgggccggaactatgagtgtcaattcaatcccagttattctagtctttctgccctgtcatgattcacacgttcattcaagggtccttattgtgtaccttctgtataccaggcagtgctttaggcactgggttacatcagtgaacaaaaagttcctttcctcctggagcttctattctagtgtggaaaggcagaaaattaaaaaaaatatatatataaacaataaaaatgaataaatattga

SEQ ID NO: 20366 - DNA, 2908 bp, Homo sapiens
  ENST00000310546
cggcggcggaggagggggaggcggcggcggctgcagcatccagagctggccgtggcggccggcgcgccccgcgcacaaaagcacccagccccaggggagggcgatgaacacaccacatcccgggcccgggccccagctgctgctaccgctgcgtgcgctcagggcgctggggaagacgcccggcgcgccgggggccagcggccgaggcgcggcccgtgcgccctgagcgcgggactcgtcgccctccgggtcaggcgccaagcttccaagcggctagagcgcgggccttggagcgcccccaggatcgcttcagtaaggcgcttccccactccaggcccgacccccggcgcctgagcgccaacttcgccaagaacgctcctaactccaggccatcctgcagcgcagagggggcgctgctgccgggcatcagccgtgaggacgcgcccctggccgtgcggagagagccggcatttgcgggtcactcgggcgcccctgagtgggcggcggcggcagcagacccctctccagggagtccaggacctgccagcgctggggattcttcccgaacaggcgcttgccctctcttttatggagcttgggcccctgccgcagcccggtagaggctgtggaggtctaccgtccggaagcctggttcccagccccgtggcccattcctggctacggggagtggaggctcccacgaggtagcggtggcctgcagcggcctcctccccgcagtgaagcatgggccagaagctctcggggagcctcaagtcagtggaggtgcgagagccggcgctgcggccggccaagcgggagctgcggggtgcagagcccgggcggccggcgcggctggaccagctgttggacatgccagcggcggggctggctgtgcagctgcggcacgcgtggaaccccgaggaccgctcgctcaacgtcttcgtcaaggacgacgaccggctcaccttccaccggcaccccgtggcccagagcaccgacggcatccgcggcaaggtgggccacgcccgcggcctgcacgcctggcagatcaactggccggctcggcagcgcggcacccacgctgtagttggtgtggccacggcccgtgctcccctgcactccgtgggctacacggcgctggtaggcagtgacgccgagtcgtggggctgggacctgggccgcagccgcctctaccacgacggcaagaaccagcccggcgtggcctacccggcctttctggggcccgacgaggcctttgcgctgcccgactcgctgctcgtggtgctggacatggatgagggcacactcagcttcatcgtggatggccagtacctgggcgtggccttccgaggtctcaagggcaagaagctgtacccggtggtgagtgccgtgtggggccactgtgaagtcaccatgcgctacatcaacggccttgaccccgagcccctgccactgatggacctgtgccggagatccatccgctcggccctgggccgccagcgcctgcaggacatcagctccctgcccctgcctcagtctctcaaaaactatctgcagtaccagtgagccaagcctgatgggcagcacagacacagacacacaccgcagggcccgaccctcctgtcattcacagtcccatggcacataggggaaaggatctacccttctcctggctccccaggacactcagttctttcaaagaccaggatgtggtaccaactttggaaacgaaaggtctcttgccaacagtatctactgccctcgaggcagccctcccaagtcagacacctccttcggagccacagagagcctggagtctgcacctcctggaaatcctgccaccaaccaggacacagcagccaccgtattgatcagagagcctgtttccttattcaagagaatgaataaaacatttaggcaggagactttctattgtgtgccccgttgcagacagggccagggagaaattagccagtgcagggggaaaattgcctctgaataatgaatgatgaaagcctgacgccgtgcccctcctggcccatacgccttgccagggcggcaggattgtcacaccgttttaggactctgtgccactttgagagactgttcccaggaggcccaaccgcagacctggcaagtggacagtgcagtgtggagacaccttccggcttacctctttgaacgttgtttacctacccctttccacgtgctccccttcccagccactgactcacagttctctggatgcccagacacctctcttcagggaagatgagtctgactggtttgccccagggaagagcatatccttaccattattttaagtagcatttgcattttaaaagaggaatgcggagaggacagtacttagtccaaaggtgctaacgggggaactgggggcattgtgacacccaagtctgatgtgtcctgggttggggggccttcctggagtgtcagggtctctgggcaacgtccattcagggtgcggcatggctgtcacaaagctttatttgagcaaattattttttcactttaggagacttctacaagtttgtttcctgtttcaaatgtgtgtgtgatgtgctgtttatttatcagcttgaggtccatgggggcagccttgtgactggaagggtggatatgggagacacattctctacctgctccgagcctggtcctctcgcaggaatgctgctgctgcctccgccgccactgctgctgccacctcttatatgtttcagacactctctgcccagactcatttttaactggaaatcatcacagcagtgggatatcagagccccagacagcactgcctcttcctccccaccccactgcccccaccttaatgtgaatttgactgatgaatgaagagcgtttctaataaagtttgtcattcagtccttca

SEQ ID NO: 20367 - DNA, 1752 bp, Homo sapiens
  ENST00000508126
cgtggtgctggacatggatgagggcacactcagcttcatcgtggatggccagtacctgggcgtggccttccgaggtctcaagggcaagaagctgtacccggtggtgagtgccgtgtggggccactgtgaagtcaccatgcgctacatcaacggccttgaccatggagtctcactcggttgccctggccaaagtgcagtggcacgatctcggctcactgcaacctccgcctcccgggttcaagctattcttctgcctcagcttcccgagtagctgggactacagccgagcccctgccactgatggacctgtgccggagatccatccgctcggccctgggccgccagcgcctgcaggacatcagctccctgcccctgcctcagtctctcaaaaactatctgcagtaccagtgagccaagcctgatgggcagcacagacacagacacacaccgcagggcccgaccctcctgtcattcacagtcccatggcacataggggaaaggatctacccttctcctggctccccaggacactcagttctttcaaagaccaggatgtggtaccaactttggaaacgaaaggtctcttgccaacagtatctactgccctcgaggcagccctcccaagtcagacacctccttcggagccacagagagcctggagtctgcacctcctggaaatcctgccaccaaccaggacacagcagccaccgtattgatcagagagcctgtttccttattcaagagaatgaataaaacatttaggcaggagactttctattgtgtgccccgttgcagacagggccagggagaaattagccagtgcagggggaaaattgcctctgaataatgaatgatgaaagcctgacgccgtgcccctcctggcccatacgccttgccagggcggcaggattgtcacaccgttttaggactctgtgccactttgagagactgttcccaggaggcccaaccgcagacctggcaagtggacagtgcagtgtggagacaccttccggcttacctctttgaacgttgtttacctacccctttccacgtgctccccttcccagccactgactcacagttctctggatgcccagacacctctcttcagggaagatgagtctgactggtttgccccagggaagagcatatccttaccattattttaagtagcatttgcattttaaaagaggaatgcggagaggacagtacttagtccaaaggtgctaacgggggaactgggggcattgtgacacccaagtctgatgtgtcctgggttggggggccttcctggagtgtcagggtctctgggcaacgtccattcagggtgcggcatggctgtcacaaagctttatttgagcaaattattttttcactttaggagacttctacaagtttgtttcctgtttcaaatgtgtgtgtgatgtgctgtttatttatcagcttgaggtccatgggggcagccttgtgactggaagggtggatatgggagacacattctctacctgctccgagcctggtcctctcgcaggaatgctgctgctgcctccgccgccactgctgctgccacctcttatatgtttcagacactctctgcccagactcatttttaactggaaatcatcacagcagtgggatatcagagccccagacagcactgcctcttcctccccaccccactgcccccaccttaatgtgaatttgactgatgaatgaagagcgtttctaataaagtttgtcattcagtccttc

SEQ ID NO: 20368 - DNA, 537 bp, Homo sapiens
  ENST00000508828
gggggatggggtttaagtgagcggggagagccaatgccctgccaggctggcggcagcctttatttacagggtcgggagccagctgatttgctttggttaaagcaagggggcggttagcgtgagttacggcctcgcccagacactaataaggctgcttgtctgaggcattccataattcaagcaaaggctgtgccgcttaatggcccttcttcgtcagatcttccaggactcggtgcctccttaatgagttatttgcttgggatgaaattaagccgagacagcgtgagcttggaaaatactgccgtgcaggctctccccggttcttcatccttctcagcggctgctttctataaatagagccgtgagttctgcttcgtgacccgcctgctgggagccccagtgggcgcctggtgtctcccatccctcttgtctcccacgcccatgatctcactgaaaactgaattccaggctttttaagaaagcatagagttccctgggtctactaagaaccatctggcagtccagccaagaaaaggg

SEQ ID NO: 20369 - DNA, 576 bp, Homo sapiens
  ENST00000507895
accttgtcatcatcccagctttgaagtcatttaagtagatgcttctgagtcgatccagggagccacagctgacttccagatcttgtcctctttgttgatgtttctccctcaaaatgcaattcatgaggaggtcccaggaaaactgaattccaggctttttaagaaagcatagagttccctgggtctactaagaaccatctggcagtccagccaagaaaaggggcctctgtaaagcagtgaactcagcgtgagctttgccgagcccctgccactgatggacctgtgccggagatccatccgctcggccctgggccgccagcgcctgcaggacatcagctccctgcccctgcctcagtctctcaaaaactatctgcagtaccagtgagccaagcctgatgggcagcacagacacagacacacaccgcagggcccgaccctcctgtcattcacagtcccatggcacataggggaaaggatctacccttctcctggctccccaggacactcagttctttcaaagaccaggatgtggtaccaactttggaaacgaaaggtctcttgccaacagtatctact

SEQ ID NO: 20370 - DNA, 10153 bp, Homo sapiens
  ENST00000556626
gtgccaggagccccgcgctgccctcctccccctgcgccgccgccgccgccacccccgggctcggggtggcccccgcttcagtcccagggcagggatccttccatgaagactgaggcaggcggagctgctaagagcctgctgacatgacatcggccacagagtttgaaaatgtgggcaaccagccaccttacagcaggatcaatgcccgctgggacgccccagacgacgagctggataatgacaacagctcagccaggctctttgagaggtcccggataaaggccttggcagatgagcgggaagttgttcagaaaaagaccttcacgaaatgggtgaactcgcacctggctcgagtgtcctgccgcatcaccgatctctacaaggacctgcgggatgggcgcatgctcatcaagctgctggaggtgctctctggagagatgctgccaaagcccaccaaggggaagatgcgcatccactgcctggagaatgtggacaaggctctccagttcctcaaggagcagcgtgtacacctggagaacatgggctcccacgacattgtagatggcaaccaccgcctggtcctgggcctcatctggaccatcatcctccgcttccagattcaggacattgtggtccaaactcaggaaggtcgtgaaacacgctcagccaaggatgcgttgctgttgtggtgtcagatgaagacggcaggctaccctcatgttaatgtcaccaactttacctccagctggaaggatggcttggcctttaatgccctgatacacaagcaccggcccgacctgatcgactttgataagctgaaggactccaatgcccggcacaacctggagcacgcattcaatgtggctgagcgccagctgggcatcatcccgctcctcgaccccgaagatgtctttacggaaaaccctgatgagaaatccatcatcacctatgtggtggccttttaccactacttctccaagatgaaggtgctggcagtggagggcaagcgtgtcggcaaggttattgaccatgccattgagactgagaagatgattgaaaagtacagcgggctagcctcggacctgctcacctggatcgagcagaccatcactgtcctgaacagccgcaagtttgccaactcgctgacgggcgtccagcagcagctgcaggccttcagcacctaccgcaccgtggagaagccgcccaagtttcaagagaaggggaatctggaagttctactttttaccatccagtcccggatgagagccaacaatcagaaagtgtacacaccccacgatgggaaactagtgtctgacatcaacagggcctgggaaagcctggaggaagctgagtatcggcgggagctggccctgagaaatgagctcattcggcaggagaagctagagcaactggcccggcgctttgaccggaaggccgcaatgagagagacctggctcagtgaaaaccagcgcctcgtggcccaggataactttgggtatgacctggcagctgtggaggccgccaagaagaagcatgaggccatcgagaccgacacggctgcctacgaggagcgggtgagagccctggaggacctggctcaggagctggagaaagagaactaccatgaccagaagcgcatcacggcccgcaaggacaatatactgcgcctatggagctacctgcaggagctgctgcagtcccggcgccagaggctcgagaccaccctggcactgcagaagctcttccaggacatgctgcacagcatcgactggatggatgagatcaaggctcacctcttgtctgccgagtttgggaagcacttgttggaggttgaagacctgctacagaagcacaagttgatggaagctgacatcgccatccaaggggacaaagtgaaggccatcaccgcagccaccctgaagttcaccgaggggaaagggtaccagccttgtgacccccaggtcatccaggaccgcatcagccacttggagcagtgctttgaggagctgagcaacatggcagctgggcggaaggcccaactggagcagtccaaacgactctggaagttcttctgggagatggatgaggctgagagctggatcaaggagaaggagcagatctattcttccctggactatggcaaagacctgaccagtgtgctcatcttacagcgcaagcacaaggcctttgaggatgagctccgtgggctggatgctcacctggagcagatcttccaggaggctcatggcatggttgcgcgcaagcagtttgggcacccgcagatcgaggcccgcataaaggaggtgtcggcacagtgggaccagctgaaggacctggctgccttctgcaagaagaacctccaggatgctgagaactttttccagttccagggcgatgcggatgacctgaaggcttggctgcaagacgcccaccggctgctctctggtgaagatgtggggcaggacgaaggggccacgcgggccctggggaaaaagcacaaggacttcctggaggagctggaggagagccgtggggtgatggagcacctggagcagcaggcccagggattccccgaagagtttcgggattccccagatgtgacccatcggctgcaggccctgcgggagctctaccaacaggtggtggcccaggcggacctgcgtcagcagaggctgcaggaagccctggacctgtacacggtgttcggggagacagacgcctgtgagctgtggatgggagagaaggagaagtggctggccgagatggaaatgccagacaccctggaggacctggaggtcgtgcagcacaggttcgacatcctggaccaggagatgaagaccttgatgactcagattgatggtgtgaacctcgctgccaacagcttggtagagagtggccacccacgcagcagggaggtgaagcagtaccaggaccatctgaacaccaggtggcaggcatttcagaccctggtgtcggagcggcgggaggctgtggactcagccctccgagtgcacaactactgcgtagattgcgaggagaccagcaagtggatcacggacaagacaaaggtagtggagtccacaaaagacctggggcgggacctggcaggtatcatcgccatccagaggaagttgtcagggctggagcgtgacgtggccgccatccaggcccgtgtggatgccctggagcgtgagtcccagcagctgatggactcgcaccctgagcagaaggaggatattggtcagcggcaaaaacacttggaggagctgtggcagggcctgcagcaatccctgcagggccaggaggacttgctgggggaagtcagccagctgcaggccttcctgcaggatctggatgacttccaggcctggctctccatcacccagaaggctgtggcctctgaggacatgcccgaatccctcccagaggctgagcagctcctgcagcagcatgcaggtatcaaggatgagattgacgggcaccaagacagctaccagcgtgttaaggagtctggggagaaagtgatccaaggccagacggacccagagtatctgcttctgggccagcggctggagggcctggatactggctggaatgccctgggcaggatgtgggagagccgcagccacaccctcgctcagtgccttggcttccaggagttccagaaagatgccaagcaggctgaagccatcctcagcaaccaggaatacactctggctcacttggagcccccagactccctggaagctgcagaggctgggatccggaagtttgaggatttcttggggtctatggagaacaaccgggataaggtcttgagtcctgtggactctggaaacaagctggtagctgagggaaacctatactcagacaagatcaaggagaaggtgcagctgattgaggacaggcacaggaagaacaacgagaaggcccaggaggcctctgtcctactgagagacaacctggagctacagaacttcctccagaactgccaggagctcactctctggatcaacgacaagctgctgacatctcaggatgtctcctatgatgaagcacgaaaccttcacaataaatggctaaagcaccaggcgtttgtggcagagctggcttcccatgaagggtggctagagaacatcgatgcggaaggaaagcagctgatggatgagaagccccagtttacagccctggtgtcccaaaagctggaagccctgcaccggctctgggacgagctgcaggccaccacaaaggagaagacccagcacctctcggctgccaggagctccgacctgcgcttgcagacccatgctgacctcaacaagtggatcagcgccatggaggaccagctgcggtcagacgacccgggcaaggacctgaccagtgtcaatcggatgttggctaagctgaagcgagtggaggaccaagtgaatgtgcgaaaagaggagctgggggagctgtttgcccaggtgccttcaatgggagaggagggaggagatgcagacttgagcatcgagaagcggttcctggacctcctggaacccctaggaaggaggaagaagcagctggaatcatccagagccaagctgcagatcagccgggacttagaggatgagacgctttgggtggaggagaggctgcctctggcccagtcagccgactatggcactaatctgcaaactgtgcaactgttcatgaagaagaaccagacactgcagaatgagattctgggccatacgccgcgggttgaggatgtgctgcagagagggcagcagctggtggaggcggcggagatcgactgccaggaccttgaggagcgcctggggcacctgcagagctcctgggacaggctgcgggaggcagcggccgggaggctgcagcgactgagggacgccaacgaggcacagcagtactacctggatgcagacgaggctgaggcctggattggcgagcaggagctctacgtcatctccgatgagatccccaaggatgaagagggcgccattgtgatgctgaagcgacatttgcggcagcagcgtgcggtggaggactacggccggaacatcaagcagctggccagccgggcccagggcctgctgtctgcaggccaccctgagggggaacagatcatcagacttcaggggcaagtggacaagcactacgcagggctgaaggacgtggcggaagagcgcaagcgcaagctggagaacatgtaccacctgttccagctcaagcgggagaccgacgacctggagcagtggatttcagaaaaggagctagtggcctcttccccggaaatggggcaagactttgaccacgtgactcttctgcgggacaagttccgggactttgcccgggagaccggggcgattgggcaggagcgggtggacaatgtgaatgccttcatcgagcgactcatcgacgcgggccacagcgaggcggccaccatcgccgagtggaaggacgggctgaacgagatgtgggcagacctcctggagctcattgacacgcgcatgcagctgctggccgcctcctatgacctgcaccgctacttctacacgggtgccgagatcctgggcctcatcgacgagaagcaccgcgagctgcccgaggacgtggggctggacgccagcacggccgagtccttccaccgggtgcacacagccttcgagcgggagctccacctgctgggtgtccaggtgcagcagttccaggacgtggccacccgtctgcagacagcatatgctggggagaaggcagaggccatccagaacaaggagcaggaggtgtctgccgcgtggcaggcgctgctcgatgcctgtgccgggcgccggacccagctagtggacacggcggataaattccgcttcttcagcatggcccgtgacctcctctcctggatggagagcatcatccggcagatcgagacccaggagaggcccagggatgtctcctctgtggaactgctcatgaagtatcaccagggcatcaatgcagagattgaaacccggagcaagaacttcagtgcctgcctggagcttggcgagtccctgctgcagcggcagcaccaggcctcagaggagatccgcgagaaactgcagcaggtgatgtccaggaggaaagagatgaatgagaagtgggaagcccgctgggagcggctccgcatgttgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacgcttgagctgaaagaacgccagattgcagagagacccgcagaggagactgggcctcaagaggaggaaggcgagacagcaggggaggctccagtttcccaccatgcggccaccgagagaacgtccccgggggaagaagagggaacgtggcctcagaacctgcagcagccaccaccgccgggtcagcacaaggatgggcagaaatccactggggatgagaggcccaccacggagcccctctttaaggtcctagatacgcctctgagcgagggtgatgagcccgcaacgctgccggccccgcgggaccatgggcagagtgtgcagatggaaggctacctgggccgcaagcatgacctggaggggcccaacaagaaggcttccaacaggtcctggaacaacctgtactgtgtgctcaggaacagtgagctaaccttctacaaggatgccaagaacctggccctggggatgccctaccatggggaggaacccctggccctgagacatgccatctgtgagattgctgccaactacaagaagaagaagcacgtctttaagctgaggctgagtaatggcagcgagtggctcttccatggcaaggatgaggaggagatgctgtcctggctgcagggcgtgagcaccgccatcaacgagtcccagagcatccgcgtcaaggcgcagagcctgcccctgccttccctctccggccccgacgccagcctcggcaagaaagacaaggagaagagattcagcttcttccccaaaaagaagtagcaggtggggctggcgggcgcggcggagtcgggacgcgcagagaccgggcagcccaggccttggcctcctctcgccgccgcccgccggtcgaatcgagatgagtcgagtcgcgggccgggcccccgggccccacgctgcactgcaaaagctgccttcgcccgcgtgtcctgggccgacgccccctccatgccctcgcccgcgctggctccgctccagggacaggggctcccagctcctctggcgcctttggggcctccaggcctgggggcaggaaacggttctctgaggcacacgccctcctctcccaccctcctcctgagccgagggggcacaggccccttacccccaaccaaaaaaaaaaaaaaaaaagagctggagaaggctgatggggttcttcaaacgctgcccgttcctaaagcaagtcttgcttcgggtcacctcccacctggtggcagccagggaaaggggaaaggaagaagacactggaaatgcatggccagccccctaggggcatgaggaaggagccttcaggtggcccacaaagccctagctctgggccaggggctctggggggctgaggggaccagactgggtgcagggccttgggagctgccagcctccttcccactgggcttccgcagaactgggactctcacttcaggggccaccacatccctcctctctgcttctccccccagatcaaagggtaccctcccacggttggcagggcctggctgagtgcctctagcaccctttgtgccaccacaggcggtcccaggaagggcagcaaggtcagaccattcctcattgaaaaccgtggctagggcacagggctctgatctgaaggagtgacaggtgcgtcacaacactgcctaaggctctccctctcaatgctgggaccctcgccccactcccagtggcagccaaaccagcaatatccaacagacataggccccctacgggacagtgtgggcccccagatataagatggataccccccgcacctgcagtaaagcatcccaaagccaaatgctcaattgcatcctgtctgcagctgggactttggagggtaatggctgggcagacagtaaagttgatcatctgttttctcggggtggcagacgcagccatgtcttggtatcaccacccatgtgacagctactcctgcacaactgggacaaatgtcagggccagagccatgaaggtgtggtaccccttgatcagcttctccacgtcctggccccaggtcttggcggggagggggtcacatgagtacagaggtcaaatatctaccaccctccagccctgagcaccagaagctctgcaaccaacgtccccaggaatggccttccccttgctgctcaggtcatacttctggaggaagagaaagctcattccatattttccccaccactctactccgaaagcaacacagttctggcccagtatcaaactagggttaggtccaagagagcagtcaagcgggtcgggggtgggggggagggcggagggcagcaggcattttcccccaaggaaaccatgaaagtccccagggcctgcagtcaagtttctatcaccttccccgtgagaaggaccttagttccatggagatgaagtgggtgaggttcaggtagaagccacaggggcaggcatccagaatgaggccccctgaggaaccctgagtgctgaccagtgccggcagaaatcagttccaccctgtggccctgacactatatgtcagggtgacaccaactgcagcaggcaggagccacaggaaggaagacgtcatccgatggagcctgacatccccaggttcccgccctggtgagcaaggtcttcatttggctttggtacatatgaccctatacagggaacctagtgtgtatcactcaccagcctctttctgtatctggggaaaccaaggcagtgaggtgactgcactcacctagcaataaagtaggcctttggtgcacttgcaggcatgtcctcctctggggcagagagcaggttccttgctgaagggcagatggtggcaaacatctccctcaactgtttccctgggccagtctttagggagcctagggacaagggcccaccctcccccttccacgtgtgccaaatcagcacctgaagtgaggcatttccagcaagcaactccacagacccgagaaaggaagggctctagtggaagagctagcatctcaccaccccaggtcccctggcctggtccagggcagccagctgcatgtgaccattctgttgccagctccccacacatccctcctgtcacccaggctccaagacattcgaccaactagactgaaaatgcaggcatccagctttgggagaccctgtgtgtgccacaccagggctaagctctcccagtgccctagcaaggtctttttttttttttctctccttattctactctacagtcttttgacagtattcccaaacgaggttgacacagctccagtccacaccagcataccaggcttccttcccagggcagtttagaggaagctccttctgggcaaggtcaggcggtcctccttccctctctccttcccctttgtcccagcctcaactgactctggctgtgggaggtgtggagggtccttaggcttccctccccaacctggcctccaccaacacccctaacaggaggcccgtggaaggctcagcctctcctccgcatccctcctccttcctgcctatcggagggagccagggtcccctaggctgaccctgaatcctcttcctcccttcatgggaggggggcaggaatccagaggaggatgaagccagcgggaccacatggcttggtggcttggacaaacaagctcagggaggaaatgaggaggcggcggctgcagaggaatgcaaccctgttgggcacagaccatgcaatctggggctggccctggggccagctgggtcctgtcctccacctgctcaaccgtgcttccaccaaccagaggaaacccatttactagtttttctaataaatcaataatgctcca

SEQ ID NO: 20371 - DNA, 1723 bp, Homo sapiens
  ENST00000342835
ctgcacggtcccaccgccttccctcacctcttgcctttttacattagagcacgttctggtaaaggccaatccgttcatacagggggaagaagagggaacgtggcctcagaacctgcagcagccaccaccgccgggtcagcacaaggatgggcagaaatccactggggatgagaggcccaccacggagcccctctttaaggtcctagatacgcctctgagcgagggtgatgagcccgcaacgctgccggccccgcgggaccatgggcagagtgtgcagatggaaggctacctgggccgcaagcatgacctggaggggcccaacaagaaggcttccaacaggtcctggaacaacctgtactgtgtgctcaggaacagtgagctaaccttctacaaggatgccaagaacctggccctggggatgccctaccatggggaggaacccctggccctgagacatgccatctgtgagattgctgccaactacaagaagaagaagcacgtctttaagctgaggctgagtaatggcagcgagtggctcttccatggcaaggatgaggaggagatgctgtcctggctgcagggcgtgagcaccgccatcaacgagtcccagagcatccgcgtcaaggcgcagagcctgcccctgccttccctctccggccccgacgccagcctcggcaagaaagacaaggagaagagattcagcttcttccccaaaaagaagtagcaggtggggctggcgggcgcggcggagtcgggacgcgcagagaccgggcagcccaggccttggcctcctctcgccgccgcccgccggtcgaatcgagatgagtcgagtcgcgggccgggcccccgggccccacgctgcactgcaaaagctgccttcgcccgcgtgtcctgggccgacgccccctccatgccctcgcccgcgctggctccgctccagggacaggggctcccagctcctctggcgcctttggggcctccaggcctgggggcaggaaacggttctctgaggcacacgccctcctctcccaccctcctcctgagccgagggggcacaggccccttacccccaaccaaaaaaaaaaaaaaaaaagagctggagaaggctgatggggttcttcaaacgctgcccgttcctaaagcaagtcttgcttcgggtcacctcccacctggtggcagccagggaaaggggaaaggaagaagacactggaaatgcatggccagccccctaggggcatgaggaaggagccttcaggtggcccacaaagccctagctctgggccaggggctctggggggctgaggggaccagactgggtgcagggccttgggagctgccagcctccttcccactgggcttccgcagaactgggactctcacttcaggggccaccacatccctcctctctgcttctccccccagatcaaagggtaccctcccacggttggcagggcctggctgagtgcctctagcaccctttgtgccaccacaggcggtcccaggaagggcagcaaggtcagaccattcctcattgaaaaccgtggctagggcacagggctctgatctgaaggagtgacaggtgcgtcacaacactgcctaaggctctccctctcaatgctgggaccctcgccccactcccagtggcagccaaaccagcaatatccaacagacataggccccctacgggacagtgtgggcccccagatataagatggataccccc

SEQ ID NO: 20372 - DNA, 3456 bp, Homo sapiens
  ENST00000553938
ggaaagcagctgatggatgagaagccccagtttacagccctggtgtcccaaaagctggaagccctgcaccggctctgggacgagctgcaggccaccacaaaggagaagacccagcacctctcggctgccaggagctccgacctgcgcttgcagacccatgctgacctcaacaagtggatcagcgccatggaggaccagctgcggtcagacgacccgggcaaggacctgaccagtgtcaatcggatgttggctaagctgaagcgagtggaggaccaagtgaatgtgcgaaaagaggagctgggggagctgtttgcccaggtgccttcaatgggagaggagggaggagatgcagacttgagcatcgagaagcggttcctggacctcctggaacccctaggaaggaggaagaagcagctggaatcatccagagccaagctgcagatcagccgggacttagaggatgagacgctttgggtggaggagaggctgcctctggcccagtcagccgactatggcactaatctgcaaactgtgcaactgttcatgaagaagaaccagacactgcagaatgagattctgggccatacgccgcgggttgaggatgtgctgcagagagggcagcagctggtggaggcggcggagatcgactgccaggaccttgaggagcgcctggggcacctgcagagctcctgggacaggctgcgggaggcagcggccgggaggctgcagcgactgagggacgccaacgaggcacagcagtactacctggatgcagacgaggctgaggcctggattggcgagcaggagctctacgtcatctccgatgagatccccaaggatgaagagggcgccattgtgatgctgaagcgacatttgcggcagcagcgtgcggtggaggactacggccggaacatcaagcagctggccagccgggcccagggcctgctgtctgcaggccaccctgagggggaacagatcatcagacttcaggggcaagtggacaagcactacgcagggctgaaggacgtggcggaagagcgcaagcgcaagctggagaacatgtaccacctgttccagctcaagcgggagaccgacgacctggagcagtggatttcagaaaaggagctagtggcctcttccccggaaatggggcaagactttgaccacgtgactcttctgcgggacaagttccgggactttgcccgggagaccggggcgattgggcaggagcgggtggacaatgtgaatgccttcatcgagcgactcatcgacgcgggccacagcgaggcggccaccatcgccgagtggaaggacgggctgaacgagatgtgggcagacctcctggagctcattgacacgcgcatgcagctgctggccgcctcctatgacctgcaccgctacttctacacgggtgccgagatcctgggcctcatcgacgagaagcaccgcgagctgcccgaggacgtggggctggacgccagcacggccgagtccttccaccgggtgcacacagccttcgagcgggagctccacctgctgggtgtccaggtgcagcagttccaggacgtggccacccgtctgcagacagcatatgctggggagaaggcagaggccatccagaacaaggagcaggaggtgtctgccgcgtggcaggcgctgctcgatgcctgtgccgggcgccggacccagctagtggacacggcggataaattccgcttcttcagcatggcccgtgacctcctctcctggatggagagcatcatccggcagatcgagacccaggagaggcccagggatgtctcctctgtggaactgctcatgaagtatcaccagggcatcaatgcagagattgaaacccggagcaagaacttcagtgcctgcctggagcttggcgagtccctgctgcagcggcagcaccaggcctcagaggagatccgcgagaaactgcagcaggtgatgtccaggaggaaagagatgaatgagaagtgggaagcccgctgggagcggctccgcatgttgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacgcttgagctgaaagaacgccagattgcagagagacccgcagaggagactgggcctcaagaggaggaaggcgagacagcaggggaggctccagtttcccaccatgcggccaccgagagaacgtccccgggggaagaagagggaacgtggcctcagaacctgcagcagccaccaccgccgggtcagcacaaggatgggcagaaatccactggggatgagaggcccaccacggagcccctctttaaggtcctagatacgcctctgagcgagggtgatgagcccgcaacgctgccggccccgcgggaccatgggcagagtgtgcagatggaaggctacctgggccgcaagcatgacctggaggggcccaacaagaaggcttccaacagtaagggagaagagggagaggagaggagggagacagaagaggaggatgaagaggaggaggaaacagagtctgttgctgtagaaatgcagcaacatgcttcccacgtgtcctggaacaacctgtactgtgtgctcaggaacagtgagctaaccttctacaaggatgccaagaacctggccctggggatgccctaccatggggaggaacccctggccctgagacatgccatctgtgagattgctgccaactacaagaagaagaagcacgtctttaagctgaggctgagtaatggcagcgagtggctcttccatggcaaggatgaggaggagatgctgtcctggctgcagggcgtgagcaccgccatcaacgagtcccagagcatccgcgtcaaggcgcagagcctgcccctgccttccctctccggccccgacgccagcctcggcaagaaagacaaggagaagagattcagcttcttccccaaaaagaagtagcaggtggggctggcgggcgcggcggagtcgggacgcgcagagaccgggcagcccaggccttggcctcctctcgccgccgcccgccggtcgaatcgagatgagtcgagtcgcgggccgggcccccgggccccacgctgcactgcaaaagctgccttcgcccgcgtgtcctgggccgacgccccctccatgccctcgcccgcgctggctccgctccagggacaggggctcccagctcctctggcgcctttggggcctccaggcctgggggcaggaaacggttctctgaggcacacgccctcctctcccaccctcctcctgagccgagggggcacaggccccttacccccaaccaaaaaaaaaaaaaaaaaa

SEQ ID NO: 20373 - DNA, 4741 bp, Homo sapiens
  ENST00000556227
tctctacaggagcagtcaggaacgccaaagaaatctttgcatacattggaaaacccccattttccaaagccaacctgtgacctggccacataatttttgatcgcactggcatagcctctgaatgtccctgccaaggaatgtgggccaggcacccattaagaggaaacagaagaaaggtgggattaagttgggagtcagtcctggcaaaatccatctctattttcagaggacagttttctaaaggaaggaaaatggaatggaagtataggaagaaaatgtagacatggaggtctctagtaaaaccaatcccaggagagcagaggctgggtaagaggggcaaacatggctgagagggtctggcaagcttccctccctatatctgccatggctgcttctctgagacccaagggcagggagagcactgatggtagcaggagcagcagtgcagcccatgtcccctcctctggaacctactcccgcccctcttggaggaaaagcagggcctccccagatgtatacccaagtcagagcgcaggatccacagaaagaccccaagcccaggcttccagtcccatccctgcctctcctgctcttcctccctgctacggtgatccaggcagggctttggggcctccagatccttgtggccaatgctggctcattgcagacactctagggtccaaaggctgccagatgcatagagaggagtggcctggccacaaccctcaggggcgctaaggtgggaaaagatgaacaccataaagatgggataaaagctcaggtctgtccattttgggagtgcatattccgaactgcctcctatacctattagctttgttgtcaccaggaaatgcagagtcctcaattcttagtctgtcttgggagaattcggccaagagaccaagtagtaatgtaagcaaaaggtttactgaaggaaaataaagagcagggattgtatttatttatttattttgtgacagagtctcactctgtctcctaggctggagtgcagtggtgtgatctcggctcactgcaacctccacctcccgggttcaagcgattctcctgcctcagcctcccaagtagctgggactacaggcacgtgccaccacgcccagctaattttttgtatttttagtagagacggggtttcactgtgttagccaggatggtctcaatctcctgatctcgtgatccacctgcctcggcctcccaaagtgttgggattacaggcgtgagctaccatgcccggcctgggagtttattgaagtagactccaagagaggagccagcaggtccgcctgggaagcagcagtattcacagcaagagtgaggtagcagcagagacaatacactctgaaagatgaggcagagcaggctgctcgaaagatgagccagcaactagagagttctgccttgcggtttttattaggtcacactctatttaggttcctgcctctgtctcaagtctccacctttgtctaatttcctgcctctatcttatgtctccatcttttcgccccacctagttcccgccccaggtttgtgggactctcccttactgtcagctgatgaacctgcaggggcgggtgtcggatatgaatcctatcgaatggtgatgttgctaattactgccactccaggaagggtgtatattggtatttattgcacgtgcatatctcgtaggaatttctcctttgctttctttccctccttagcatgcagctggctacattcccacaggttaactgcagagtgatgactgggcatcttaaggggtgtcttggggtgttccttcctgcatagatatttcccctcctctctgctcatatctagggtgaatgttttggatggtctctggggtgtgagactttccagacctccctttctcagaggctttcccacctgctcatatttatctgcctactccgacagtataaccttgggcaagtcacttgacctctctgagcactggttttctcattatagatcgaaagcattagactaagtcagtggtttccaaactttcccagccacataaccctttctttaaatgaaatcttactggatccctaccatgtaacctgtttactgaacagtcctaatttgatgagatacaaacatgaccagttttatctttcttgcaaccactgccttccaacgtctccattgagccccccttcccattcctaaggccacctcaggcagaccctggtcactttcagtggataaaaagtctgcccagttgtttcagtttaaagcttcgatctgatgtccaacatggggcccacatcctcccatcctccatcctctgtttcgggtttgccccatagtctaaaggattcagaccagggaggagaacatggtctgctctctcctggctccttccctctcctccccagcactcttctggacctctgtcttcagctgttggggcagggaggagggagcagaaaaagaaccttttctgacctcctggctgaagatgtccttggtgcttcaggcatccagctgcttgggggccttcctacctcttgctgaaaggtgtttagcagtcaggtctttgggaccgggtcctggccagatggctccagtgaggctgccttccttggtgctcacttggcacggaggagacccacccattcttgccccacctggcaatgggaggccgcccgctgctgccccaatctgtcctgccctctctttcttctgccccaacaggcaaaagggcagatcagcaaggtctagcataaggagatgcccagccagggaatggcaggtcagcttccccttctcgtgggcacctgtatgtcatacagtgagtggcaccattggaggcccctcccttgacttgggcaggggccaggcatccccaggtctccacagggaggtgcagggaggtaaagaccacagcagttccccaaggctgtgcctccttacgagggggattctcaactcctgctgaacattagatcccatgaaatgctcagtaagagataccaatgtgccgacccccggggccagttaactcagcatcttgagatggagcctgagaatgtttcttttgaaagcacctgaggtgattgcggaaggcagccagggttaggaaccactgccctgtccaaaaagttcccatcaaatgatggagaaaggacctgttagacctgctgatggccagggagggtctgggttctccctttgtaaggtggcaggggcgggcagacttaggacctggtacccttagttttagggctttaggcacaatttgaaagtaccagaagagttcccattcaacattctactataagtggttgccgaacttgtcttagcagcagaactttcctcatacgagtgtctggctgcagcaaggggaggggccagagctttgccagcagcattggaacctgccccccctcacacccctttaatgaaataatcactcaggcccctttggctcactctgagaaccttccgttgctatgttacattggagagagggggccaccctgcagctctctgaagggagaatggggtggaaatggagccagaagcacaggcagagtagagaagcaagggggcacccatagcaggttgtgggagagccagggtgggccaggaggtgggagtagaaaggaagtaggcttgggggtgtggagagggtggctgctgacctcccaattttgctgagaacagccatctctaagccagagtacccagaaaggtgtgctcctccctatgccctgagcagggggaagaagagggaacgtggcctcagaacctgcagcagccaccaccgccgggtcagcacaaggatgggcagaaatccactggggatgagaggcccaccacggagcccctctttaaggtcctagatacgcctctgagcgagggtgatgagcccgcaacgctgccggccccgcgggaccatgggcagagtgtgcagatggaaggctacctgggccgcaagcatgacctggaggggcccaacaagaaggcttccaacaggtcctggaacaacctgtactgtgtgctcaggaacagtgagctaaccttctacaaggatgccaagaacctggccctggggatgccctaccatggggaggaacccctggccctgagacatgccatctgtgagattgctgccaactacaagaagaagaagcacgtctttaagctgaggctgagtaatggcagcgagtggctcttccatggcaaggatgaggaggagatgctgtcctggctgcagggcgtgagcaccgccatcaacgagtcccagagcatccgcgtcaaggcgcagagcctgcccctgccttccctctccggccccgacgccagcctcggcaagaaagacaaggagaagagattcagcttcttccccaaaaagaagtagcaggtggggctggcgggcgcggcggagtcgggacgcgcagagaccgggcagcccaggccttggcctcctctcgccgccgcccgccggtcgaatcgagatgagtcgagtcgcgggccgggcccccgggccccacgctgcactgcaaaagctgccttcgcccgcgtgtcctgggccgacgccccctccatgccctcgcccgcgctggctccgctccagggacaggggctcccagctcctctggcgcctttggggcctccaggcctgggggcaggaaacggttctctgaggcacacgccctcctctcccaccctcctcctgagccgagggggcacaggccccttacccccaacc

SEQ ID NO: 20374 - DNA, 6705 bp, Homo sapiens
  ENST00000389721
tgaggcaggcggagctgctaagagcctgctgacatgacatcggccacagagtttgaaaatgtgggcaaccagccaccttacagcaggatcaatgcccgctgggacgccccagacgacgagctggataatgacaacagctcagccaggctctttgagaggtcccggataaaggccttggcagatgagcgggaagttgttcagaaaaagaccttcacgaaatgggtgaactcgcacctggctcgagtgtcctgccgcatcaccgatctctacaaggacctgcgggatgggcgcatgctcatcaagctgctggaggtgctctctggagagatgctgccaaagcccaccaaggggaagatgcgcatccactgcctggagaatgtggacaaggctctccagttcctcaaggagcagcgtgtacacctggagaacatgggctcccacgacattgtagatggcaaccaccgcctggtcctgggcctcatctggaccatcatcctccgcttccagattcaggacattgtggtccaaactcaggaaggtcgtgaaacacgctcagccaaggatgcgttgctgttgtggtgtcagatgaagacggcaggctaccctcatgttaatgtcaccaactttacctccagctggaaggatggcttggcctttaatgccctgatacacaagcaccggcccgacctgatcgactttgataagctgaaggactccaatgcccggcacaacctggagcacgcattcaatgtggctgagcgccagctgggcatcatcccgctcctcgaccccgaagatgtctttacggaaaaccctgatgagaaatccatcatcacctatgtggtggccttttaccactacttctccaagatgaaggtgctggcagtggagggcaagcgtgtcggcaaggttattgaccatgccattgagactgagaagatgattgaaaagtacagcgggctagcctcggacctgctcacctggatcgagcagaccatcactgtcctgaacagccgcaagtttgccaactcgctgacgggcgtccagcagcagctgcaggccttcagcacctaccgcaccgtggagaagccgcccaagtttcaagagaaggggaatctggaagttctactttttaccatccagtcccggatgagagccaacaatcagaaagtgtacacaccccacgatgggaaactagtgtctgacatcaacagggcctgggaaagcctggaggaagctgagtatcggcgggagctggccctgagaaatgagctcattcggcaggagaagctagagcaactggcccggcgctttgaccggaaggccgcaatgagagagacctggctcagtgaaaaccagcgcctcgtggcccaggataactttgggtatgacctggcagctgtggaggccgccaagaagaagcatgaggccatcgagaccgacacggctgcctacgaggagcgggtgagagccctggaggacctggctcaggagctggagaaagagaactaccatgaccagaagcgcatcacggcccgcaaggacaatatactgcgcctatggagctacctgcaggagctgctgcagtcccggcgccagaggctcgagaccaccctggcactgcagaagctcttccaggacatgctgcacagcatcgactggatggatgagatcaaggctcacctcttgtctgccgagtttgggaagcacttgttggaggttgaagacctgctacagaagcacaagttgatggaagctgacatcgccatccaaggggacaaagtgaaggccatcaccgcagccaccctgaagttcaccgaggggaaagggtaccagccttgtgacccccaggtcatccaggaccgcatcagccacttggagcagtgctttgaggagctgagcaacatggcagctgggcggaaggcccaactggagcagtccaaacgactctggaagttcttctgggagatggatgaggctgagagctggatcaaggagaaggagcagatctattcttccctggactatggcaaagacctgaccagtgtgctcatcttacagcgcaagcacaaggcctttgaggatgagctccgtgggctggatgctcacctggagcagatcttccaggaggctcatggcatggttgcgcgcaagcagtttgggcacccgcagatcgaggcccgcataaaggaggtgtcggcacagtgggaccagctgaaggacctggctgccttctgcaagaagaacctccaggatgctgagaactttttccagttccagggcgatgcggatgacctgaaggcttggctgcaagacgcccaccggctgctctctggtgaagatgtggggcaggacgaaggggccacgcgggccctggggaaaaagcacaaggacttcctggaggagctggaggagagccgtggggtgatggagcacctggagcagcaggcccagggattccccgaagagtttcgggattccccagatgtgacccatcggctgcaggccctgcgggagctctaccaacaggtggtggcccaggcggacctgcgtcagcagaggctgcaggaagccctggacctgtacacggtgttcggggagacagacgcctgtgagctgtggatgggagagaaggagaagtggctggccgagatggaaatgccagacaccctggaggacctggaggtcgtgcagcacaggttcgacatcctggaccaggagatgaagaccttgatgactcagattgatggtgtgaacctcgctgccaacagcttggtagagagtggccacccacgcagcagggaggtgaagcagtaccaggaccatctgaacaccaggtggcaggcatttcagaccctggtgtcggagcggcgggaggctgtggactcagccctccgagtgcacaactactgcgtagattgcgaggagaccagcaagtggatcacggacaagacaaaggtagtggagtccacaaaagacctggggcgggacctggcaggtatcatcgccatccagaggaagttgtcagggctggagcgtgacgtggccgccatccaggcccgtgtggatgccctggagcgtgagtcccagcagctgatggactcgcaccctgagcagaaggaggatattggtcagcggcaaaaacacttggaggagctgtggcagggcctgcagcaatccctgcagggccaggaggacttgctgggggaagtcagccagctgcaggccttcctgcaggatctggatgacttccaggcctggctctccatcacccagaaggctgtggcctctgaggacatgcccgaatccctcccagaggctgagcagctcctgcagcagcatgcaggtatcaaggatgagattgacgggcaccaagacagctaccagcgtgttaaggagtctggggagaaagtgatccaaggccagacggacccagagtatctgcttctgggccagcggctggagggcctggatactggctggaatgccctgggcaggatgtgggagagccgcagccacaccctcgctcagtgccttggcttccaggagttccagaaagatgccaagcaggctgaagccatcctcagcaaccaggaatacactctggctcacttggagcccccagactccctggaagctgcagaggctgggatccggaagtttgaggatttcttggggtctatggagaacaaccgggataaggtcttgagtcctgtggactctggaaacaagctggtagctgagggaaacctatactcagacaagatcaaggagaaggtgcagctgattgaggacaggcacaggaagaacaacgagaaggcccaggaggcctctgtcctactgagagacaacctggagctacagaacttcctccagaactgccaggagctcactctctggatcaacgacaagctgctgacatctcaggatgtctcctatgatgaagcacgaaaccttcacaataaatggctaaagcaccaggcgtttgtggcagagctggcttcccatgaagggtggctagagaacatcgatgcggaaggaaagcagctgatggatgagaagccccagtttacagccctggtgtcccaaaagctggaagccctgcaccggctctgggacgagctgcaggccaccacaaaggagaagacccagcacctctcggctgccaggagctccgacctgcgcttgcagacccatgctgacctcaacaagtggatcagcgccatggaggaccagctgcggtcagacgacccgggcaaggacctgaccagtgtcaatcggatgttggctaagctgaagcgagtggaggaccaagtgaatgtgcgaaaagaggagctgggggagctgtttgcccaggtgccttcaatgggagaggagggaggagatgcagacttgagcatcgagaagcggttcctggacctcctggaacccctaggaaggaggaagaagcagctggaatcatccagagccaagctgcagatcagccgggacttagaggatgagacgctttgggtggaggagaggctgcctctggcccagtcagccgactatggcactaatctgcaaactgtgcaactgttcatgaagaagaaccagacactgcagaatgagattctgggccatacgccgcgggttgaggatgtgctgcagagagggcagcagctggtggaggcggcggagatcgactgccaggaccttgaggagcgcctggggcacctgcagagctcctgggacaggctgcgggaggcagcggccgggaggctgcagcgactgagggacgccaacgaggcacagcagtactacctggatgcagacgaggctgaggcctggattggcgagcaggagctctacgtcatctccgatgagatccccaaggatgaagagggcgccattgtgatgctgaagcgacatttgcggcagcagcgtgcggtggaggactacggccggaacatcaagcagctggccagccgggcccagggcctgctgtctgcaggccaccctgagggggaacagatcatcagacttcaggggcaagtggacaagcactacgcagggctgaaggacgtggcggaagagcgcaagcgcaagctggagaacatgtaccacctgttccagctcaagcgggagaccgacgacctggagcagtggatttcagaaaaggagctagtggcctcttccccggaaatggggcaagactttgaccacgtgactcttctgcgggacaagttccgggactttgcccgggagaccggggcgattgggcaggagcgggtggacaatgtgaatgccttcatcgagcgactcatcgacgcgggccacagcgaggcggccaccatcgccgagtggaaggacgggctgaacgagatgtgggcagacctcctggagctcattgacacgcgcatgcagctgctggccgcctcctatgacctgcaccgctacttctacacgggtgccgagatcctgggcctcatcgacgagaagcaccgcgagctgcccgaggacgtggggctggacgccagcacggccgagtccttccaccgggtgcacacagccttcgagcgggagctccacctgctgggtgtccaggtgcagcagttccaggacgtggccacccgtctgcagacagcatatgctggggagaaggcagaggccatccagaacaaggagcaggaggtgtctgccgcgtggcaggcgctgctcgatgcctgtgccgggcgccggacccagctagtggacacggcggataaattccgcttcttcagcatggcccgtgacctcctctcctggatggagagcatcatccggcagatcgagacccaggagaggcccagggatgtctcctctgtggaactgctcatgaagtatcaccagggcatcaatgcagagattgaaacccggagcaagaacttcagtgcctgcctggagcttggcgagtccctgctgcagcggcagcaccaggcctcagaggagatccgcgagaaactgcagcaggtgatgtccaggaggaaagagatgaatgagaagtgggaagcccgctgggagcggctccgcatgttgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacgcttgagctgaaagaacgccagattgcagagagacccgcagaggagactgggcctcaagaggaggaaggcgagacagcaggggaggctccagtttcccaccatgcggccaccgagagaacgtccccggtcagtctctggtctcgtttgtctagttcctgggagtcactgcagccagagccctctcacccctactaggctcagcccaggtggaggcgagatgagctggcgcagccccgccctccatcctccccacatccctgcagccacctcccagcagagcaggctacgtcctcactgaggtgttcttcatgagagtactagcctcctccactcctccccacagcgcagaggaaacaggccagcccagtgacatgacgttattagttttgttttacctaatgtaataaattttattgtataaatatatcaccatttacatgaggggaaacacta

SEQ ID NO: 20375 - DNA, 6321 bp, Homo sapiens
  ENST00000389720
atgacatcggccacagagtttgaaaatgtgggcaaccagccaccttacagcaggatcaatgcccgctgggacgccccagacgacgagctggataatgacaacagctcagccaggctctttgagaggtcccggataaaggccttggcagatgagcgggaagttgttcagaaaaagaccttcacgaaatgggtgaactcgcacctggctcgagtgtcctgccgcatcaccgatctctacaaggacctgcgggatgggcgcatgctcatcaagctgctggaggtgctctctggagagatgctgccaaagcccaccaaggggaagatgcgcatccactgcctggagaatgtggacaaggctctccagttcctcaaggagcagcgtgtacacctggagaacatgggctcccacgacattgtagatggcaaccaccgcctggtcctgggcctcatctggaccatcatcctccgcttccagattcaggacattgtggtccaaactcaggaaggtcgtgaaacacgctcagccaaggatgcgttgctgttgtggtgtcagatgaagacggcaggctaccctcatgttaatgtcaccaactttacctccagctggaaggatggcttggcctttaatgccctgatacacaagcaccggcccgacctgatcgactttgataagctgaaggactccaatgcccggcacaacctggagcacgcattcaatgtggctgagcgccagctgggcatcatcccgctcctcgaccccgaagatgtctttacggaaaaccctgatgagaaatccatcatcacctatgtggtggccttttaccactacttctccaagatgaaggtgctggcagtggagggcaagcgtgtcggcaaggttattgaccatgccattgagactgagaagatgattgaaaagtacagcgggctagcctcggacctgctcacctggatcgagcagaccatcactgtcctgaacagccgcaagtttgccaactcgctgacgggcgtccagcagcagctgcaggccttcagcacctaccgcaccgtggagaagccgcccaagtttcaagagaaggggaatctggaagttctactttttaccatccagtcccggatgagagccaacaatcagaaagtgtacacaccccacgatgggaaactagtgtctgacatcaacagggcctgggaaagcctggaggaagctgagtatcggcgggagctggccctgagaaatgagctcattcggcaggagaagctagagcaactggcccggcgctttgaccggaaggccgcaatgagagagacctggctcagtgaaaaccagcgcctcgtggcccaggataactttgggtatgacctggcagctgtggaggccgccaagaagaagcatgaggccatcgagaccgacacggctgcctacgaggagcgggtgagagccctggaggacctggctcaggagctggagaaagagaactaccatgaccagaagcgcatcacggcccgcaaggacaatatactgcgcctatggagctacctgcaggagctgctgcagtcccggcgccagaggctcgagaccaccctggcactgcagaagctcttccaggacatgctgcacagcatcgactggatggatgagatcaaggctcacctcttgtctgccgagtttgggaagcacttgttggaggttgaagacctgctacagaagcacaagttgatggaagctgacatcgccatccaaggggacaaagtgaaggccatcaccgcagccaccctgaagttcaccgaggggaaagggtaccagccttgtgacccccaggtcatccaggaccgcatcagccacttggagcagtgctttgaggagctgagcaacatggcagctgggcggaaggcccaactggagcagtccaaacgactctggaagttcttctgggagatggatgaggctgagagctggatcaaggagaaggagcagatctattcttccctggactatggcaaagacctgaccagtgtgctcatcttacagcgcaagcacaaggcctttgaggatgagctccgtgggctggatgctcacctggagcagatcttccaggaggctcatggcatggttgcgcgcaagcagtttgggcacccgcagatcgaggcccgcataaaggaggtgtcggcacagtgggaccagctgaaggacctggctgccttctgcaagaagaacctccaggatgctgagaactttttccagttccagggcgatgcggatgacctgaaggcttggctgcaagacgcccaccggctgctctctggtgaagatgtggggcaggacgaaggggccacgcgggccctggggaaaaagcacaaggacttcctggaggagctggaggagagccgtggggtgatggagcacctggagcagcaggcccagggattccccgaagagtttcgggattccccagatgtgacccatcggctgcaggccctgcgggagctctaccaacaggtggtggcccaggcggacctgcgtcagcagaggctgcaggaagccctggacctgtacacggtgttcggggagacagacgcctgtgagctgtggatgggagagaaggagaagtggctggccgagatggaaatgccagacaccctggaggacctggaggtcgtgcagcacaggttcgacatcctggaccaggagatgaagaccttgatgactcagattgatggtgtgaacctcgctgccaacagcttggtagagagtggccacccacgcagcagggaggtgaagcagtaccaggaccatctgaacaccaggtggcaggcatttcagaccctggtgtcggagcggcgggaggctgtggactcagccctccgagtgcacaactactgcgtagattgcgaggagaccagcaagtggatcacggacaagacaaaggtagtggagtccacaaaagacctggggcgggacctggcaggtatcatcgccatccagaggaagttgtcagggctggagcgtgacgtggccgccatccaggcccgtgtggatgccctggagcgtgagtcccagcagctgatggactcgcaccctgagcagaaggaggatattggtcagcggcaaaaacacttggaggagctgtggcagggcctgcagcaatccctgcagggccaggaggacttgctgggggaagtcagccagctgcaggccttcctgcaggatctggatgacttccaggcctggctctccatcacccagaaggctgtggcctctgaggacatgcccgaatccctcccagaggctgagcagctcctgcagcagcatgcaggtatcaaggatgagattgacgggcaccaagacagctaccagcgtgttaaggagtctggggagaaagtgatccaaggccagacggacccagagtatctgcttctgggccagcggctggagggcctggatactggctggaatgccctgggcaggatgtgggagagccgcagccacaccctcgctcagtgccttggcttccaggagttccagaaagatgccaagcaggctgaagccatcctcagcaaccaggaatacactctggctcacttggagcccccagactccctggaagctgcagaggctgggatccggaagtttgaggatttcttggggtctatggagaacaaccgggataaggtcttgagtcctgtggactctggaaacaagctggtagctgagggaaacctatactcagacaagatcaaggagaaggtgcagctgattgaggacaggcacaggaagaacaacgagaaggcccaggaggcctctgtcctactgagagacaacctggagctacagaacttcctccagaactgccaggagctcactctctggatcaacgacaagctgctgacatctcaggatgtctcctatgatgaagcacgaaaccttcacaataaatggctaaagcaccaggcgtttgtggcagagctggcttcccatgaagggtggctagagaacatcgatgcggaaggaaagcagctgatggatgagaagccccagtttacagccctggtgtcccaaaagctggaagccctgcaccggctctgggacgagctgcaggccaccacaaaggagaagacccagcacctctcggctgccaggagctccgacctgcgcttgcagacccatgctgacctcaacaagtggatcagcgccatggaggaccagctgcggtcagacgacccgggcaaggacctgaccagtgtcaatcggatgttggctaagctgaagcgagtggaggaccaagtgaatgtgcgaaaagaggagctgggggagctgtttgcccaggtgccttcaatgggagaggagggaggagatgcagacttgagcatcgagaagcggttcctggacctcctggaacccctaggaaggaggaagaagcagctggaatcatccagagccaagctgcagatcagccgggacttagaggatgagacgctttgggtggaggagaggctgcctctggcccagtcagccgactatggcactaatctgcaaactgtgcaactgttcatgaagaagaaccagacactgcagaatgagattctgggccatacgccgcgggttgaggatgtgctgcagagagggcagcagctggtggaggcggcggagatcgactgccaggaccttgaggagcgcctggggcacctgcagagctcctgggacaggctgcgggaggcagcggccgggaggctgcagcgactgagggacgccaacgaggcacagcagtactacctggatgcagacgaggctgaggcctggattggcgagcaggagctctacgtcatctccgatgagatccccaaggatgaagagggcgccattgtgatgctgaagcgacatttgcggcagcagcgtgcggtggaggactacggccggaacatcaagcagctggccagccgggcccagggcctgctgtctgcaggccaccctgagggggaacagatcatcagacttcaggggcaagtggacaagcactacgcagggctgaaggacgtggcggaagagcgcaagcgcaagctggagaacatgtaccacctgttccagctcaagcgggagaccgacgacctggagcagtggatttcagaaaaggagctagtggcctcttccccggaaatggggcaagactttgaccacgtgactcttctgcgggacaagttccgggactttgcccgggagaccggggcgattgggcaggagcgggtggacaatgtgaatgccttcatcgagcgactcatcgacgcgggccacagcgaggcggccaccatcgccgagtggaaggacgggctgaacgagatgtgggcagacctcctggagctcattgacacgcgcatgcagctgctggccgcctcctatgacctgcaccgctacttctacacgggtgccgagatcctgggcctcatcgacgagaagcaccgcgagctgcccgaggacgtggggctggacgccagcacggccgagtccttccaccgggtgcacacagccttcgagcgggagctccacctgctgggtgtccaggtgcagcagttccaggacgtggccacccgtctgcagacagcatatgctggggagaaggcagaggccatccagaacaaggagcaggaggtgtctgccgcgtggcaggcgctgctcgatgcctgtgccgggcgccggacccagctagtggacacggcggataaattccgcttcttcagcatggcccgtgacctcctctcctggatggagagcatcatccggcagatcgagacccaggagaggcccagggatgtctcctctgtggaactgctcatgaagtatcaccagggcatcaatgcagagattgaaacccggagcaagaacttcagtgcctgcctggagcttggcgagtccctgctgcagcggcagcaccaggcctcagaggagatccgcgagaaactgcagcaggtgatgtccaggaggaaagagatgaatgagaagtgggaagcccgctgggagcggctccgcatgttgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacggcctcaagaggaggaaggcgagacagcaggggaggctccagtttcccaccatgcggccaccgagagaacgtccccggtcagtctctggtctcgtttgtctag

SEQ ID NO: 20376 - DNA, 580 bp, Homo sapiens
  ENST00000542694
aaaaattagctgggcatggtggtgcacacctatagtcccagccacttggtaggctgagatgggaggatcacttgaacccaggaggctgaggctgccatgagccataatcacatcactgcactccagcctgggtgacagattgaagccctccctctaaaaaaatataactattgtgaagatcggttaggggcccagtgtggaatggggtggctgcaggcagcaagcgtatccatgtggtttagggacacctattcaggccacctgcctgaccactggccccaatcaggagtgaacgattgggtgctaacaggccctgggccttgtggggggtctgtgtcctgttccccctggcagtgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacgcttgagctgaaagaacgccagattgcaga

SEQ ID NO: 20377 - DNA, 10063 bp, Homo sapiens
  ENST00000389722
cagggatccttccatgaagactgaggcaggcggagctgctaagagcctgctgacatgacatcggccacagagtttgaaaatgtgggcaaccagccaccttacagcaggatcaatgcccgctgggacgccccagacgacgagctggataatgacaacagctcagccaggctctttgagaggtcccggataaaggccttggcagatgagcgggaagttgttcagaaaaagaccttcacgaaatgggtgaactcgcacctggctcgagtgtcctgccgcatcaccgatctctacaaggacctgcgggatgggcgcatgctcatcaagctgctggaggtgctctctggagagatgctgccaaagcccaccaaggggaagatgcgcatccactgcctggagaatgtggacaaggctctccagttcctcaaggagcagcgtgtacacctggagaacatgggctcccacgacattgtagatggcaaccaccgcctggtcctgggcctcatctggaccatcatcctccgcttccagattcaggacattgtggtccaaactcaggaaggtcgtgaaacacgctcagccaaggatgcgttgctgttgtggtgtcagatgaagacggcaggctaccctcatgttaatgtcaccaactttacctccagctggaaggatggcttggcctttaatgccctgatacacaagcaccggcccgacctgatcgactttgataagctgaaggactccaatgcccggcacaacctggagcacgcattcaatgtggctgagcgccagctgggcatcatcccgctcctcgaccccgaagatgtctttacggaaaaccctgatgagaaatccatcatcacctatgtggtggccttttaccactacttctccaagatgaaggtgctggcagtggagggcaagcgtgtcggcaaggttattgaccatgccattgagactgagaagatgattgaaaagtacagcgggctagcctcggacctgctcacctggatcgagcagaccatcactgtcctgaacagccgcaagtttgccaactcgctgacgggcgtccagcagcagctgcaggccttcagcacctaccgcaccgtggagaagccgcccaagtttcaagagaaggggaatctggaagttctactttttaccatccagtcccggatgagagccaacaatcagaaagtgtacacaccccacgatgggaaactagtgtctgacatcaacagggcctgggaaagcctggaggaagctgagtatcggcgggagctggccctgagaaatgagctcattcggcaggagaagctagagcaactggcccggcgctttgaccggaaggccgcaatgagagagacctggctcagtgaaaaccagcgcctcgtggcccaggataactttgggtatgacctggcagctgtggaggccgccaagaagaagcatgaggccatcgagaccgacacggctgcctacgaggagcgggtgagagccctggaggacctggctcaggagctggagaaagagaactaccatgaccagaagcgcatcacggcccgcaaggacaatatactgcgcctatggagctacctgcaggagctgctgcagtcccggcgccagaggctcgagaccaccctggcactgcagaagctcttccaggacatgctgcacagcatcgactggatggatgagatcaaggctcacctcttgtctgccgagtttgggaagcacttgttggaggttgaagacctgctacagaagcacaagttgatggaagctgacatcgccatccaaggggacaaagtgaaggccatcaccgcagccaccctgaagttcaccgaggggaaagggtaccagccttgtgacccccaggtcatccaggaccgcatcagccacttggagcagtgctttgaggagctgagcaacatggcagctgggcggaaggcccaactggagcagtccaaacgactctggaagttcttctgggagatggatgaggctgagagctggatcaaggagaaggagcagatctattcttccctggactatggcaaagacctgaccagtgtgctcatcttacagcgcaagcacaaggcctttgaggatgagctccgtgggctggatgctcacctggagcagatcttccaggaggctcatggcatggttgcgcgcaagcagtttgggcacccgcagatcgaggcccgcataaaggaggtgtcggcacagtgggaccagctgaaggacctggctgccttctgcaagaagaacctccaggatgctgagaactttttccagttccagggcgatgcggatgacctgaaggcttggctgcaagacgcccaccggctgctctctggtgaagatgtggggcaggacgaaggggccacgcgggccctggggaaaaagcacaaggacttcctggaggagctggaggagagccgtggggtgatggagcacctggagcagcaggcccagggattccccgaagagtttcgggattccccagatgtgacccatcggctgcaggccctgcgggagctctaccaacaggtggtggcccaggcggacctgcgtcagcagaggctgcaggaagccctggacctgtacacggtgttcggggagacagacgcctgtgagctgtggatgggagagaaggagaagtggctggccgagatggaaatgccagacaccctggaggacctggaggtcgtgcagcacaggttcgacatcctggaccaggagatgaagaccttgatgactcagattgatggtgtgaacctcgctgccaacagcttggtagagagtggccacccacgcagcagggaggtgaagcagtaccaggaccatctgaacaccaggtggcaggcatttcagaccctggtgtcggagcggcgggaggctgtggactcagccctccgagtgcacaactactgcgtagattgcgaggagaccagcaagtggatcacggacaagacaaaggtagtggagtccacaaaagacctggggcgggacctggcaggtatcatcgccatccagaggaagttgtcagggctggagcgtgacgtggccgccatccaggcccgtgtggatgccctggagcgtgagtcccagcagctgatggactcgcaccctgagcagaaggaggatattggtcagcggcaaaaacacttggaggagctgtggcagggcctgcagcaatccctgcagggccaggaggacttgctgggggaagtcagccagctgcaggccttcctgcaggatctggatgacttccaggcctggctctccatcacccagaaggctgtggcctctgaggacatgcccgaatccctcccagaggctgagcagctcctgcagcagcatgcaggtatcaaggatgagattgacgggcaccaagacagctaccagcgtgttaaggagtctggggagaaagtgatccaaggccagacggacccagagtatctgcttctgggccagcggctggagggcctggatactggctggaatgccctgggcaggatgtgggagagccgcagccacaccctcgctcagtgccttggcttccaggagttccagaaagatgccaagcaggctgaagccatcctcagcaaccaggaatacactctggctcacttggagcccccagactccctggaagctgcagaggctgggatccggaagtttgaggatttcttggggtctatggagaacaaccgggataaggtcttgagtcctgtggactctggaaacaagctggtagctgagggaaacctatactcagacaagatcaaggagaaggtgcagctgattgaggacaggcacaggaagaacaacgagaaggcccaggaggcctctgtcctactgagagacaacctggagctacagaacttcctccagaactgccaggagctcactctctggatcaacgacaagctgctgacatctcaggatgtctcctatgatgaagcacgaaaccttcacaataaatggctaaagcaccaggcgtttgtggcagagctggcttcccatgaagggtggctagagaacatcgatgcggaaggaaagcagctgatggatgagaagccccagtttacagccctggtgtcccaaaagctggaagccctgcaccggctctgggacgagctgcaggccaccacaaaggagaagacccagcacctctcggctgccaggagctccgacctgcgcttgcagacccatgctgacctcaacaagtggatcagcgccatggaggaccagctgcggtcagacgacccgggcaaggacctgaccagtgtcaatcggatgttggctaagctgaagcgagtggaggaccaagtgaatgtgcgaaaagaggagctgggggagctgtttgcccaggtgccttcaatgggagaggagggaggagatgcagacttgagcatcgagaagcggttcctggacctcctggaacccctaggaaggaggaagaagcagctggaatcatccagagccaagctgcagatcagccgggacttagaggatgagacgctttgggtggaggagaggctgcctctggcccagtcagccgactatggcactaatctgcaaactgtgcaactgttcatgaagaagaaccagacactgcagaatgagattctgggccatacgccgcgggttgaggatgtgctgcagagagggcagcagctggtggaggcggcggagatcgactgccaggaccttgaggagcgcctggggcacctgcagagctcctgggacaggctgcgggaggcagcggccgggaggctgcagcgactgagggacgccaacgaggcacagcagtactacctggatgcagacgaggctgaggcctggattggcgagcaggagctctacgtcatctccgatgagatccccaaggatgaagagggcgccattgtgatgctgaagcgacatttgcggcagcagcgtgcggtggaggactacggccggaacatcaagcagctggccagccgggcccagggcctgctgtctgcaggccaccctgagggggaacagatcatcagacttcaggggcaagtggacaagcactacgcagggctgaaggacgtggcggaagagcgcaagcgcaagctggagaacatgtaccacctgttccagctcaagcgggagaccgacgacctggagcagtggatttcagaaaaggagctagtggcctcttccccggaaatggggcaagactttgaccacgtgactcttctgcgggacaagttccgggactttgcccgggagaccggggcgattgggcaggagcgggtggacaatgtgaatgccttcatcgagcgactcatcgacgcgggccacagcgaggcggccaccatcgccgagtggaaggacgggctgaacgagatgtgggcagacctcctggagctcattgacacgcgcatgcagctgctggccgcctcctatgacctgcaccgctacttctacacgggtgccgagatcctgggcctcatcgacgagaagcaccgcgagctgcccgaggacgtggggctggacgccagcacggccgagtccttccaccgggtgcacacagccttcgagcgggagctccacctgctgggtgtccaggtgcagcagttccaggacgtggccacccgtctgcagacagcatatgctggggagaaggcagaggccatccagaacaaggagcaggaggtgtctgccgcgtggcaggcgctgctcgatgcctgtgccgggcgccggacccagctagtggacacggcggataaattccgcttcttcagcatggcccgtgacctcctctcctggatggagagcatcatccggcagatcgagacccaggagaggcccagggatgtctcctctgtggaactgctcatgaagtatcaccagggcatcaatgcagagattgaaacccggagcaagaacttcagtgcctgcctggagcttggcgagtccctgctgcagcggcagcaccaggcctcagaggagatccgcgagaaactgcagcaggtgatgtccaggaggaaagagatgaatgagaagtgggaagcccgctgggagcggctccgcatgttgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacgcttgagctgaaagaacgccagattgcagagagacccgcagaggagactgggcctcaagaggaggaaggcgagacagcaggggaggctccagtttcccaccatgcggccaccgagagaacgtccccgggggaagaagagggaacgtggcctcagaacctgcagcagccaccaccgccgggtcagcacaaggatgggcagaaatccactggggatgagaggcccaccacggagcccctctttaaggtcctagatacgcctctgagcgagggtgatgagcccgcaacgctgccggccccgcgggaccatgggcagagtgtgcagatggaaggctacctgggccgcaagcatgacctggaggggcccaacaagaaggcttccaacaggtcctggaacaacctgtactgtgtgctcaggaacagtgagctaaccttctacaaggatgccaagaacctggccctggggatgccctaccatggggaggaacccctggccctgagacatgccatctgtgagattgctgccaactacaagaagaagaagcacgtctttaagctgaggctgagtaatggcagcgagtggctcttccatggcaaggatgaggaggagatgctgtcctggctgcagggcgtgagcaccgccatcaacgagtcccagagcatccgcgtcaaggcgcagagcctgcccctgccttccctctccggccccgacgccagcctcggcaagaaagacaaggagaagagattcagcttcttccccaaaaagaagtagcaggtggggctggcgggcgcggcggagtcgggacgcgcagagaccgggcagcccaggccttggcctcctctcgccgccgcccgccggtcgaatcgagatgagtcgagtcgcgggccgggcccccgggccccacgctgcactgcaaaagctgccttcgcccgcgtgtcctgggccgacgccccctccatgccctcgcccgcgctggctccgctccagggacaggggctcccagctcctctggcgcctttggggcctccaggcctgggggcaggaaacggttctctgaggcacacgccctcctctcccaccctcctcctgagccgagggggcacaggccccttacccccaaccaaaaaaaaaaaaaaaaaagagctggagaaggctgatggggttcttcaaacgctgcccgttcctaaagcaagtcttgcttcgggtcacctcccacctggtggcagccagggaaaggggaaaggaagaagacactggaaatgcatggccagccccctaggggcatgaggaaggagccttcaggtggcccacaaagccctagctctgggccaggggctctggggggctgaggggaccagactgggtgcagggccttgggagctgccagcctccttcccactgggcttccgcagaactgggactctcacttcaggggccaccacatccctcctctctgcttctccccccagatcaaagggtaccctcccacggttggcagggcctggctgagtgcctctagcaccctttgtgccaccacaggcggtcccaggaagggcagcaaggtcagaccattcctcattgaaaaccgtggctagggcacagggctctgatctgaaggagtgacaggtgcgtcacaacactgcctaaggctctccctctcaatgctgggaccctcgccccactcccagtggcagccaaaccagcaatatccaacagacataggccccctacgggacagtgtgggcccccagatataagatggataccccccgcacctgcagtaaagcatcccaaagccaaatgctcaattgcatcctgtctgcagctgggactttggagggtaatggctgggcagacagtaaagttgatcatctgttttctcggggtggcagacgcagccatgtcttggtatcaccacccatgtgacagctactcctgcacaactgggacaaatgtcagggccagagccatgaaggtgtggtaccccttgatcagcttctccacgtcctggccccaggtcttggcggggagggggtcacatgagtacagaggtcaaatatctaccaccctccagccctgagcaccagaagctctgcaaccaacgtccccaggaatggccttccccttgctgctcaggtcatacttctggaggaagagaaagctcattccatattttccccaccactctactccgaaagcaacacagttctggcccagtatcaaactagggttaggtccaagagagcagtcaagcgggtcgggggtgggggggagggcggagggcagcaggcattttcccccaaggaaaccatgaaagtccccagggcctgcagtcaagtttctatcaccttccccgtgagaaggaccttagttccatggagatgaagtgggtgaggttcaggtagaagccacaggggcaggcatccagaatgaggccccctgaggaaccctgagtgctgaccagtgccggcagaaatcagttccaccctgtggccctgacactatatgtcagggtgacaccaactgcagcaggcaggagccacaggaaggaagacgtcatccgatggagcctgacatccccaggttcccgccctggtgagcaaggtcttcatttggctttggtacatatgaccctatacagggaacctagtgtgtatcactcaccagcctctttctgtatctggggaaaccaaggcagtgaggtgactgcactcacctagcaataaagtaggcctttggtgcacttgcaggcatgtcctcctctggggcagagagcaggttccttgctgaagggcagatggtggcaaacatctccctcaactgtttccctgggccagtctttagggagcctagggacaagggcccaccctcccccttccacgtgtgccaaatcagcacctgaagtgaggcatttccagcaagcaactccacagacccgagaaaggaagggctctagtggaagagctagcatctcaccaccccaggtcccctggcctggtccagggcagccagctgcatgtgaccattctgttgccagctccccacacatccctcctgtcacccaggctccaagacattcgaccaactagactgaaaatgcaggcatccagctttgggagaccctgtgtgtgccacaccagggctaagctctcccagtgccctagcaaggtctttttttttttttctctccttattctactctacagtcttttgacagtattcccaaacgaggttgacacagctccagtccacaccagcataccaggcttccttcccagggcagtttagaggaagctccttctgggcaaggtcaggcggtcctccttccctctctccttcccctttgtcccagcctcaactgactctggctgtgggaggtgtggagggtccttaggcttccctccccaacctggcctccaccaacacccctaacaggaggcccgtggaaggctcagcctctcctccgcatccctcctccttcctgcctatcggagggagccagggtcccctaggctgaccctgaatcctcttcctcccttcatgggaggggggcaggaatccagaggaggatgaagccagcgggaccacatggcttggtggcttggacaaacaagctcagggaggaaatgaggaggcggcggctgcagaggaatgcaaccctgttgggcacagaccatgcaatctggggctggccctggggccagctgggtcctgtcctccacctgctcaaccgtgcttccaccaaccagaggaaacccatttactagtttttctaataaatcaataatgctcc

SEQ ID NO: 20378 - DNA, 8128 bp, Homo sapiens
  ENST00000533211
gatgttctgggagggagagccggcccagctgcctgaaggaggacgcgagagcgaggggacgggtgagaggaatgcttagcggagacggactggaggtgcccggagaggaaaggggaacggaggctggatctcgggaaacctcgtcggcagtgtcattagaggaaggatcgcgtgtctcggggatacggattttggaggaaaagcagaatagggacaaaggcttcccaggtggcttcccctcttcccctgggggctgatttccactgagcagccaaccgcagcctctggccacaaggagagcggagcacaggagcaggaagccgcctaccaccatgagcagcacgctgtcacccacagactttgacagcttggaaatccagggccagtacagtgacatcaacaaccgctgggaccttcctgactcggactgggacaatgacagcagctcggcccgcctctttgagaggtctcgcattaaggctctggcagatgaacgagaagctgtgcagaagaaaaccttcaccaagtgggtaaactcgcacctggcccgggtcacgtgccgggtgggggacctgtacagcgacctccgggacggacgcaacctgctgaggctcctcgaggtgctctcgggagagatactgccaaagcctacaaagggccgcatgcggatccactgcctggagaacgtggacaaggcactgcagttcctcaaggagcagaaagtgcacttggaaaacatgggctcccatgacattgtggacggaaaccaccgactgacccttgggctggtctggaccatcatccttcgattccagatccaagacatcagtgtggagacagaagacaacaaggagaagaagtcagccaaggatgccctgcttctgtggtgccagatgaagactgcaggttatcccaacgtcaatgtacacaacttcaccaccagctggagagatggactagctttcaacgccatcgtgcataaacaccggccagacctgctggattttgagtctctgaagaagtgtaatgcacactataatctgcagaatgcattcaatctggctgaaaaggaactgggacttaccaagctgctggatcccgaagacgtgaatgtggaccagccagatgagaagtcaatcattacctatgtggctacttactaccattacttctccaagatgaaggccctggccgtggaaggcaagagaattggcaaggtgctggaccatgccatggaggcagagcgcctggtggagaaatacgagtccctggcctcggagctgctgcagtggatcgagcaaacgatcgtgaccctcaatgaccggcagttggccaactcccttagcggggtccagaaccagctgcagtccttcaactcctaccgcaccgtggagaagccgcccaagtttaccgagaaagggaacttggaagtgctgctcttcaccatccagagcaagcttcgggccaacaaccagaaggtctacacgccccgcgagggccggctcatctcggacatcaacaaggcttgggagcggctggagaaggcggagcacgagcgtgagctggccctgcgcaccgagctcatccgccaggagaagctggagcagctggccgcccgcttcgaccgcaaggctgccatgcgggagacctggctcagcgagaaccagcgcctcgtgtcccaggacaactttgggctggagctggcagctgtcgaggcagcagtacggaagcacgaagccattgagacggacatcgtggcctacagcggccgggtgcaggcagtggacgccgtggctgcagagctggccgccgagcgctaccacgacatcaagcgcatcgccgctcggcagcacaacgtggcacggctctgggacttcttgcggcagatggtggccgcccggcgggagcggctcctcctcaacctggagctgcagaaggtgttccaggacctgctctacctcatggactggatggaagagatgaagggccggctgcagtctcaggacctgggcaggcacctagcaggagtggaggacctgctgcagctgcacgagctggtggaggcagacatcgccgtgcaggccgagagggtgcgggccgtcagcgcctctgccctgcgcttctgcaacccagggaaagagtatagaccttgcgacccgcagctggtgtcggagcgggtggccaagctagagcagagctatgaggcactgtgcgagttggcagcggcgcggcgggcccggctggaggaatcacggcggctctggcgtttcctctgggaggtgggtgaagctgaggcctgggtgcgggagcagcagcacctcctggcctcagccgacacgggccgagacctgaccggtgccctccgcctgctcaacaagcacacagccctgcggggcgagatgagcggccggctggggcccctgaagctcaccctggagcagggccagcagttggtggccgagggtcaccctggggcaagccaggcctctgcccgtgcagctgaactccaagcccagtgggagcggctagaggccctggccgaggagcgtgcccagcggctggcccaagccgccagcctctaccagttccaggccgatgcaaacgacatggaggcctggttggttgacgcactgcgcctggtgtccagccccgagctggggcacgacgagttctccacgcaggctctagccaggcagcatcgggccctggaggaggagattcgaagccaccggccaaccctggacgccttgagggaacaggcagcagccctgccccccacactgagccgcacgcccgaggtgcagagccgggtgcccaccctggagcggcactacgaggagctgcaggcccgggcaggcgagcgagcgcgggccttggaggcagccctggcgctctacaccatgctcagcgaggccggggcctgtggactctgggtggaggagaaggagcagtggctcaacgggctggccctgcctgaacgcctggaggacctggaggtcgtgcagcagaggttcgagaccctggagcctgaaatgaacacccttgcagcacaaatcaccgcggtgaatgacattgccgagcagttactgaaggccaaccccccaggcaaagaccgcattgtcaacacccaggagcagctcaaccacaggtggcagcagtttcggcgtctggcagacggcaagaaggcagctctcacctcagccctgagcatccagaactaccacttagagtgcacggagacccaggcctggatgagagagaagaccaaagtcatcgagtccacccagggcctaggcaacgatctggctggggtgctggccctgcagcgcaagctggccggcacggagcgggacctggaggccatcgccgcccgggtgggcgaactgactcgagaggcaaatgccctggctgccggccatcccgctcaggcagtggccatcaacgcccggctgagagaggtgcagaccggctgggaggacctcagggccaccatgcggcgtcgagaagagtcgctgggggaggcgcggcggctgcaggacttcttgcgcagcttggatgacttccaggcctggctaggccgcactcagactgctgtggcctctgaagaagggccggccaccctgcctgaggcagaggccctcctggcccaacatgcagccctgcggggagaggtggagcgggcccagagcgagtatagccggctgcgagccctgggcgaggaggtgacccgggaccaggctgacccccagtgcctcttcctacgacagcgactggaggccctgggaactggctgggaggagctgggccgaatgtgggagagccggcaaggtcgcctggcccaggcccacggcttccagggattcctgcgggatgctcgtcaggctgagggcgtgctcagcagccaggaatatgttctgtctcacacggagatgccagggacactccaggctgctgatgctgccattaaaaaactggaggacttcatgagcaccatggacgccaatggggaacggatccacgggctcctggaggctggccgccagctggtatctgaaggcaacatccacgccgacaagattcgggaaaaggcagactccattgagaggaggcacaagaagaatcaagacgcagcgcagcaatttctgggccgtcttcgggacaaccgggagcagcagcatttcctgcaagattgtcacgagctgaagctctggatcgacgagaagatgctgacagcccaggacgtgtcctatgacgaggcccgcaacctgcatactaagtggcagaagcaccaggcattcatggccgagctggctgccaacaaagactggctggacaaggtggacaaggaagggcgagagctcacccttgagaagccagagctgaaagccctggtgtcggagaagctgagagacctgcacaggcgctgggacgagctggagaccaccacccaagccaaggcccgcagcctctttgatgccaaccgagctgagctgtttgcccagagctgctgtgccctggagagctggctggagagcctgcaggcccagctgcactcggatgactacggcaaggacctcaccagcgtcaacatcctgctcaagaagcagcagatgctggaatgggagatggctgtgagagagaaggaggtggaggcaatccaggcccaggccaaagcactggcccaggaggaccagggtgcaggggaggtggagagaacctcgagggccgtggaggagaagttcagggccttgtgccagcccatgcgggaacgctgccggcgcctgcaggcttctcgcgagcagcaccagttccaccgcgatgtggaagatgagattttgtgggtgacagagcggctgcccatggccagctccatggagcatggcaaggacctgcccagcgtccagcttctcatgaagaaaaaccagaccctgcagaaagagattcagggccatgagccccggatcgcggacctgagggagcggcagcgtgctctaggtgcagcagcagcaggtccagagctggctgagctgcaggaaatgtggaaacgcctgggccacgagctggaacttcgagggaagcgactggaggatgccctgcgagcccagcagttctaccgcgatgccgccgaggcggaggcctggatgggcgagcaggaattacacatgatgggccaggagaaggccaaggatgagctgagtgcccaggcagaggtgaagaagcaccaggtgctggagcaagccctggccgactacgcgcagaccatccaccagctggcggccagcagccaggacatgattgaccacgagcacccagagagcactcggatatccatccgccaagcccaggtggacaagctgtatgccggcctgaaggagctggctggagagcggcgggagcgcctgcaggagcacctccggctgtgccagctccgccgcgagctggatgacctggaacagtggatccaggagcgcgaggtggtggcggcctcccacgagctgggccaggactacgagcatgtgactatgctccgagacaaattccgagagttctcccgggacacaagcaccatcggtcaggagcgcgtagatagcgccaatgcgctggccaatgggctcattgctgggggccatgctgcacgggccaccgtggccgagtggaaggacagtctcaacgaggcctgggctgacctgcttgagctgctggacacacggggtcaggtgctggccgcggcgtacgagctgcagcgcttcctgcacggggcacgccaagccctggcgcgggtgcagcacaagcagcagcagcttccggacgggactggccgcgacctcaacgctgccgaggccctgcagcgccgacactgtgcctacgagcatgacattcaggccctcagcccccaggtccagcaggtgcaggacgacggccaccggctccagaaggcctacgctggagacaaggctgaggagatcggccgccacatgcaggccgtggccgaggcctgggcccagcttcagggaagctctgccgcccgccggcagctgctgctggacaccacagacaagttccgcttcttcaaggctgtccgggaactgatgctctggatggatgaggtcaacctgcagatggatgcccaggagcgtccccgggatgtgtcctccgcggatctagtcatcaagaaccagcaaggcatcaaggcagagatagaggcccgggcagaccgcttctcctcctgcatcgacatggggaaggagctgctggccaggagccactatgcggccgaggagatctcagagaagctgtctcagctgcaggcacggcgccaggagacagctgagaagtggcaggagaagatggactggcttcagctggttttggaggtgcttgtgtttggaagagatgcagggatggcagaggcctggctctgcagccaggagccactggtgcgcagcgctgagctgggttgcacggtcgacgaagttgagagcctcatcaagcggcacgaggccttccagaagtcagcagtggcctgggaggagcgattctgtgcgctggagaagcttactgcgctagaggagcgggagaaggagcgaaagagaaagagggaggaggaggagcggcggaaacagccgcctgctcccgaacccacagccagtgtgcctccaggggacctggtgggcggccagacagcttctgacaccacctgggacggaacccagccacggccaccaccatccacacaagcacccagtgttaatggagtctgcacagatggagagccctcacagcccctgctgggacaacagagacttgagcacagcagcttccccgaagggccgggacctggctcaggggacgaagccaatgggccccggggagagaggcagacccggactcggggcccggccccatctgcaatgccccagagcaggtctaccgagtcagcccatgctgccaccctgccgcctcgaggcccagagccatctgcccaggagcagatggaggggatgctgtgccgcaagcaggagatggaggccttcgggaagaaggctgccaacaggtcctggcagaacgtgtactgtgtcctgcggcgtgggagcctcggcttttacaaggatgccaaggcagccagcgcgggagtgccataccacggagaagtgcctgtcagcctggccagggcccagggcagcgtcgcctttgattaccgaaagcgcaaacatgtcttcaagctgggcttacaggatggaaaagaatatttattccaggccaaggatgaggcagagatgagctcgtggctacgggtggtgaatgcagccattgccacagcgtcttctgcctctggagagcctgaagagccggtggtgcccagcaccacccggggcatgacccgggccatgaccatgcccccagtgtcacccgtcggggctgaggggcctgttgtgctccgcagcaaagacggcagagaacgagagcgagaaaaacgcttcagcttctttaagaagaacaagtagttgggggcaaggtcccaggccaactccctccctccgttcaggaaactgccagggacagtcgacagggaccgccctcttgtcaggacaactgcctgctgctagggtctgttgccaaggtcaacccatcaccaggaactgtcactggggacgagtccatgttcccaagggcagcccttctcttctgctgtttaattccagactggtggtgggacccaggtaaccccctctcccacccccgccgacttctcccctttccccagcctcgtgcctctgtccctcaccacggtgtggacagtgccgcaccctcaacataggccatgtggggagtggctgcccctgcctcagggtcattctcctgccatgcgagggcactcgccttctgccttctggttcctcacccctcagaccagccaggaacctctcagagctgaagcaggccctgggggcagaagtgccagatgacagtcagaggcgcaggagccctccctccccacccccaccctgtaactccagctgccactccatctccagctgctctcaatggcttccaggtgtgttgttcggggacagccaccgccttgagtctggccaaggaggtgattaaacagctcagcttctctcac

SEQ ID NO: 20379 - DNA, 8085 bp, Homo sapiens
  ENST00000529997
atgagcagcacgctgtcacccacagactttgacagcttggaaatccagggccagtacagtgacatcaacaaccgctgggaccttcctgactcggactgggacaatgacagcagctcggcccgcctctttgagaggtctcgcattaaggctctggcagatgaacgagaagctgtgcagaagaaaaccttcaccaagtgggtaaactcgcacctggcccgggtcacgtgccgggtgggggacctgtacagcgacctccgggacggacgcaacctgctgaggctcctcgaggtgctctcgggagagatactgccaaagcctacaaagggccgcatgcggatccactgcctggagaacgtggacaaggcactgcagttcctcaaggagcagaaagtgcacttggaaaacatgggctcccatgacattgtggacggaaaccaccgactgacccttgggctggtctggaccatcatccttcgattccagatccaagacatcagtgtggagacagaagacaacaaggagaagaagtcagccaaggatgccctgcttctgtggtgccagatgaagactgcaggttatcccaacgtcaatgtacacaacttcaccaccagctggagagatggactagctttcaacgccatcgtgcataaacaccggccagacctgctggattttgagtctctgaagaagtgtaatgcacactataatctgcagaatgcattcaatctggctgaaaaggaactgggacttaccaagctgctggatcccgaagacgtgaatgtggaccagccagatgagaagtcaatcattacctatgtggctacttactaccattacttctccaagatgaaggccctggccgtggaaggcaagagaattggcaaggtgctggaccatgccatggaggcagagcgcctggtggagaaatacgagtccctggcctcggagctgctgcagtggatcgagcaaacgatcgtgaccctcaatgaccggcagttggccaactcccttagcggggtccagaaccagctgcagtccttcaactcctaccgcaccgtggagaagccgcccaagtttaccgagaaagggaacttggaagtgctgctcttcaccatccagagcaagcttcgggccaacaaccagaaggtctacacgccccgcgagggccggctcatctcggacatcaacaaggcttgggagcggctggagaaggcggagcacgagcgtgagctggccctgcgcaccgagctcatccgccaggagaagctggagcagctggccgcccgcttcgaccgcaaggctgccatgcgggagacctggctcagcgagaaccagcgcctcgtgtcccaggacaactttgggctggagctggcagctgtcgaggcagcagtacggaagcacgaagccattgagacggacatcgtggcctacagcggccgggtgcaggcagtggacgccgtggctgcagagctggccgccgagcgctaccacgacatcaagcgcatcgccgctcggcagcacaacgtggcacggctctgggacttcttgcggcagatggtggccgcccggcgggagcggctcctcctcaacctggagctgcagaaggtgttccaggacctgctctacctcatggactggatggaagagatgaagggccggctgcagtctcaggacctgggcaggcacctagcaggagtggaggacctgctgcagctgcacgagctggtggaggcagacatcgccgtgcaggccgagagggtgcgggccgtcagcgcctctgccctgcgcttctgcaacccagggaaagagtatagaccttgcgacccgcagctggtgtcggagcgggtggccaagctagagcagagctatgaggcactgtgcgagttggcagcggcgcggcgggcccggctggaggaatcacggcggctctggcgtttcctctgggaggtgggtgaagctgaggcctgggtgcgggagcagcagcacctcctggcctcagccgacacgggccgagacctgaccggtgccctccgcctgctcaacaagcacacagccctgcggggcgagatgagcggccggctggggcccctgaagctcaccctggagcagggccagcagttggtggccgagggtcaccctggggcaagccaggcctctgcccgtgcagctgaactccaagcccagtgggagcggctagaggccctggccgaggagcgtgcccagcggctggcccaagccgccagcctctaccagttccaggccgatgcaaacgacatggaggcctggttggttgacgcactgcgcctggtgtccagccccgagctggggcacgacgagttctccacgcaggctctagccaggcagcatcgggccctggaggaggagattcgaagccaccggccaaccctggacgccttgagggaacaggcagcagccctgccccccacactgagccgcacgcccgaggtgcagagccgggtgcccaccctggagcggcactacgaggagctgcaggcccgggcaggcgagcgagcgcgggccttggaggcagccctggcgctctacaccatgctcagcgaggccggggcctgtggactctgggtggaggagaaggagcagtggctcaacgggctggccctgcctgaacgcctggaggacctggaggtcgtgcagcagaggttcgagaccctggagcctgaaatgaacacccttgcagcacaaatcaccgcggtgaatgacattgccgagcagttactgaaggccaaccccccaggcaaagaccgcattgtcaacacccaggagcagctcaaccacaggtggcagcagtttcggcgtctggcagacggcaagaaggcagctctcacctcagccctgagcatccagaactaccacttagagtgcacggagacccaggcctggatgagagagaagaccaaagtcatcgagtccacccagggcctaggcaacgatctggctggggtgctggccctgcagcgcaagctggccggcacggagcgggacctggaggccatcgccgcccgggtgggcgaactgactcgagaggcaaatgccctggctgccggccatcccgctcaggcagtggccatcaacgcccggctgagagaggtgcagaccggctgggaggacctcagggccaccatgcggcgtcgagaagagtcgctgggggaggcgcggcggctgcaggacttcttgcgcagcttggatgacttccaggcctggctaggccgcactcagactgctgtggcctctgaagaagggccggccaccctgcctgaggcagaggccctcctggcccaacatgcagccctgcggggagaggtggagcgggcccagagcgagtatagccggctgcgagccctgggcgaggaggtgacccgggaccaggctgacccccagtgcctcttcctacgacagcgactggaggccctgggaactggctgggaggagctgggccgaatgtgggagagccggcaaggtcgcctggcccaggcccacggcttccagggattcctgcgggatgctcgtcaggctgagggcgtgctcagcagccaggaatatgttctgtctcacacggagatgccagggacactccaggctgctgatgctgccattaaaaaactggaggacttcatgagcaccatggacgccaatggggaacggatccacgggctcctggaggctggccgccagctggtatctgaaggcaacatccacgccgacaagattcgggaaaaggcagactccattgagaggaggcacaagaagaatcaagacgcagcgcagcaatttctgggccgtcttcgggacaaccgggagcagcagcatttcctgcaagattgtcacgagctgaagctctggatcgacgagaagatgctgacagcccaggacgtgtcctatgacgaggcccgcaacctgcatactaagtggcagaagcaccaggcattcatggccgagctggctgccaacaaagactggctggacaaggtggacaaggaagggcgagagctcacccttgagaagccagagctgaaagccctggtgtcggagaagctgagagacctgcacaggcgctgggacgagctggagaccaccacccaagccaaggcccgcagcctctttgatgccaaccgagctgagctgtttgcccagagctgctgtgccctggagagctggctggagagcctgcaggcccagctgcactcggatgactacggcaaggacctcaccagcgtcaacatcctgctcaagaagcagcagatgctggaatgggagatggctgtgagagagaaggaggtggaggcaatccaggcccaggccaaagcactggcccaggaggaccagggtgcaggggaggtggagagaacctcgagggccgtggaggagaagttcagggccttgtgccagcccatgcgggaacgctgccggcgcctgcaggcttctcgcgagcagcaccagttccaccgcgatgtggaagatgagattttgtgggtgacagagcggctgcccatggccagctccatggagcatggcaaggacctgcccagcgtccagcttctcatgaagaaaaaccagaccctgcagaaagagattcagggccatgagccccggatcgcggacctgagggagcggcagcgtgctctaggtgcagcagcagcaggtccagagctggctgagctgcaggaaatgtggaaacgcctgggccacgagctggaacttcgagggaagcgactggaggatgccctgcgagcccagcagttctaccgcgatgccgccgaggcggaggcctggatgggcgagcaggaattacacatgatgggccaggagaaggccaaggatgagctgagtgcccaggcagaggtgaagaagcaccaggtgctggagcaagccctggccgactacgcgcagaccatccaccagctggcggccagcagccaggacatgattgaccacgagcacccagagagcactcggatatccatccgccaagcccaggtggacaagctgtatgccggcctgaaggagctggctggagagcggcgggagcgcctgcaggagcacctccggctgtgccagctccgccgcgagctggatgacctggaacagtggatccaggagcgcgaggtggtggcggcctcccacgagctgggccaggactacgagcatgtgactatgctccgagacaaattccgagagttctcccgggacacaagcaccatcggtcaggagcgcgtagatagcgccaatgcgctggccaatgggctcattgctgggggccatgctgcacgggccaccgtggccgagtggaaggacagtctcaacgaggcctgggctgacctgcttgagctgctggacacacggggtcaggtgctggccgcggcgtacgagctgcagcgcttcctgcacggggcacgccaagccctggcgcgggtgcagcacaagcagcagcagcttccggacgggactggccgcgacctcaacgctgccgaggccctgcagcgccgacactgtgcctacgagcatgacattcaggccctcagcccccaggtccagcaggtgcaggacgacggccaccggctccagaaggcctacgctggagacaaggctgaggagatcggccgccacatgcaggccgtggccgaggcctgggcccagcttcagggaagctctgccgcccgccggcagctgctgctggacaccacagacaagttccgcttcttcaaggctgtccgggaactgatgctctggatggatgaggtcaacctgcagatggatgcccaggagcgtccccgggatgtgtcctccgcggatctagtcatcaagaaccagcaaggcatcaaggcagagatagaggcccgggcagaccgcttctcctcctgcatcgacatggggaaggagctgctggccaggagccactatgcggccgaggagatctcagagaagctgtctcagctgcaggcacggcgccaggagacagctgagaagtggcaggagaagatggactggcttcagctggttttggaggtgcttgtgtttggaagagatgcagggatggcagaggcctggctctgcagccaggagccactggtgcgcagcgctgagctgggttgcacggtcgacgaagttgagagcctcatcaagcggcacgaggccttccagaagtcagcagtggcctgggaggagcgattctgtgcgctggagaagcttactgcgctagaggagcgggagaaggagcgaaagagaaagagggaggaggaggagcggcggaaacagccgcctgctcccgaacccacagccagtgtgcctccaggggacctggtgggcggccagacagcttctgacaccacctgggacggaacccagccacggccaccaccatccacacaagcacccagtgttaatggagtctgcacagatggagagccctcacagcccctgctgggacaacagagacttgagcacagcagcttccccgaagggccgggacctggctcaggggacgaagccaatgggccccggggagagaggcagacccggactcggggcccggccccatctgcaatgccccagagcaggtctaccgagtcagcccatgctgccaccctgccgcctcgaggcccagagccatctgcccaggagcagatggaggggatgctgtgccgcaagcaggagatggaggccttcgggaagaaggctgccaacaggtcctggcagaacgtgtactgtgtcctgcggcgtgggagcctcggcttttacaaggatgccaaggcagccagcgcgggagtgccataccacggagaagtgcctgtcagcctggccagggcccagggcagcgtcgcctttgattaccgaaagcgcaaacatgtcttcaagctgggcttacaggatggaaaagaatatttattccaggccaaggatgaggtgagctgtccttcgtgttcctctctgtccgtgccattccagaagcttccagctgcagactccccttctttccctgtcctccctctttttcctggtcttgtcctttgtggtaagactggatgtgtgcgacggccgcaccaggccgcactccctgtctaagccggccacattctcctaatagcatgaaacagtcagctcactttctgcctcctcctcttacacttccctgctgtccactgcggccaactcagcacagtgtccttgaagctgattgagggtctttccatccacaggcagagatgagctcgtggctacgggtggtgaatgcagccattgccacagcgtcttctgcctctggagagcctgaagagccggtggtgcccagcaccacccggggcatgacccgggccatgaccatgcccccagtgtcacccgtcggggctgaggggcctgttgtgctccgcagcaaagacggcagagaacgagagcgagaaaaacgcttcagcttctttaagaagaacaagtagttgggggcaaggtcccaggccaactccctccctccgttcaggaaactgccagggacagtcgacagggaccgccctcttgtcaggacaactgcctgctgctagggtctgttgccaaggtcaacccatcaccaggaactgtcactggggacgagtccatgttcccaagggcagcccttctcttctgctgtttaattccagactggtggtgggacccaggtaaccccctctcccacccccgccgacttctcccctttccccagcctcgtgcctctgtccctcaccacggtgtggacagtgccgcaccctcaacataggccatgtggggagtggctgcccctgcctcagggtcattctcctgccatgcgagggcactcgccttctgccttctggttcctcacccctcagaccagccaggaacctctcagagctgaagcaggccctgggggcagaagtgccagatgacagtcagaggcgcaggagccctccctccccacccccaccctgtaactccagctgccactccatctccagctgctctcaatggcttccaggtgtgttgttcggggacagccaccgccttgagtctggccaaggaggtgattaaacagctcagcttctc

SEQ ID NO: 20380 - DNA, 573 bp, Homo sapiens
  ENST00000528051
atgattacgctctcaccagcagctacctggcagatccggattctcagctctgccctgtggcctctctctcccaacagcttacaggatggaaaagaatatttattccaggccaaggatgaggcagagatgagctcgtggctacgggtggtgaatgcagccattgccacagcgtcttctgcctctggagagcctgaagagccggtggtgcccagcaccacccggggcatgacccgggccatgaccatgcccccagtgtcacccgtcggggctgaggggcctgttgtgctccgcagcaaagacggcagagaacgagagcgagaaaaacgcttcagcttctttaagaagaacaagtagttgggggcaaggtcccaggccaactccctccctccgttcaggaaactgccagggacagtcgacagggaccgccctcttgtcaggacaactgcctgctgctagggtctgttgccaaggtcaacccatcaccaggaactgtcactggggacgagtccatgttcccaagggcagcccttctcttctgctgtttaattccagactggtggtgggacccaggta

SEQ ID NO: 20381 - DNA, 473 bp, Homo sapiens
  ENST00000530775
ccgcctcgaggcccagagccatctgcccaggagcagatggaggggatgctgtgccgcaagcaggagatggaggccttcgggaagaaggctgccaacaggtcctggcagaacgtgtactgtgtcctgcggcgtgggagcctcggcttttacaaggatgccaaggcagccagcgcgggagtgccataccacggagaagtgcctgtcagcctggccagggcccagggcagcgtcgcctttgattaccgaaagcgcaaacatgtcttcaagctggggtaggaacagggaacagtgctctcgggatgggaggagagttgggagtgacacaggtgagccatgagtcaggtccagagggaggggagttcctgtaaggagcctgagtggagtaaccaggccagccacttggggatagtgtagatgagggaggcggagattctggttgtctccacaccaaggggagcaggagaaccaagacc

SEQ ID NO: 20382 - DNA, 571 bp, Homo sapiens
  ENST00000532650
catggccactgtgccctgccagtggccactctgacccaccatcttcctgcaacccccgatcctgccagttttggaggtgcttgtgtttggaagagatgcagggatggcagaggcctggctctgcagccaggagccactggtgcgcagcgctgagctgggttgcacggtcgacgaagttgagagcctcatcaagcggcacgaggccttccagaagtcagcagtggcctgggaggagcgattctgtgcgctggagaagcttactgcgctagaggagcgggagaaggagcgaaagagaaagagggaggaggaggagcggcggaaacagccgcctgctcccgaacccacagccagtgtgcctccaggggacctggtgggcggccagacagcttctgacaccacctgggacggaacccagccacggccaccaccatccacacaagcacccagtgttaatggagtctgcacagatggagagccctcacagcccctgctgggacaacagagacttgagcacagcagcttccccgaagggccgggacctggctcaggggacgaagccaatgggccccgg

SEQ ID NO: 20383 - DNA, 573 bp, Homo sapiens
  ENST00000532902
ggcagccaggactgaggcaggctgcggctccttggagtcccccgctctgcctgactctgacccggggctccgcaggtccagcaggtgcaggacgacggccaccggctccagaaggcctacgctggagacaaggctgaggagatcggccgccacatgcaggccgtggccgaggcctgggcccagcttcagggaagctctgccgcccgccggcagctgctgctggacaccacagacaagttccgcttcttcaaggctgtccgggaactgatgctctggatggatgaggtcaacctgcagatggatgcccaggagcgtccccgggatgtgtcctccgcggatctagtcatcaagaaccagcaaggcatcaaggcagagatagaggcccgggcagaccgcttctcctcctgcatcgacatggggaaggagctgctggccaggagccactatgcggccgaggagatctcagagaagctgtctcagctgcaggcacggcgccaggagacagctgagaagtggcaggagaagatggactggcttcagctggttttggaggtgcttgtgtttggaagagat

SEQ ID NO: 20384 - DNA, 462 bp, Homo sapiens
  ENST00000530665
ccctgttttatgtttggtccagctgaagctctggatcgacgagaagatgctgacagcccaggacgtgtcctatgacgaggcccgcaacctgcatactaagtggcagaagcaccaggcattcatggccgagctggctgccaacaaagactggctggacaaggtggacaaggaagggcgagagctcacccttgagaagccagagctgaaagccctggtgtcggagaagctgagagacctgcacaggcgctgggacgagctggagaccaccacccaagccaaggcccgcagcctctttgatgccaaccgagctgagctgtttgcccagagctgctgtgccctggagagctggctggagagcctgcaggcccagctgcactcggatgactacggcaaggacctcaccagcgtcaacatcctgctcaagaagcagcagatgctggaatgggagatggctgtgagaga

SEQ ID NO: 20385 - DNA, 859 bp, Homo sapiens
  ENST00000527010
tgatttgggcataattccttcctctcctaagcaggcagcagttcaccttggttaaggaccttggaccttagaccactcagacgctaacaaaccaaggagaaacccagccgtgtcaggcctagaaatgtctgcccccacccccacccccctcaagacggtgactaggccggaattctcctggttgataaatgagaggagctgagaagcgctgagatgcctgtttggagcatctgatctgtagaagacgaatcttcactgtgccatggagatgttctgggagggagagccggcccagctgcctgaaggaggacgcgagagcgaggggacgggtgagaggaatgcttagcggagacggactggaggtgcccggagaggaaaggggaacggaggctggatctcgggaaacctcgtcggcagtgtcattagaggaaggatcgcgtgtctcggggatacggattttggaggaaaagcagaatagggacaaaggagcaggaagccgcctaccaccatgagcagcacgctgtcacccacagactttgacagcttggaaatccagggccagtacagtgacatcaacaaccgctgggaccttcctgactcggactgggacaatgacagcagctcggcccgcctctttgagaggtctcgcattaaggctctggcagatgaacgagaagctgtgcagaagaaaaccttcaccaagtgggtaaactcgcacctggcccgggtcacgtgccgggtgggggacctgtacagcgacctccgggacggacgcaacctgctgaggctcctcgaggtgctctcgggagagatactgccaaagcctacaaagggccgcatgcggatccactgcctggag

SEQ ID NO: 20386 - DNA, 7866 bp, Homo sapiens
  ENST00000309996
ccactgagcagccaaccgcagcctctggccacaaggagagcggagcacaggagcaggaagccgcctaccaccatgagcagcacgctgtcacccacagactttgacagcttggaaatccagggccagtacagtgacatcaacaaccgctgggaccttcctgactcggactgggacaatgacagcagctcggcccgcctctttgagaggtctcgcattaaggctctggcagatgaacgagaagctgtgcagaagaaaaccttcaccaagtgggtaaactcgcacctggcccgggtcacgtgccgggtgggggacctgtacagcgacctccgggacggacgcaacctgctgaggctcctcgaggtgctctcgggagagatactgccaaagcctacaaagggccgcatgcggatccactgcctggagaacgtggacaaggcactgcagttcctcaaggagcagaaagtgcacttggaaaacatgggctcccatgacattgtggacggaaaccaccgactgacccttgggctggtctggaccatcatccttcgattccagatccaagacatcagtgtggagacagaagacaacaaggagaagaagtcagccaaggatgccctgcttctgtggtgccagatgaagactgcaggttatcccaacgtcaatgtacacaacttcaccaccagctggagagatggactagctttcaacgccatcgtgcataaacaccggccagacctgctggattttgagtctctgaagaagtgtaatgcacactataatctgcagaatgcattcaatctggctgaaaaggaactgggacttaccaagctgctggatcccgaagacgtgaatgtggaccagccagatgagaagtcaatcattacctatgtggctacttactaccattacttctccaagatgaaggccctggccgtggaaggcaagagaattggcaaggtgctggaccatgccatggaggcagagcgcctggtggagaaatacgagtccctggcctcggagctgctgcagtggatcgagcaaacgatcgtgaccctcaatgaccggcagttggccaactcccttagcggggtccagaaccagctgcagtccttcaactcctaccgcaccgtggagaagccgcccaagtttaccgagaaagggaacttggaagtgctgctcttcaccatccagagcaagcttcgggccaacaaccagaaggtctacacgccccgcgagggccggctcatctcggacatcaacaaggcttgggagcggctggagaaggcggagcacgagcgtgagctggccctgcgcaccgagctcatccgccaggagaagctggagcagctggccgcccgcttcgaccgcaaggctgccatgcgggagacctggctcagcgagaaccagcgcctcgtgtcccaggacaactttgggctggagctggcagctgtcgaggcagcagtacggaagcacgaagccattgagacggacatcgtggcctacagcggccgggtgcaggcagtggacgccgtggctgcagagctggccgccgagcgctaccacgacatcaagcgcatcgccgctcggcagcacaacgtggcacggctctgggacttcttgcggcagatggtggccgcccggcgggagcggctcctcctcaacctggagctgcagaaggtgttccaggacctgctctacctcatggactggatggaagagatgaagggccggctgcagtctcaggacctgggcaggcacctagcaggagtggaggacctgctgcagctgcacgagctggtggaggcagacatcgccgtgcaggccgagagggtgcgggccgtcagcgcctctgccctgcgcttctgcaacccagggaaagagtatagaccttgcgacccgcagctggtgtcggagcgggtggccaagctagagcagagctatgaggcactgtgcgagttggcagcggcgcggcgggcccggctggaggaatcacggcggctctggcgtttcctctgggaggtgggtgaagctgaggcctgggtgcgggagcagcagcacctcctggcctcagccgacacgggccgagacctgaccggtgccctccgcctgctcaacaagcacacagccctgcggggcgagatgagcggccggctggggcccctgaagctcaccctggagcagggccagcagttggtggccgagggtcaccctggggcaagccaggcctctgcccgtgcagctgaactccaagcccagtgggagcggctagaggccctggccgaggagcgtgcccagcggctggcccaagccgccagcctctaccagttccaggccgatgcaaacgacatggaggcctggttggttgacgcactgcgcctggtgtccagccccgagctggggcacgacgagttctccacgcaggctctagccaggcagcatcgggccctggaggaggagattcgaagccaccggccaaccctggacgccttgagggaacaggcagcagccctgccccccacactgagccgcacgcccgaggtgcagagccgggtgcccaccctggagcggcactacgaggagctgcaggcccgggcaggcgagcgagcgcgggccttggaggcagccctggcgctctacaccatgctcagcgaggccggggcctgtggactctgggtggaggagaaggagcagtggctcaacgggctggccctgcctgaacgcctggaggacctggaggtcgtgcagcagaggttcgagaccctggagcctgaaatgaacacccttgcagcacaaatcaccgcggtgaatgacattgccgagcagttactgaaggccaaccccccaggcaaagaccgcattgtcaacacccaggagcagctcaaccacaggtggcagcagtttcggcgtctggcagacggcaagaaggcagctctcacctcagccctgagcatccagaactaccacttagagtgcacggagacccaggcctggatgagagagaagaccaaagtcatcgagtccacccagggcctaggcaacgatctggctggggtgctggccctgcagcgcaagctggccggcacggagcgggacctggaggccatcgccgcccgggtgggcgaactgactcgagaggcaaatgccctggctgccggccatcccgctcaggcagtggccatcaacgcccggctgagagaggtgcagaccggctgggaggacctcagggccaccatgcggcgtcgagaagagtcgctgggggaggcgcggcggctgcaggacttcttgcgcagcttggatgacttccaggcctggctaggccgcactcagactgctgtggcctctgaagaagggccggccaccctgcctgaggcagaggccctcctggcccaacatgcagccctgcggggagaggtggagcgggcccagagcgagtatagccggctgcgagccctgggcgaggaggtgacccgggaccaggctgacccccagtgcctcttcctacgacagcgactggaggccctgggaactggctgggaggagctgggccgaatgtgggagagccggcaaggtcgcctggcccaggcccacggcttccagggattcctgcgggatgctcgtcaggctgagggcgtgctcagcagccaggaatatgttctgtctcacacggagatgccagggacactccaggctgctgatgctgccattaaaaaactggaggacttcatgagcaccatggacgccaatggggaacggatccacgggctcctggaggctggccgccagctggtatctgaaggcaacatccacgccgacaagattcgggaaaaggcagactccattgagaggaggcacaagaagaatcaagacgcagcgcagcaatttctgggccgtcttcgggacaaccgggagcagcagcatttcctgcaagattgtcacgagctgaagctctggatcgacgagaagatgctgacagcccaggacgtgtcctatgacgaggcccgcaacctgcatactaagtggcagaagcaccaggcattcatggccgagctggctgccaacaaagactggctggacaaggtggacaaggaagggcgagagctcacccttgagaagccagagctgaaagccctggtgtcggagaagctgagagacctgcacaggcgctgggacgagctggagaccaccacccaagccaaggcccgcagcctctttgatgccaaccgagctgagctgtttgcccagagctgctgtgccctggagagctggctggagagcctgcaggcccagctgcactcggatgactacggcaaggacctcaccagcgtcaacatcctgctcaagaagcagcagatgctggaatgggagatggctgtgagagagaaggaggtggaggcaatccaggcccaggccaaagcactggcccaggaggaccagggtgcaggggaggtggagagaacctcgagggccgtggaggagaagttcagggccttgtgccagcccatgcgggaacgctgccggcgcctgcaggcttctcgcgagcagcaccagttccaccgcgatgtggaagatgagattttgtgggtgacagagcggctgcccatggccagctccatggagcatggcaaggacctgcccagcgtccagcttctcatgaagaaaaaccagaccctgcagaaagagattcagggccatgagccccggatcgcggacctgagggagcggcagcgtgctctaggtgcagcagcagcaggtccagagctggctgagctgcaggaaatgtggaaacgcctgggccacgagctggaacttcgagggaagcgactggaggatgccctgcgagcccagcagttctaccgcgatgccgccgaggcggaggcctggatgggcgagcaggaattacacatgatgggccaggagaaggccaaggatgagctgagtgcccaggcagaggtgaagaagcaccaggtgctggagcaagccctggccgactacgcgcagaccatccaccagctggcggccagcagccaggacatgattgaccacgagcacccagagagcactcggatatccatccgccaagcccaggtggacaagctgtatgccggcctgaaggagctggctggagagcggcgggagcgcctgcaggagcacctccggctgtgccagctccgccgcgagctggatgacctggaacagtggatccaggagcgcgaggtggtggcggcctcccacgagctgggccaggactacgagcatgtgactatgctccgagacaaattccgagagttctcccgggacacaagcaccatcggtcaggagcgcgtagatagcgccaatgcgctggccaatgggctcattgctgggggccatgctgcacgggccaccgtggccgagtggaaggacagtctcaacgaggcctgggctgacctgcttgagctgctggacacacggggtcaggtgctggccgcggcgtacgagctgcagcgcttcctgcacggggcacgccaagccctggcgcgggtgcagcacaagcagcagcagcttccggacgggactggccgcgacctcaacgctgccgaggccctgcagcgccgacactgtgcctacgagcatgacattcaggccctcagcccccaggtccagcaggtgcaggacgacggccaccggctccagaaggcctacgctggagacaaggctgaggagatcggccgccacatgcaggccgtggccgaggcctgggcccagcttcagggaagctctgccgcccgccggcagctgctgctggacaccacagacaagttccgcttcttcaaggctgtccgggaactgatgctctggatggatgaggtcaacctgcagatggatgcccaggagcgtccccgggatgtgtcctccgcggatctagtcatcaagaaccagcaaggcatcaaggcagagatagaggcccgggcagaccgcttctcctcctgcatcgacatggggaaggagctgctggccaggagccactatgcggccgaggagatctcagagaagctgtctcagctgcaggcacggcgccaggagacagctgagaagtggcaggagaagatggactggcttcagctggttttggaggtgcttgtgtttggaagagatgcagggatggcagaggcctggctctgcagccaggagccactggtgcgcagcgctgagctgggttgcacggtcgacgaagttgagagcctcatcaagcggcacgaggccttccagaagtcagcagtggcctgggaggagcgattctgtgcgctggagaagcttactgcgctagaggagcgggagaaggagcgaaagagaaagagggaggaggaggagcggcggaaacagccgcctgctcccgaacccacagccagtgtgcctccaggggacctggtgggcggccagacagcttctgacaccacctgggacggaacccagccacggccaccaccatccacacaagcacccagtgttaatggagtctgcacagatggagagccctcacagcccctgctgggacaacagagacttgagcacagcagcttccccgaagggccgggacctggctcaggggacgaagccaatgggccccggggagagaggcagacccggactcggggcccggccccatctgcaatgccccagagcaggtctaccgagtcagcccatgctgccaccctgccgcctcgaggcccagagccatctgcccaggagcagatggaggggatgctgtgccgcaagcaggagatggaggccttcgggaagaaggctgccaacaggtcctggcagaacgtgtactgtgtcctgcggcgtgggagcctcggcttttacaaggatgccaaggcagccagcgcgggagtgccataccacggagaagtgcctgtcagcctggccagggcccagggcagcgtcgcctttgattaccgaaagcgcaaacatgtcttcaagctgggcttacaggatggaaaagaatatttattccaggccaaggatgaggcagagatgagctcgtggctacgggtggtgaatgcagccattgccacagcgtcttctgcctctggagagcctgaagagccggtggtgcccagcaccacccggggcatgacccgggccatgaccatgcccccagtgtcacccgtcggggctgaggggcctgttgtgctccgcagcaaagacggcagagaacgagagcgagaaaaacgcttcagcttctttaagaagaacaagtagttgggggcaaggtcccaggccaactccctccctccgttcaggaaactgccagggacagtcgacagggaccgccctcttgtcaggacaactgcctgctgctagggtctgttgccaaggtcaacccatcaccaggaactgtcactggggacgagtccatgttcccaagggcagcccttctcttctgctgtttaattccagactggtggtgggacccaggtaaccccctctcccacccccgccgacttctcccctttccccagcctcgtgcctctgtccctcaccacggtgtggacagtgccgcaccctcaacataggccatgtggggagtggctgcccctgcctcagggtcattctcctgccatgcgagggcactcgccttctgccttctggttcctcacccctcagaccagccaggaacctctcagagctgaagcaggccctgggggcagaagtgccagatgacagtcagaggcgcaggagccctccctccccacccccaccctgtaactccagctgccactccatctccagctgctctcaatggcttccaggtgtgttgttcggggacagccaccgccttgagtctggccaaggaggtgattaaacagctcagcttctctc

SEQ ID NO: 20387 - DNA, 3498 bp, Homo sapiens
  ENST00000617502
ccactgagcagccaaccgcagcctctggccacaaggagagcggagcacaggagcaggaagccgcctaccaccatgagcagcacgctgtcacccacagactttgacagcttggaaatccagggccagtacagtgacatcaacaaccgctgggaccttcctgactcggactgggacaatgacagcagctcggcccgcctctttgagaggtctcgcattaaggctctggcagatgaacgagaagctgtgcagaagaaaaccttcaccaagtgggtaaactcgcacctggcccgggtcacgtgccgggtgggggacctgtacagcgacctccgggacggacgcaacctgctgaggctcctcgaggtgctctcgggagagatactgccaaagcctacaaagggccgcatgcggatccactgcctggagaacgtggacaaggcactgcagttcctcaaggagcagaaagtgcacttggaaaacatgggctcccatgacattgtggacggaaaccaccgactgacccttgggctggtctggaccatcatccttcgattccagatccaagacatcagtgtggagacagaagacaacaaggagaagaagtcagccaaggatgccctgcttctgtggtgccagatgaagactgcaggttatcccaacgtcaatgtacacaacttcaccaccagctggagagatggactagctttcaacgccatcgtgcataaacaccggccagacctgctggattttgagtctctgaagaagtgtaatgcacactataatctgcagaatgcattcaatctggctgaaaaggaactgggacttaccaagctgctggatcccgaagacgtgaatgtggaccagccagatgagaagtcaatcattacctatgtggctacttactaccattacttctccaagatgaaggccctggccgtggaaggcaagagaattggcaaggtgctggaccatgccatggaggcagagcgcctggtggagaaatacgagtccctggcctcggagctgctgcagtggatcgagcaaacgatcgtgaccctcaatgaccggcagttggccaactcccttagcggggtccagaaccagctgcagtccttcaactcctaccgcaccgtggagaagccgcccaagtttaccgagaaagggaacttggaagtgctgctcttcaccatccagagcaagcttcgggccaacaaccagaaggtctacacgccccgcgagggccggctcatctcggacatcaacaaggcttgggagcggctggagaaggcggagcacgagcgtgagctggccctgcgcaccgagctcatccgccaggagaagctggagcagctggccgcccgcttcgaccgcaaggctgccatgcgggagacctggctcagcgagaaccagcgcctcgtgtcccaggacaactttgggctggagctggcagctgtcgaggcagcagtacggaagcacgaagccattgagacggacatcgtggcctacagcggccgggtgcaggcagtggacgccgtggctgcagagctggccgccgagcgctaccacgacatcaagcgcatcgccgctcggcagcacaacgtggcacggctctgggacttcttgcggcagatggtggccgcccggcgggagcggctcctcctcaacctggagctgcagaaggtgttccaggacctgctctacctcatggactggatggaagagatgaagggccggctgcagtctcaggacctgggcaggcacctagcaggagtggaggacctgctgcagctgcacgagctggtggaggcagacatcgccgtgcaggccgagagggtgcgggccgtcagcgcctctgccctgcgcttctgcaacccagggaaagagtatagaccttgcgacccgcagctggtgtcggagcgggttgcaaagcttactgcgctagaggagcgggagaaggagcgaaagagaaagagggaggaggaggagcggcggaaacagccgcctgctcccgaacccacagccagtgtgcctccaggggacctggtgggcggccagacagcttctgacaccacctgggacggaacccagccacggccaccaccatccacacaagcacccagtgttaatggagtctgcacagatggagagccctcacagcccctgctgggacaacagagacttgagcacagcagcttccccgaagggccgggacctggctcaggggacgaagccaatgggccccggggagagaggcagacccggactcggggcccggccccatctgcaatgccccagagcaggtctaccgagtcagcccatgctgccaccctgccgcctcgaggcccagagccatctgcccaggagcagatggaggggatgctgtgccgcaagcaggagatggaggccttcgggaagaaggctgccaacaggtcctggcagaacgtgtactgtgtcctgcggcgtgggagcctcggcttttacaaggatgccaaggcagccagcgcgggagtgccataccacggagaagtgcctgtcagcctggccagggcccagggcagcgtcgcctttgattaccgaaagcgcaaacatgtcttcaagctgggcttacaggatggaaaagaatatttattccaggccaaggatgaggcagagatgagctcgtggctacgggtggtgaatgcagccattgccacagcgtcttctgcctctggagagcctgaagagccggtggtgcccagcaccacccggggcatgacccgggccatgaccatgcccccagtgtcacccgtcggggctgaggggcctgttgtgctccgcagcaaagacggcagagaacgagagcgagaaaaacgcttcagcttctttaagaagaacaagtagttgggggcaaggtcccaggccaactccctccctccgttcaggaaactgccagggacagtcgacagggaccgccctcttgtcaggacaactgcctgctgctagggtctgttgccaaggtcaacccatcaccaggaactgtcactggggacgagtccatgttcccaagggcagcccttctcttctgctgtttaattccagactggtggtgggacccaggtaaccccctctcccacccccgccgacttctcccctttccccagcctcgtgcctctgtccctcaccacggtgtggacagtgccgcaccctcaacataggccatgtggggagtggctgcccctgcctcagggtcattctcctgccatgcgagggcactcgccttctgccttctggttcctcacccctcagaccagccaggaacctctcagagctgaagcaggccctgggggcagaagtgccagatgacagtcagaggcgcaggagccctccctccccacccccaccctgtaactccagctgccactccatctccagctgctctcaatggcttccaggtgtgttgttcggggacagccaccgccttgagtctggccaaggaggtgattaaacagctcagcttctctc

SEQ ID NO: 20388 - DNA, 2890 bp, Homo sapiens
  ENST00000611817
cacaaggagagcggagcacaggagcaggaagccgcctaccaccatgagcagcacgctgtcacccacagactttgacagcttggaaatccagggccagtacagtgacatcaacaaccgctgggaccttcctgactcggactgggacaatgacagcagctcggcccgcctctttgagaggtctcgcattaaggctctggcagatgaacgagaagctgtgcagaagaaaaccttcaccaagtgggtaaactcgcacctggcccgggtcacgtgccgggtgggggacctgtacagcgacctccgggacggacgcaacctgctgaggctcctcgaggtgctctcgggagagatactgccaaagcctacaaagggccgcatgcggatccactgcctggagaacgtggacaaggcactgcagttcctcaaggagcagaaagtgcacttggaaaacatgggctcccatgacattgtggacggaaaccaccgactgacccttgggctggtctggaccatcatccttcgattccagatccaagacatcagtgtggagacagaagacaacaaggagaagaagtcagccaaggatgccctgcttctgtggtgccagatgaagactgcaggttatcccaacgtcaatgtacacaacttcaccaccagctggagagatggactagctttcaacgccatcgtgcataaacaccggccagacctgctggattttgagtctctgaagaagtgtaatgcacactataatctgcagaatgcattcaatctggctgaaaaggaactgggacttaccaagctgctggatcccgaagacgtgaatgtggaccagccagatgagaagtcaatcattacctatgtggctacttactaccattacttctccaagatgaaggccctggccgtggaaggcaagagaattggcaaggtgctggaccatgccatggaggcagagcgcctggtggagaaatacgagtccctggcctcggagctgctgcagtggatcgagcaaacgatcgtgaccctcaatgaccggcagttggccaactcccttagcggggtccagaaccagctgcagtccttcaactcctaccgcaccgtggagaagccgcccaagtttaccgagaaagggaacttggaagtgctgctcttcaccatccagagcaagcttcgggccaacaaccagaaggtctacacgccccgcgagggccggctcatctcggacatcaacaaggcttgggagcggctggagaaggcggagcacgagcgtgagctggccctgcgcaccgagctcatccgccaggagaagctggagcagctggccgcccgcttcgaccgcaaggctgccatgcgggagacctggctcagcgagaaccagcgcctcgtgtcccaggacaactttgggctggagctggcagctgtcgaggcagcagtacggaagcacgaagccattgagacggacatcgtggcctacagcggccgggtgcaggcagtggacgccgtggctgcagagctggccgccgagcgctaccacgacatcaagcgcatcgccgctcggcagcacaacgtggcacggctctgggacttcttgcggcagatggtggccgcccggcgggagcggctcctcctcaacctggagctgcagaaggtgttccaggacctgctctacctcatggactggatggaagagatgaagggccggctgcagtctcaggacctgggcaggcacctagcaggagtggaggacctgctgcagctgcacgagctggtggaggcagacatcgccgtgcaggccgagagggtgcgggccgtcagcgcctctgccctgcgcttctgcaacccagggaaagagtatagaccttgcgacccgcagctggtgtcggagcgggtggccaagcttactgcgctagaggagcgggagaaggagcgaaagagaaagagggaggaggaggagcggcggaaacagccgcctgctcccgaacccacagccagtgtgcctccaggggacctggtgggcggccagacagcttctgacaccacctgggacggaacccagccacggccaccaccatccacacaagcacccagtgttaatggagtctgcacagatggagagccctcacagcccctgctgggacaacagagacttgagcacagcagcttccccgaagggccgggacctggctcaggggacgaagccaatgggccccggggagagaggcagacccggactcggggcccggccccatctgcaatgccccagagcaggtctaccgagtcagcccatgctgccaccctgccgcctcgaggcccagagccatctgcccaggagcagatggaggggatgctgtgccgcaagcaggagatggaggccttcgggaagaaggctgccaacaggtcctggcagaacgtgtactgtgtcctgcggcgtgggagcctcggcttttacaaggatgccaaggcagccagcgcgggagtgccataccacggagaagtgcctgtcagcctggccagggcccagggcagcgtcgcctttgattaccgaaagcgcaaacatgtcttcaagctgggcttacaggatggaaaagaatatttattccaggccaaggatgaggcagagatgagctcgtggctacgggtggtgaatgcagccattgccacagcgtcttctgcctctggagagcctgaagagccggtggtgcccagcaccacccggggcatgacccgggccatgaccatgcccccagtgtcacccgtcggggctgaggggcctgttgtgctccgcagcaaagacggcagagaacgagagcgagaaaaacgcttcagcttctttaagaagaacaagtagttgggggcaaggtcccaggccaactccctccctccgttcagg

SEQ ID NO: 20389 - DNA, 5754 bp, Homo sapiens
  ENST00000336349
taaaagcggaagttacgcagggactcgcgagcgctgtggcggccctgaaaggatataggccgtggagggaagggggcgggcagacggcataggaaggcgccggaagtggtcccgcagaggcggggtgggagtggggctcccgaggcagtgcagttggctgtagctgggcgcctcggttaggtgcgctgtcagtcctttccgagtgcctggcccagtctctcccgcctcggcccaacatggacttcagagaaattctcatgatagcttccaagggacaaggtgtcaacaatgtgccgaaaaggtatagtttggcagtggggcctccaaaaaaagacccaaaagttaaaggtgtccaatcagcagctgtacaagcttttcttaaaaggaaagaagaggagctgagacgaaaagccttagaggagaaaaggagaaaagaggaactagtgaaaaagcgaattgagctcaaacatgacaagaaagcaagagctatggccaagaggacaaaggataatttccatggttacaatgggattcctattgaggaaaagtcaaagaagaggcaggcaacagaaagccataccagccaaggaaccgaccgagagtatgaaatggaagaagagaatgaattcctcgagtacaatcacgcagagtcagagcaggagtatgaggaagagcaagaacctcccaaagttgaaagcaaaccaaaggtcccccttaaaagtgccccaccacccatgaacttcactgatttactcaggctggctgagaaaaagcagtttgaaccagtggaaatcaaggtagtgaagaaatcagaagagcgacctatgaccgcagaagaacttagggagcgagaattccttgaacgaaagcataggagaaaaaaacttgagacagatggaaaactacctccaactgtgtccaaaaaggcaccctctcagaaagaaagtgtgggcacaaaacttagcaaaggttctggagacaggcatccttcttccaaaggaatgccccttcctcatgctgagaagaaatcaagacccagcatggccaatgagaaacacctcgctttgtcttcatccaaatccatgccaggagagaggatcaaggcaggatctggcaatagctcccaaccctcacttcgtgagggccacgacaaacctgtttttaatggagctggaaagcctcattccagcacctcttcaccaagtgtcccaaagacttctgctagcaggactcagaaatctgctgttgagcacaaagccaaaaaatctctgtcccatcctagccattccaggcctgggcccatggtcaccccacacaataaggctaagagtccaggtgtcaggcagccaggcagcagctctagctcagcccctgggcagcccagcacaggggttgctcgacccacagttagttctggccctgtgcctaggcgccagaatggcagctccagctcaggacctgagcgatcaatcagtgggtccaagaagccaaccaatgactcaaatccctctaggcggacagtcagtggtacatgtggccctggacaacctgcaagcagctcaggtggccctgggcgacccatcagtggttcagttagttctgcaagacccttgggcagctctcgtggccctggccggcctgtgagcagtccacatgaacttcgacgaccagtgagtggcttgggccccccggggcggtctgtcagtggccctgggagatccataagtggctcaattccagctggacggactgtcagtaattcagtcccaggaagaccagtgagcagcttgggacctgggcaaacagttagtagctcaggtcccactataaagcctaagtgcactgttgtctccgaaacaatttcttccaagaatatcattagccggtccagcaatggacagatgaatggaatgaagcctcccctatctggctacagagctgcccaaggtcctcaaaggcttcccttccctactggttacaaaaggcagcgagaatatgaagaggaagatgacgatgatgatgaatacgactctgaaatggaagattttattgaagatgaaggagagcctcaggaagaaatatccaagcacattagagaaatctttggttatgaccgaaaaaaatacaaagatgaaagtgattatgccttacgttacatggaaagtagttggaaagagcagcagaaggaagaagcaaagagcttaagactgggtatgcaagaggacttagaggaaatgagacgtgaagaagaagaaatgcaacgtcgaagggccaagaagctgaagaggcgttagctgctgcttttatttttgtgaaattctagagctgctctgctgcaaggatttcctgccttcagactgaagaagcccccttatcattttagatttatacttgggtactcaaggagaaggaatgcatactgtcatttgcaggctgtcatttgagcataaaatattttcagatattttccagggtgaaatctgtaatgcagatgatataatgcccacttgtgctcttatgaagttaactgttcacagatgccagccttgatcctgatgagctatgcactctaatgtggggccactcaccagtcagccaatcttttattgttcctttgctactttgaaaggaaaaaaaaggttgtctcttgatttctgtaattcttctgctgatctgtgagtagggcactgccctgctcccaatcaaacttagtctttttatgagaaacctggaccttccatgaatgttgccagcaataaagtgacttgtcctaatctatggattgagaacttgaaaatgtagagtagaatttataactatcatatggatgtcatcctgtgactttgaagtacaaagtagaataaattctgtattcatggattggatgctgagcattcttactcattaatttaggtggctaggaattaatgaaaaaattttcaagttaaaatacaggttataacagtataatattcttttctaagttttcctttcagatttactgttatgttggctttagtgtaagacaaggtcactgtgctgattgatttttatctaaaaaaattcatttttatatcgaagaaaaaatattttattcaaacattagatttgaaagagtaatagtttataaaataaggaagtaacatgtgaggctctcccctcctcccctcccccatcataaagatattttgaaatcccaaggtgccctcatacctcttgacattaatgacttcattttttagcttgaatttgttagcaaatattaatggcagaaaaccaaaaactaaatttatggtatcgagagcaccaccttctctttttgcccatattgcactttgatttcaaactatgcactgtgaagagatttttttccccaggtaggaagggatgttccctgttatcgttattttactgagctgtggaaactcatttttaccctttttaaagtcataaatatggacttaatagcccttaaccttcaagtccaagcagttccaatcaggctgacttaggatcatgctggaaggaagccaagtctcaagaactgtcagcaacagaaaatgagatatgatgctagagagcatttgtccttgactgtaagtacagaggcttaggggaagtgagacataagcttgtaggaataataaacgttctacaataaacgttttggctatcttaagccattgtatgggggggattaggaagtaggagggattgtcctacaacaggcccttatacttcaacagcccaaatattttggtttattcctttttatccataaagtctttattcttcaagtttgggtattatagattaccattgttagcctcccttaatgggaccatatgagccaggcttttaagacggactcattttgaattgagtttcaaactttgaaagtgcaaggatttaatttttaagttgaatcccatgaaaggtgtcatcatcactaggaataacaccctttgtaactacatatagaactgttacaatggtagcagaaaatcctattgatttcatctcacccatttcagataccttcagtgaaattaagggtagtgtgatgtcccatgtaataaaacaggcttagaacatcaattcctctgctgccatttatgtgcttttattcccccttcaaaaattttttattggatatatatatttttcagtattcagactctgaaatctgtcattacaatcaagtgcttgtcacagctgaaagatttctggtggcttaaagtttactagcagtaaatttatgatatggtacagttctttgtacagaaaggcaccattatgttagaataaatttccagaacttagtgggaagaatcaggttttaaccttgtgtgtctgttacttctgagtgcatttctataatataaatgttgatttgcgtcaacattataaaagagcacttctgtggctcatttaaaagaaaaaaaaggttaagtcttttaaattttggccttgtttccaaatcctgtcttccatgttgtttttctgcacttcctgaccactcttataaaaagctcacaaacctttgaagaaactggagtaggctgttatttcattaaggtttacaaattaaatgcttgatttttaatgtattctctactgttttgatttttggattttcttaattcaacatttgaagatgtgccttttgggtaatgttaatcacgaatgtagtaatatttcatgattgtaataatgttacatgatcatgggtgtggcattctctaacaaatgatgtgaaaggaaagtagttttcataaaactcatggctctgattgcacagtcccacttgcttttgatattgctatgtcaaagcaaagggcacttcttttaaggctactttcagaactttgtattttcgctaaactataaatgcagttgtgtccagttggaggccagggtaccacatgtcacaggcggccttacatgtgtgccgtgaaaaggttcaaagaccgttaacaaaaaagtaagtctggccgggcatggtggctcaagcctgtaatcccagcactttgggaggccgaggcgggcggatcacttgagaccaggagttcgagaccagcctggccaacatggtgtgagaccccgtctctactaaaaataaaaaaattagccgggtgcggtggcacacacctgtaatcccagctaccggggaggctgaggcaggagaatcgctagaacctgggaggcggaggttgcagtcagccaagatagcaccactgcactccaggctgggtgacagagcgagactccatgtcaaaaaaaaaagaatgtgggaactcaaattttcatttttaatgtaatccccaagattttctccaagaaataaattgttgttttgtattttgtaacttaaaagcagctattggtaaatttctgagatatagcaggagaccaaaacatgtttggaaagagaataaatatatgaagagagactggttgttttattttcaatgtattgaatatattagactactatttattttctgagtggatgtgattaaatattcagacgtttagtgtatgattaagagtgagatagagatttctttggagtaattaaatccatcctgtcttttacacaatggacaaatcaagttaaaaaaatttttagatagcttagcttgttttctggtgctgttgacctgcaagagaatatacttttgcatatacaggtgaaagttttgcaatttatgtatacaagaaattgtaggcattaaaaatattttattgata

SEQ ID NO: 20390 - DNA, 2167 bp, Homo sapiens
  ENST00000536336
agtggtcccgcagaggcggggtgggagtggggctcccgaggcagtgcagttggctgtagctgggcgcctcggttaggtgcgctgtcagtcctttccgagtgcctggcccagtctctcccgcctcggcccaacatggacttcagagaaattctcatgatagcttccaagggacaaggtgtcaacaatgtgccgaaaaggtatagtttggcagtggggcctccaaaaaaagacccaaaagttaaaggtgtccaatcagcagctgtacaagcttttcttaaaaggaaagaagaggagctgagacgaaaagccttagaggagaaaaggagaaaagaggaactagtgaaaaagcgaattgagctcaaacatgacaagaaagcaagagctatggccaagaggacaaaggataatttccatggttacaatgggattcctattgaggaaaagtcaaagaagaggcaggcaacagaaagccataccagccaaggaaccgaccgagagtatgaaatggaagaagagaatgaattcctcgagtacaatcacgcagagtcagagcaggagtatgaggaagagcaagaacctcccaaagttgaaagcaaaccaaaggtcccccttaaaagtgccccaccacccatgaacttcactgatttactcaggctggctgagaaaaagcagtttgaaccagtggaaatcaaggtagtgaagaaatcagaagagcgacctatgaccgcagaagaacttagggagcgagaattccttgaacgaaagcataggagaaaaaaacttgagacagatggaaaactacctccaactgtgtccaaaaaggcaccctctcagaaagaaagtgtgggcacaaaacttagcaaaggttctggagacaggcatccttcttccaaaggaatgccccttcctcatgctgagaagaaatcaagacccagcatggccaatgagaaacacctcgctttgtcttcatccaaatccatgccaggagagaggatcaaggcaggatctggcaatagctcccaaccctcacttcgtgagggccacgacaaacctgtttttaatggagctggaaagcctcattccagcacctcttcaccaagtgtcccaaagacttctgctagcaggactcagaaatctgctgttgagcacaaagccaaaaaatctctgtcccatcctagccattccaggcctgggcccatggtcaccccacacaataaggctaagagtccaggtgtcaggcagccaggcagcagctctagctcagcccctgggcagcccagcacaggggttgctcgacccacagttagttctggccctgtgcctaggcgccagaatggcagctccagctcaggacctgagcgatcaatcagtgggtccaagaagccaaccaatgactcaaatccctctaggcggacagtcagtggtacatgtggccctggacaacctgcaagcagctcaggtggccctgggcgacccatcagtggttcagttagttctgcaagacccttgggcagctctcgtggccctggccggcctgtgagcagtccacatgaacttcgacgaccagtgagtggcttgggccccccggggcggtctgtcagtggccctgggagatccataagtggctcaattccagctggacggactgtcagtaattcagtcccaggaagaccagtgagcagcttgggacctgggcaaacagttagtagctcaggtcccactataaagcctaagtgcactgttgtctccgaaacaatttcttccaagaatatcattagccggtccagcaatggacagatgaatggaatgaagcctcccctatctggctacagagctgcccaaggtcctcaaaggcttcccttccctactggttacaaaaggcagcgagaatatgaagaggaagatgacgatgatgatgaatacgactctgaaatggaagattttattgaagatgaaggagagcctcaggaagaaatatccaagcacattagagaaatctttggttatgaccgaaaaaagtaagactaaagaagattcagataactatgacatcctttttttattttgaataattcatgtcatggggtaataaactaatagtggaggcactgaatacaattcttaattaggaacccttgggtgattgttatttaaataaacgtactct

SEQ ID NO: 20391 - DNA, 543 bp, Homo sapiens
  ENST00000543776
aagtagcccaaaccccggctcgagatccgtctgttcagctgttgtggcgccgccgttttggatctaagcgcctacccgtgacacccagagaacccaggcctgaaaaggtatagtttggcagtggggcctccaaaaaaagacccaaaagttaaaggtgtccaatcagcagctgtacaagcttttcttaaaaggaaagaagaggagctgagacgaaaagccttagaggagaaaaggagaaaagaggaactagtgaaaaagcgaattgagctcaaacatgacaagaaagcaagagctatggccaagaggacaaaggataatttccatggttacaatgggattcctattgaggaaaagtcaaagaagaggcaggcaacagaaagccataccagccaaggaaccgaccgagagtatgaaatggaagaagagaatgaattcctcgagtacaatcacgcagagtcagagcaggagtatgaggaagagcaagaacctcccaaagttgaaagcaaaccaaaggtcccccttaaaagtgccccaccacccatg

SEQ ID NO: 20392 - DNA, 446 bp, Homo sapiens
  ENST00000497734
caaacaagtgcggccatttcaccagcccaggctggcttctgctgttgactggctgtggcacctcaagcagcccctttcccctctagcctcagtttatcaccgcaagagctaccattcatctagcacaacctgaccatcctcacactggtcagttccaaccttcccaggaatcttctgtggccatgttcactccggttttacagaacagagaacagaagctcagagaagtgaagcaacttgcccagctatgagagacagagccaggatttgaaaccagatgaggacgctgaggcccagagagggaaagccacttgcctagggacacacagcggggagaggtggagcagggcctctatttcgagacccctgactccacacctggtgtttgtgccaagaccccaggctgcctcccaggtcctctgggacagcccctgccttctaccagg

SEQ ID NO: 20393 - DNA, 4630 bp, Homo sapiens
  ENST00000373578
gccggagcggccaggccgccgtctgcccgtcccgctggacgtcccgcggtccgccctcccgtgcgtccgtctgccggtgagcccgcccgcccgccggcccagaacagagaacagaagctcagagaagtgaagcaacttgcccagctatgagagacagagccaggatttgaaaccagatgaggacgctgaggcccagagagggaaagccacttgcctagggacacacagcggggagaggtggagcagggcctctatttcgagacccctgactccacacctggtgtttgtgccaagaccccaggctgcctcccaggtcctctgggacagcccctgccttctaccaggaccatgggtagcaacaagagcaagcccaaggatgccagccagcggcgccgcagcctggagcccgccgagaacgtgcacggcgctggcgggggcgctttccccgcctcgcagacccccagcaagccagcctcggccgacggccaccgcggccccagcgcggccttcgcccccgcggccgccgagcccaagctgttcggaggcttcaactcctcggacaccgtcacctccccgcagagggcgggcccgctggccggtggagtgaccacctttgtggccctctatgactatgagtctaggacggagacagacctgtccttcaagaaaggcgagcggctccagattgtcaacaacacagagggagactggtggctggcccactcgctcagcacaggacagacaggctacatccccagcaactacgtggcgccctccgactccatccaggctgaggagtggtattttggcaagatcaccagacgggagtcagagcggttactgctcaatgcagagaacccgagagggaccttcctcgtgcgagaaagtgagaccacgaaaggtgcctactgcctctcagtgtctgacttcgacaacgccaagggcctcaacgtgaagcactacaagatccgcaagctggacagcggcggcttctacatcacctcccgcacccagttcaacagcctgcagcagctggtggcctactactccaaacacgccgatggcctgtgccaccgcctcaccaccgtgtgccccacgtccaagccgcagactcagggcctggccaaggatgcctgggagatccctcgggagtcgctgcggctggaggtcaagctgggccagggctgctttggcgaggtgtggatggggacctggaacggtaccaccagggtggccatcaaaaccctgaagcctggcacgatgtctccagaggccttcctgcaggaggcccaggtcatgaagaagctgaggcatgagaagctggtgcagttgtatgctgtggtttcagaggagcccatttacatcgtcacggagtacatgagcaaggggagtttgctggactttctcaagggggagacaggcaagtacctgcggctgcctcagctggtggacatggctgctcagatcgcctcaggcatggcgtacgtggagcggatgaactacgtccaccgggaccttcgtgcagccaacatcctggtgggagagaacctggtgtgcaaagtggcggactttgggctggctcggctcattgaagacaatgagtacacggcgcggcaaggtgccaaattccccatcaagtggacggctccagaagctgccctctatggccgcttcaccatcaagtcggacgtgtggtccttcgggatcctgctgactgagctcaccacaaagggacgggtgccctaccctgggatggtgaaccgcgaggtgctggaccaggtggagcggggctaccggatgccctgcccgccggagtgtcccgagtccctgcacgacctcatgtgccagtgctggcggaaggagcctgaggagcggcccaccttcgagtacctgcaggccttcctggaggactacttcacgtccaccgagccccagtaccagcccggggagaacctctaggcacaggcgggcccagaccggcttctcggcttggatcctgggctgggtggcccctgtctcggggcttgccccactctgcctgcctgctgttggtcctctctctgtggggctgaattgccaggggcgaggcccttcctctttggtggcatggaaggggcttctggacctagggtggcctgagagggcggtgggtatgcgagaccagcacggtgactctgtccagctcccgctgtggccgcacgcctctccctgcactccctcctggagctctgtgggtctctggaagaggaaccaggagaagggctggggccggggctgagggtgcccttttccagcctcagcctactccgctcactgaactccttccccacttctgtgccacccccggtctatgtcgagagctggccaaagagcctttccaaagaggagcgatgggcccctggccccgcctgcctgccaccctgccccttgccatccattctggaaacacctgtaggcagaggctgccgagacagaccctctgccgctgcttccaggctgggcagcacaaggccttgcctggcctgatgatggtgggtgggtgggatgagtaccccctcaaaccctgccctccttagacctgagggacccttcgagatcatcacttccttgcccccatttcacccatggggagacagttgagagcggggatgtgacatgcccaaggccacggagcagttcagagtggaggcgggcttggaacccggtgctccctctgtcatcctcaggaaccaacaattcgtcggaggcatcatggaaagactgggacagcccaggaaacaaggggtctgaggatgcattcgagatggcagattcccactgccgctgcccgctcagcccagctgttgggaacagcatggaggcagatgtggggctgagctggggaatcagggtaaaaggtgcaggtgtggagagagaggcttcaatcggcttgtgggtgatgtttgaccttcagagccagccggctatgaaagggagcgagcccctcggctctggaggcaatcaagcagacatagaagagccaagagtccaggaggccctggtcctggcctccttccccgtactttgtcccgtggcatttcaattcctggccctgttctcctccccaagtcggcaccctttaactcatgaggagggaaaagagtgcctaagcgggggtgaaagaggacgtgttacccactgccatgcaccaggactggctgtgtaaccttgggtggcccctgctgtctctctgggctgcagagtctgccccacatgtggccatggcctctgcaactgctcagctctggtccaggccctgtggcaggacacacatggtgagcctagccctgggacatcaggagactgggctctggctctgttcggcctttgggtgtgtggtggattctccctgggcctcagtgtgcccatctgtaaaggggcagctgacagtttgtggcatcttgccaagggtccctgtgtgtgtgtatgtgtgtgcatgtgtgcgtgtctccatgtgcgtccatatttaacatgtaaaaatgtcccccccgctccgtcccccaaacatgttgtacatttcaccatggccccctcatcatagcaataacattcccactgccaggggttcttgagccagccaggccctgccagtggggaaggaggccaagcagtgcctgcctatgaaatttcaacttttcctttcatacgtctttattacccaagtcttctcccgtccattccagtcaaatctgggctcactcaccccagcgagctctcaaatccctctccaactgcctaaggccctttgtgtaaggtgtcttaatactgtcctttttttttttttaacagtgttttgtagatttcagatgactatgcagaggcctgggggacccctggctctgggccgggcctggggctccgaaattccaaggcccagacttgcggggggtgggggggtatccagaattggttgtaaatactttgcatattgtctgattaaacacaaacagacctcagaatctgatcaacagtttattgaacatctactgtgtgctggaaagcgagatggggcggaatgcgagaacaaactaccccttgaggggtctttgggcagcactagtagctggagggcttcaggccaaggcaggggtgacatcagattggagacagctacggcagaatgtggctgtttgtgaacatctgcacctgtgttagggggtgagcacctgggagaaggacaaggcacatcacaggacttccctgagcatgacaagttcaggactcaaatgtccgtggtggatggtagcagtgacattggggagtgggtggggctgtcaagcctgcctagaggagatcacaaatacacgacgagaataccgttgtgtgtgctcttcgtgtgtttcctaggagtgcagggcaggggtgctgggtcgatccacaaaagtcctgaaaacgctgaagaaaaatccaaagacccttcccctcctccctccttccccaccaccgaagcacacagtcttgaaggttgatttgcaaccgtctatacaaacacatttattttacacaaatatacatcagatcacacacctgtgcaccggagtcaactctggccacgacattgcttaattaaaaacaaatttcaaaaactgga

SEQ ID NO: 20394 - DNA, 4321 bp, Homo sapiens
  ENST00000373567
catcgaggttttgagaggctaactctcccaaaaaggaccatgggtagcaacaagagcaagcccaaggatgccagccagcggcgccgcagcctggagcccgccgagaacgtgcacggcgctggcgggggcgctttccccgcctcgcagacccccagcaagccagcctcggccgacggccaccgcggccccagcgcggccttcgcccccgcggccgccgagcccaagctgttcggaggcttcaactcctcggacaccgtcacctccccgcagagggcgggcccgctggccggtggagtgaccacctttgtggccctctatgactatgagtctaggacggagacagacctgtccttcaagaaaggcgagcggctccagattgtcaacaacacagagggagactggtggctggcccactcgctcagcacaggacagacaggctacatccccagcaactacgtggcgccctccgactccatccaggctgaggagtggtattttggcaagatcaccagacgggagtcagagcggttactgctcaatgcagagaacccgagagggaccttcctcgtgcgagaaagtgagaccacgaaaggtgcctactgcctctcagtgtctgacttcgacaacgccaagggcctcaacgtgaagcactacaagatccgcaagctggacagcggcggcttctacatcacctcccgcacccagttcaacagcctgcagcagctggtggcctactactccaaacacgccgatggcctgtgccaccgcctcaccaccgtgtgccccacgtccaagccgcagactcagggcctggccaaggatgcctgggagatccctcgggagtcgctgcggctggaggtcaagctgggccagggctgctttggcgaggtgtggatggggacctggaacggtaccaccagggtggccatcaaaaccctgaagcctggcacgatgtctccagaggccttcctgcaggaggcccaggtcatgaagaagctgaggcatgagaagctggtgcagttgtatgctgtggtttcagaggagcccatttacatcgtcacggagtacatgagcaaggggagtttgctggactttctcaagggggagacaggcaagtacctgcggctgcctcagctggtggacatggctgctcagatcgcctcaggcatggcgtacgtggagcggatgaactacgtccaccgggaccttcgtgcagccaacatcctggtgggagagaacctggtgtgcaaagtggcggactttgggctggctcggctcattgaagacaatgagtacacggcgcggcaaggtgccaaattccccatcaagtggacggctccagaagctgccctctatggccgcttcaccatcaagtcggacgtgtggtccttcgggatcctgctgactgagctcaccacaaagggacgggtgccctaccctgggatggtgaaccgcgaggtgctggaccaggtggagcggggctaccggatgccctgcccgccggagtgtcccgagtccctgcacgacctcatgtgccagtgctggcggaaggagcctgaggagcggcccaccttcgagtacctgcaggccttcctggaggactacttcacgtccaccgagccccagtaccagcccggggagaacctctaggcacaggcgggcccagaccggcttctcggcttggatcctgggctgggtggcccctgtctcggggcttgccccactctgcctgcctgctgttggtcctctctctgtggggctgaattgccaggggcgaggcccttcctctttggtggcatggaaggggcttctggacctagggtggcctgagagggcggtgggtatgcgagaccagcacggtgactctgtccagctcccgctgtggccgcacgcctctccctgcactccctcctggagctctgtgggtctctggaagaggaaccaggagaagggctggggccggggctgagggtgcccttttccagcctcagcctactccgctcactgaactccttccccacttctgtgccacccccggtctatgtcgagagctggccaaagagcctttccaaagaggagcgatgggcccctggccccgcctgcctgccaccctgccccttgccatccattctggaaacacctgtaggcagaggctgccgagacagaccctctgccgctgcttccaggctgggcagcacaaggccttgcctggcctgatgatggtgggtgggtgggatgagtaccccctcaaaccctgccctccttagacctgagggacccttcgagatcatcacttccttgcccccatttcacccatggggagacagttgagagcggggatgtgacatgcccaaggccacggagcagttcagagtggaggcgggcttggaacccggtgctccctctgtcatcctcaggaaccaacaattcgtcggaggcatcatggaaagactgggacagcccaggaaacaaggggtctgaggatgcattcgagatggcagattcccactgccgctgcccgctcagcccagctgttgggaacagcatggaggcagatgtggggctgagctggggaatcagggtaaaaggtgcaggtgtggagagagaggcttcaatcggcttgtgggtgatgtttgaccttcagagccagccggctatgaaagggagcgagcccctcggctctggaggcaatcaagcagacatagaagagccaagagtccaggaggccctggtcctggcctccttccccgtactttgtcccgtggcatttcaattcctggccctgttctcctccccaagtcggcaccctttaactcatgaggagggaaaagagtgcctaagcgggggtgaaagaggacgtgttacccactgccatgcaccaggactggctgtgtaaccttgggtggcccctgctgtctctctgggctgcagagtctgccccacatgtggccatggcctctgcaactgctcagctctggtccaggccctgtggcaggacacacatggtgagcctagccctgggacatcaggagactgggctctggctctgttcggcctttgggtgtgtggtggattctccctgggcctcagtgtgcccatctgtaaaggggcagctgacagtttgtggcatcttgccaagggtccctgtgtgtgtgtatgtgtgtgcatgtgtgcgtgtctccatgtgcgtccatatttaacatgtaaaaatgtcccccccgctccgtcccccaaacatgttgtacatttcaccatggccccctcatcatagcaataacattcccactgccaggggttcttgagccagccaggccctgccagtggggaaggaggccaagcagtgcctgcctatgaaatttcaacttttcctttcatacgtctttattacccaagtcttctcccgtccattccagtcaaatctgggctcactcaccccagcgagctctcaaatccctctccaactgcctaaggccctttgtgtaaggtgtcttaatactgtcctttttttttttttaacagtgttttgtagatttcagatgactatgcagaggcctgggggacccctggctctgggccgggcctggggctccgaaattccaaggcccagacttgcggggggtgggggggtatccagaattggttgtaaatactttgcatattgtctgattaaacacaaacagacctcagaatctgatcaacagtttattgaacatctactgtgtgctggaaagcgagatggggcggaatgcgagaacaaactaccccttgaggggtctttgggcagcactagtagctggagggcttcaggccaaggcaggggtgacatcagattggagacagctacggcagaatgtggctgtttgtgaacatctgcacctgtgttagggggtgagcacctgggagaaggacaaggcacatcacaggacttccctgagcatgacaagttcaggactcaaatgtccgtggtggatggtagcagtgacattggggagtgggtggggctgtcaagcctgcctagaggagatcacaaatacacgacgagaataccgttgtgtgtgctcttcgtgtgtttcctaggagtgcagggcaggggtgctgggtcgatccacaaaagtcctgaaaacgctgaagaaaaatccaaagacccttcccctcctccctccttccccaccaccgaagcacacagtcttgaaggttgatttgcaaccgtctatacaaacacatttattttacacaaatatacatcagatcacacacctgtgcaccggagtcaactctggccacgacattgcttaattaaaaacaaatttcaaaaactgga

SEQ ID NO: 20395 - DNA, 4304 bp, Homo sapiens
  ENST00000373558
gaccatgggtagcaacaagagcaagcccaaggatgccagccagcggcgccgcagcctggagcccgccgagaacgtgcacggcgctggcgggggcgctttccccgcctcgcagacccccagcaagccagcctcggccgacggccaccgcggccccagcgcggccttcgcccccgcggccgccgagcccaagctgttcggaggcttcaactcctcggacaccgtcacctccccgcagagggcgggcccgctggccggtggagtgaccacctttgtggccctctatgactatgagtctaggacggagacagacctgtccttcaagaaaggcgagcggctccagattgtcaacaacacgaggaaggtggatgtcagagagggagactggtggctggcccactcgctcagcacaggacagacaggctacatccccagcaactacgtggcgccctccgactccatccaggctgaggagtggtattttggcaagatcaccagacgggagtcagagcggttactgctcaatgcagagaacccgagagggaccttcctcgtgcgagaaagtgagaccacgaaaggtgcctactgcctctcagtgtctgacttcgacaacgccaagggcctcaacgtgaagcactacaagatccgcaagctggacagcggcggcttctacatcacctcccgcacccagttcaacagcctgcagcagctggtggcctactactccaaacacgccgatggcctgtgccaccgcctcaccaccgtgtgccccacgtccaagccgcagactcagggcctggccaaggatgcctgggagatccctcgggagtcgctgcggctggaggtcaagctgggccagggctgctttggcgaggtgtggatggggacctggaacggtaccaccagggtggccatcaaaaccctgaagcctggcacgatgtctccagaggccttcctgcaggaggcccaggtcatgaagaagctgaggcatgagaagctggtgcagttgtatgctgtggtttcagaggagcccatttacatcgtcacggagtacatgagcaaggggagtttgctggactttctcaagggggagacaggcaagtacctgcggctgcctcagctggtggacatggctgctcagatcgcctcaggcatggcgtacgtggagcggatgaactacgtccaccgggaccttcgtgcagccaacatcctggtgggagagaacctggtgtgcaaagtggcggactttgggctggctcggctcattgaagacaatgagtacacggcgcggcaaggtgccaaattccccatcaagtggacggctccagaagctgccctctatggccgcttcaccatcaagtcggacgtgtggtccttcgggatcctgctgactgagctcaccacaaagggacgggtgccctaccctgggatggtgaaccgcgaggtgctggaccaggtggagcggggctaccggatgccctgcccgccggagtgtcccgagtccctgcacgacctcatgtgccagtgctggcggaaggagcctgaggagcggcccaccttcgagtacctgcaggccttcctggaggactacttcacgtccaccgagccccagtaccagcccggggagaacctctaggcacaggcgggcccagaccggcttctcggcttggatcctgggctgggtggcccctgtctcggggcttgccccactctgcctgcctgctgttggtcctctctctgtggggctgaattgccaggggcgaggcccttcctctttggtggcatggaaggggcttctggacctagggtggcctgagagggcggtgggtatgcgagaccagcacggtgactctgtccagctcccgctgtggccgcacgcctctccctgcactccctcctggagctctgtgggtctctggaagaggaaccaggagaagggctggggccggggctgagggtgcccttttccagcctcagcctactccgctcactgaactccttccccacttctgtgccacccccggtctatgtcgagagctggccaaagagcctttccaaagaggagcgatgggcccctggccccgcctgcctgccaccctgccccttgccatccattctggaaacacctgtaggcagaggctgccgagacagaccctctgccgctgcttccaggctgggcagcacaaggccttgcctggcctgatgatggtgggtgggtgggatgagtaccccctcaaaccctgccctccttagacctgagggacccttcgagatcatcacttccttgcccccatttcacccatggggagacagttgagagcggggatgtgacatgcccaaggccacggagcagttcagagtggaggcgggcttggaacccggtgctccctctgtcatcctcaggaaccaacaattcgtcggaggcatcatggaaagactgggacagcccaggaaacaaggggtctgaggatgcattcgagatggcagattcccactgccgctgcccgctcagcccagctgttgggaacagcatggaggcagatgtggggctgagctggggaatcagggtaaaaggtgcaggtgtggagagagaggcttcaatcggcttgtgggtgatgtttgaccttcagagccagccggctatgaaagggagcgagcccctcggctctggaggcaatcaagcagacatagaagagccaagagtccaggaggccctggtcctggcctccttccccgtactttgtcccgtggcatttcaattcctggccctgttctcctccccaagtcggcaccctttaactcatgaggagggaaaagagtgcctaagcgggggtgaaagaggacgtgttacccactgccatgcaccaggactggctgtgtaaccttgggtggcccctgctgtctctctgggctgcagagtctgccccacatgtggccatggcctctgcaactgctcagctctggtccaggccctgtggcaggacacacatggtgagcctagccctgggacatcaggagactgggctctggctctgttcggcctttgggtgtgtggtggattctccctgggcctcagtgtgcccatctgtaaaggggcagctgacagtttgtggcatcttgccaagggtccctgtgtgtgtgtatgtgtgtgcatgtgtgcgtgtctccatgtgcgtccatatttaacatgtaaaaatgtcccccccgctccgtcccccaaacatgttgtacatttcaccatggccccctcatcatagcaataacattcccactgccaggggttcttgagccagccaggccctgccagtggggaaggaggccaagcagtgcctgcctatgaaatttcaacttttcctttcatacgtctttattacccaagtcttctcccgtccattccagtcaaatctgggctcactcaccccagcgagctctcaaatccctctccaactgcctaaggccctttgtgtaaggtgtcttaatactgtcctttttttttttttaacagtgttttgtagatttcagatgactatgcagaggcctgggggacccctggctctgggccgggcctggggctccgaaattccaaggcccagacttgcggggggtgggggggtatccagaattggttgtaaatactttgcatattgtctgattaaacacaaacagacctcagaatctgatcaacagtttattgaacatctactgtgtgctggaaagcgagatggggcggaatgcgagaacaaactaccccttgaggggtctttgggcagcactagtagctggagggcttcaggccaaggcaggggtgacatcagattggagacagctacggcagaatgtggctgtttgtgaacatctgcacctgtgttagggggtgagcacctgggagaaggacaaggcacatcacaggacttccctgagcatgacaagttcaggactcaaatgtccgtggtggatggtagcagtgacattggggagtgggtggggctgtcaagcctgcctagaggagatcacaaatacacgacgagaataccgttgtgtgtgctcttcgtgtgtttcctaggagtgcagggcaggggtgctgggtcgatccacaaaagtcctgaaaacgctgaagaaaaatccaaagacccttcccctcctccctccttccccaccaccgaagcacacagtcttgaaggttgatttgcaaccgtctatacaaacacatttattttacacaaatatacatcagatcacacacctgtgcaccggagtcaactctggccacgacattgcttaattaaaaacaaatttcaaaaactgga

SEQ ID NO: 20396 - DNA, 461 bp, Homo sapiens
  ENST00000472968
cggccgccgagcccaagctgttcggaggcttcaactcctcggacaccgtcacctccccgcagagggcgggcccgctggccggtggagtgaccacctttgtggccctctatgactatgagtctaggacggagacagacctgtccttcaagaaaggcgagcggctccagattgtcaacaacacagagggagactggtggctggcccactcgctcagcacaggacagacaggctacatccccagcaactacgtggcgccctccgactccatccaggctgaggagtgagtaccgtctctggctgcctctacccgtcgtccctggacactgccggtgcagagtgcctctcctgggctggggtgggaggtctggctgtccagcgccccagccatatccagggagaagcactgtgagtgggcagaagcctggacagtcagcaccatcctccgtcctcccacccccagg

SEQ ID NO: 20397 - DNA, 551 bp, Homo sapiens
  ENST00000489153
atgctgtggggactcacgctggccccaccacctccctgggcctccctcagccactagagccctgagcacagcacctaggaggatggtgggcaccgggcttgtggctgacggctcccttctcctttcctccctccttctgtccctgctcagagagggagactggtggctggcccactcgctcagcacaggacagacaggctacatccccagcaactacgtggcgccctccgactccatccaggctgaggagtggtattttggcaagatcaccagacgggagtcagagcggttactgctcaatgcagagaacccgagagggaccttcctcgtgcgagaaagtgagaccacgaaaggtgcctactgcctctcagtgtctgacttcgacaacgccaagggcctcaacgtgaagcactacaagatccgcaagctggacagcggcggcttctacatcacctcccgcacccagttcaacagcctgcagcagctggtggcctactactccaaacacgccgatggcctgtgccaccgcctcaccaccgtgtgccccacgt

SEQ ID NO: 20398 - DNA, 3300 bp, Homo sapiens
  ENST00000477066
acttccccctcccccctcccttcctctctcctcccttttccctcctttccttgtctccttcttcttcctcttctttcccccagcccccctcctccctgtccccctctctccctgctccacgcagtgtcccactgcccgcctttctctgcagctggctggtatggagggggctgccctgaggagccccagagtaagctggaagggaggggacagaggctggtgtcatttgtctctgtagccctaggaccggtctgaaccggttgctgggagaggaggagggggcggccagatcgattgcagcaaagagggaagagagcggcagagggagctcgcggggcttgcgtgctggaacacgccgatggcctgtgccaccgcctcaccaccgtgtgccccacgtccaagccgcagactcagggcctggccaaggatgcctgggagatccctcgggagtcgctgcggctggaggtcaagctgggccagggctgctttggcgaggtgtggatggggacctggaacggtaccaccagggtggccatcaaaaccctgaagcctggcacgatgtctccagaggccttcctgcaggaggcccaggtcatgaagaagctgaggcatgagaagctggtgcagttgtatgctgtggtttcagaggagcccatttacatcgtcacggagtacatgagcaaggggagtttgctggactttctcaagggggagacaggcaagtacctgcggctgcctcagctggtggacatggctgctcagatcgcctcaggcatggcgtacgtggagcggatgaactacgtccaccgggaccttcgtgcagccaacatcctggtgggagagaacctggtgtgcaaagtggcggactttgggctggctcggctcattgaagacaatgagtacacggcgcggcaaggtgccaaattccccatcaagtggacggctccagaagctgccctctatggccgcttcaccatcaagtcggacgtgtggtccttcgggatcctgctgactgagctcaccacaaagggacgggtgccctaccctgggatggtgaaccgcgaggtgctggaccaggtggagcggggctaccggatgccctgcccgccggagtgtcccgagtccctgcacgacctcatgtgccagtgctggcggaaggagcctgaggagcggcccaccttcgagtacctgcaggccttcctggaggactacttcacgtccaccgagccccagtaccagcccggggagaacctctaggcacaggcgggcccagaccggcttctcggcttggatcctgggctgggtggcccctgtctcggggcttgccccactctgcctgcctgctgttggtcctctctctgtggggctgaattgccaggggcgaggcccttcctctttggtggcatggaaggggcttctggacctagggtggcctgagagggcggtgggtatgcgagaccagcacggtgactctgtccagctcccgctgtggccgcacgcctctccctgcactccctcctggagctctgtgggtctctggaagaggaaccaggagaagggctggggccggggctgagggtgcccttttccagcctcagcctactccgctcactgaactccttccccacttctgtgccacccccggtctatgtcgagagctggccaaagagcctttccaaagaggagcgatgggcccctggccccgcctgcctgccaccctgccccttgccatccattctggaaacacctgtaggcagaggctgccgagacagaccctctgccgctgcttccaggctgggcagcacaaggccttgcctggcctgatgatggtgggtgggtgggatgagtaccccctcaaaccctgccctccttagacctgagggacccttcgagatcatcacttccttgcccccatttcacccatggggagacagttgagagcggggatgtgacatgcccaaggccacggagcagttcagagtggaggcgggcttggaacccggtgctccctctgtcatcctcaggaaccaacaattcgtcggaggcatcatggaaagactgggacagcccaggaaacaaggggtctgaggatgcattcgagatggcagattcccactgccgctgcccgctcagcccagctgttgggaacagcatggaggcagatgtggggctgagctggggaatcagggtaaaaggtgcaggtgtggagagagaggcttcaatcggcttgtgggtgatgtttgaccttcagagccagccggctatgaaagggagcgagcccctcggctctggaggcaatcaagcagacatagaagagccaagagtccaggaggccctggtcctggcctccttccccgtactttgtcccgtggcatttcaattcctggccctgttctcctccccaagtcggcaccctttaactcatgaggagggaaaagagtgcctaagcgggggtgaaagaggacgtgttacccactgccatgcaccaggactggctgtgtaaccttgggtggcccctgctgtctctctgggctgcagagtctgccccacatgtggccatggcctctgcaactgctcagctctggtccaggccctgtggcaggacacacatggtgagcctagccctgggacatcaggagactgggctctggctctgttcggcctttgggtgtgtggtggattctccctgggcctcagtgtgcccatctgtaaaggggcagctgacagtttgtggcatcttgccaagggtccctgtgtgtgtgtatgtgtgtgcatgtgtgcgtgtctccatgtgcgtccatatttaacatgtaaaaatgtcccccccgctccgtcccccaaacatgttgtacatttcaccatggccccctcatcatagcaataacattcccactgccaggggttcttgagccagccaggccctgccagtggggaaggaggccaagcagtgcctgcctatgaaatttcaacttttcctttcatacgtctttattacccaagtcttctcccgtccattccagtcaaatctgggctcactcaccccagcgagctctcaaatccctctccaactgcctaaggccctttgtgtaaggtgtcttaatactgtcctttttttttttttaacagtgttttgtagatttcagatgactatgcagaggcctgggggacccctggctctgggccgggcctggggctccgaaattccaaggcccagacttgcggggggtgggggggtatccagaattggttgtaaatactttgcatattgtctgattaaacacaaacagacctcagaatctg

SEQ ID NO: 20399 - DNA, 502 bp, Homo sapiens
  ENST00000467556
aaccctgaagcctggcacgatgtctccagaggccttcctgcaggaggcccaggtcatgaagaagctgaggcatgagaagctggtgcagttgtatgctgtggtttcagaggagcccatttacatcgtcacggagtacatgagcaaggggagtttgctggactttctcaagggggagacaggcaagtacctgcggctgcctcagctggtggacatggctgctcaggtgagtcagcccctcccgcctccccacacccttggtcctcaagcacccagacccatctggtgcagccagttctggcctcttgagtgccccctccaagaagcctgccttgattgcctccacactcactgatcttgccgcacgtatttaccaggtctgcttacaggtgccctgaggggtgattctgggcagcagaaggcccttacctgggcatcaggggtcactgacttactgtgggacctcgggcctcagttgtcgtctctgtaaaggtcatttagtcgc

SEQ ID NO: 20400 - DNA, 584 bp, Homo sapiens
  ENST00000477475
ttcagaggagcccatttacatcgtcacggagtacatgagcaaggggagtttgctggactttctcaagggggagacaggcaagtacctgcggctgcctcagctggtggacatggctgctcaggtctgcttacaggtgccctgaggggtgattctgggcagcagaaggcccttacctgggcatcaggggtcactgacttactgtgggacctcgggcctcagttgtcgtctctgtaaaggtcatttagtcgcttagcagacgtgttcatgcttgctgtaggcagtggtcaacaagcctttttttttttcatttaatcctcatcacgaccaggagtgacgaggattggctgttattcccattggacggatgagaaaactgaggctcagagaggggacttgggcagcaggcaggacctggcactcatctgtgtctgggtccgctggggcctctttccctggtcacctcgctttcctggctgcatcggatctcgtgcctcccctttgacctttgccttctgccctctgctctgtgccctgtgctccctactcccgcagagcactgctcctgctttcgatgccaacagcat

SEQ ID NO: 20401 - DNA, 559 bp, Homo sapiens
  ENST00000493775
ttgcctgaagaagtgtggggagggtggggaaggggtggttggctctccagccccagagtgctctgtggccctgggagggcatgggtggcacctgagccaggctcccacggttccgcctgcagatcgcctcaggcatggcgtacgtggagcggatgaactacgtccaccgggaccttcgtgcagccaacatcctggtgggagagaacctggtgtgcaaagtggcggactttgggctggctcggctcattgaagacaatgagtacacggcgcggcaaggtgccaaattccccatcaagtggacggctccagaagctgccctctatggccgcttcaccatcaagtcggacgtgtggtccttcgggatcctgctgactgagctcaccacaaagggacgggtgccctaccctggtaagaaggtcctcatggcctgtctgtggtccctgaatccctctgccctggtggccttgggcaagtcatgactcctgctgggcctgtttccccacccgtaaaacaaagaagttgagcgtctgatgttaggctctctcgatggtccatgctc

SEQ ID NO: 20402 - DNA, 3851 bp, Homo sapiens
  ENST00000358208
atccctgctttgcagatgaggacgctgaggcccagagagggaaagccacttgcctagggacacacagcggggagaggtggagcagggcctctatttcgagacccctgactccacacctggtgtttgtgccaagaccccaggctgcctcccaggtcctctgggacagcccctgccttctaccaggaccatgggtagcaacaagagcaagcccaaggatgccagccagcggcgccgcagcctggagcccgccgagaacgtgcacggcgctggcgggggcgctttccccgcctcgcagacccccagcaagccagcctcggccgacggccaccgcggccccagcgcggccttcgcccccgcggccgccgagcccaagctgttcggaggcttcaactcctcggacaccgtcacctccccgcagagggcgggcccgctggccggtggagtgaccacctttgtggccctctatgactatgagtctaggacggagacagacctgtccttcaagaaaggcgagcggctccagattgtcaacaacacagagggagactggtggctggcccactcgctcagcacaggacagacaggctacatccccagcaactacgtggcgccctccgactccatccaggctgaggagtggtattttggcaagatcaccagacgggagtcagagcggttactgctcaatgcagagaacccgagagggaccttcctcgtgcgagaaagtgagaccacgaaaggtgcctactgcctctcagtgtctgacttcgacaacgccaagggcctcaacgtgaagcactacaagatccgcaagctggacagcggcggcttctacatcacctcccgcacccagttcaacagcctgcagcagctggtggcctactactccaaacacgccgatggcctgtgccaccgcctcaccaccgtgtgccccacgtccaagccgcagactcagggcctggccaaggatgcctgggagatccctcgggagtcgctgcggctggaggtcaagctgggccagggctgctttggcgaggtgtggatggggacctggaacggtaccaccagggtggccatcaaaaccctgaagcctggcacgatgtctccagaggccttcctgcaggaggcccaggtcatgaagaagctgaggcatgagaagctggtgcagttgtatgctgtggtttcagaggagcccatttacatcgtcacggagtacatgagcaaggggagtttgctggactttctcaagggggagacaggcaagtacctgcggctgcctcagctggtggacatggctgctcagatcgcctcaggcatggcgtacgtggagcggatgaactacgtccaccgggaccttcgtgcagccaacatcctggtgggagagaacctggtgtgcaaagtggcggactttgggctggctcggctcattgaagacaatgagtacacggcgcggcaaggtgccaaattccccatcaagtggacggctccagaagctgccctctatggccgcttcaccatcaagtcggacgtgtggtccttcgggatcctgctgactgagctcaccacaaagggacgggtgccctaccctgggatggtgaaccgcgaggtgctggaccaggtggagcggggctaccggatgccctgcccgccggagtgtcccgagtccctgcacgacctcatgtgccagtgctggcggaaggagcctgaggagcggcccaccttcgagtacctgcaggccttcctggaggactacttcacgtccaccgagccccagtaccagcccggggagaacctctaggcacaggcgggcccagaccggcttctcggcttggatcctgggctgggtggcccctgtctcggggcttgccccactctgcctgcctgctgttggtcctctctctgtggggctgaattgccaggggcgaggcccttcctctttggtggcatggaaggggcttctggacctagggtggcctgagagggcggtgggtatgcgagaccagcacggtgactctgtccagctcccgctgtggccgcacgcctctccctgcactccctcctggagctctgtgggtctctggaagaggaaccaggagaagggctggggccggggctgagggtgcccttttccagcctcagcctactccgctcactgaactccttccccacttctgtgccacccccggtctatgtcgagagctggccaaagagcctttccaaagaggagcgatgggcccctggccccgcctgcctgccaccctgccccttgccatccattctggaaacacctgtaggcagaggctgccgagacagaccctctgccgctgcttccaggctgggcagcacaaggccttgcctggcctgatgatggtgggtgggtgggatgagtaccccctcaaaccctgccctccttagacctgagggacccttcgagatcatcacttccttgcccccatttcacccatggggagacagttgagagcggggatgtgacatgcccaaggccacggagcagttcagagtggaggcgggcttggaacccggtgctccctctgtcatcctcaggaaccaacaattcgtcggaggcatcatggaaagactgggacagcccaggaaacaaggggtctgaggatgcattcgagatggcagattcccactgccgctgcccgctcagcccagctgttgggaacagcatggaggcagatgtggggctgagctggggaatcagggtaaaaggtgcaggtgtggagagagaggcttcaatcggcttgtgggtgatgtttgaccttcagagccagccggctatgaaagggagcgagcccctcggctctggaggcaatcaagcagacatagaagagccaagagtccaggaggccctggtcctggcctccttccccgtactttgtcccgtggcatttcaattcctggccctgttctcctccccaagtcggcaccctttaactcatgaggagggaaaagagtgcctaagcgggggtgaaagaggacgtgttacccactgccatgcaccaggactggctgtgtaaccttgggtggcccctgctgtctctctgggctgcagagtctgccccacatgtggccatggcctctgcaactgctcagctctggtccaggccctgtggcaggacacacatggtgagcctagccctgggacatcaggagactgggctctggctctgttcggcctttgggtgtgtggtggattctccctgggcctcagtgtgcccatctgtaaaggggcagctgacagtttgtggcatcttgccaagggtccctgtgtgtgtgtatgtgtgtgcatgtgtgcgtgtctccatgtgcgtccatatttaacatgtaaaaatgtcccccccgctccgtcccccaaacatgttgtacatttcaccatggccccctcatcatagcaataacattcccactgccaggggttcttgagccagccaggccctgccagtggggaaggaggccaagcagtgcctgcctatgaaatttcaacttttcctttcatacgtctttattacccaagtcttctcccgtccattccagtcaaatctgggctcactcaccccagcgagctctcaaatccctctccaactgcctaaggccctttgtgtaaggtgtcttaatactgtcctttttttttttttaacagtgttttgtagatttcagatgactatgcagaggcctgggggacccctggctctgggccgggcctggggctccgaaattccaaggcccagacttgcggggggtgggggggtatccagaattggttgtaaatactttgcatattgtctgattaaacacaaacagacctcagaatctgatcaacagtt

SEQ ID NO: 20403 - DNA, 7058 bp, Homo sapiens
  ENST00000615049
acactcgctctcgcacactcggtgacacgcccgcgcgcgcgctcacccacacgcccggccgccggcgccctcccagctggtccaccccggcggggcccgcgcccccggcccgcccgcctggcaccgcgccccggggctggggccgagcgaggagcccgcgaggcggcgagagggcgagcgccaggcaggccggcccggggcccccgccccccgcgcccccgcccgatggggaacgctccgtcccaagatccggagcggagcagcccccccatgctgtctgcggacgatgcggagtacccgcgggagtaccggaccctggggggcgggggcggcgggggcagcgggggccggcgcttctccaacgtggggctggtgcacacgtccgagcggcggcacacggtgatcgcggcccagagtctggaggcgctcagcgggctccagaaggcggacgccgaccgcaagcgtgatgccttcatggaccacctgaagagcaagtacccacagcacgccctggccctgcgaggccagcaggacaggatgcgagagcagccaaactactggagtttcaagacccgcagctcacgccacactcagggagcccagcccgggctggcagaccaggcggcaaagctgtcctacgcctccgccgagtcgctggagaccatgtcggaggccgagctgcccctgggcttcagcaggatgaaccgcttccgacagagcctgcctctctcccgctcggccagccagaccaagctgcgctccccaggggtgctgttcctgcagttcggggaggagactcggcgcgtgcacatcacgcacgaggtcagcagcctggacacgctgcacgcactcatcgcgcacatgttcccgcagaagctcaccatgggcatgcttaagtcgcccaataccgccatcctcatcaaagacgaggctcgcaacgtcttctacgagctggaggacgtccgggacatccaggaccgcagtattatcaagatctacagaaaggagcccctctacgctgccttccctggctcacatctcaccaacggggacctccggagagagatggtgtacgcatcgcgggagtcctcgcccacgcggcgcctcaacaacctgtcaccagcgccgcacctggcatccggctcgccgccgcccgggctgccgtcggggctgccgtccgggctgcagtccggttcgccgtcgcgttcgcgcctatcgtacgccggggggcgcccgccttcgtacgccggcagcccggtgcaccacgcggccgagaggctgggaggcgccccggccgcccagggcgtcagccccagccccagcgccatcctggagcggcgcgacgtgaagccggacgaggacctggcgagcaaggcgggcggcatggtgctggtgaaaggcgagggcctctatgctgacccctacgggctgctgcacgagggccgtctgagcctggccgcggccgccggcgacccgttcgcctacccgggcgccggcggcctctacaagcgcggctcggtgcgctcgctcagcacctactcggccgccgcgctgcagtccgatctggaggactccctgtacaaggcggcgggcggcggcggcccgctgtacggcgacggctacggcttccgcctgccgccttcgtcaccgcagaagctggccgacgtggcagcaccccccggaggtcccccgccaccgcacagcccctactcggggccgcccagccgcggctcgccagtgcgccagtccttccgcaaggactcgggctcctcgtccgtctttgccgagagtcctggagggaagacccgcagcgcggggagcgcctcgacggccggagctcccccttcggagctcttccctgggcctggggaacgctcgctggttgggttcgggccgccagtgccagccaaggacacggagaccagggagcgcatggaggccatggagaagcagattgccagcctcacaggcctggtgcagagcgccttactgcgaggctctgagcctgagacccccagcgagaagattgaaggctccaatggagcagccaccccctcagcaccctgtgggtcaggcggccggagcagcggggccaccccggtgtccggcccgcccccgccctcggccagcagcacccccgcaggtcagcctaccgccgttagccggctgcagatgcagcttcacctgcgaggcctgcagaacagcgccagtgacttgcgcggccagctccagcagttgcgcaagctccagctacagaaccaggagtcggtgcgcgcgctgctgaagcgcacggaggcagagctgagcatgcgcgtgtcggaggcggcgcggcggcaggaggacccgctgcagcggcagcgcaccctggtggaagaggaacggctgcgctatctcaacgacgaggagcttattacccagcagctcaatgacctggagaaatcggtggagaagatccagagagacgtgtcccacaaccaccggctggtgcccggccctgagctggaggagaaggcactggtgctgaagcagctcggggagacgctgacagagctcaaggctcacttcccgggcctgcagagcaagatgcgggtggtgctgcgcgtggaggtggaggcggtgaagttcctgaaggaggagccccagcgcctggatgggctcctcaagcgctgccgcggggtcacggacacgctggcccagatccgaaggcaagtggatgagggtgtgtggccaccccccaacaatctcctgagtcagtcccccaagaaggtgacggcagagactgacttcaacaagagcgtggacttcgaaatgccaccccccagccccccgctgaacctgcatgagctgagcgggccagctgaaggagcctctcttacccccaaggggggcaaccccaccaaaggcctggacactcctggcaagagaagcgtggacaaagctgtgtctgttgaggctgcagagcgagactgggaggagaagcgggcagccctgacccagtacagtgccaaggacatcaaccggctgctggaagagacacaggcagagctgctcaaggccatccctgacctggactgtgccagcaaggcccatccaggcccggcccccactccagatcacaagccccccaaggccccccacggccagaaggcagccccccgaacggagcccagtgggaggaggggctcagatgagttgaccgtgccccgataccgcacagagaagccctccaagtcgcccccaccgccccctccccgccggagcttcccctcctcccatggcctgaccaccacacgtaccggagaggtggtggtcaccagcaagaaggactcggccttcatcaagaaggctgagtccgaggagctggaggtgcagaagccccaggtgaagctgcgccgggctgtgtctgaggtggcccgcccagcctccacaccacccatcatggcctcggccatcaaggacgaggatgacgaggatcgcatcatcgcagagctagagagtggcggaggcagtgtaccacccatgaaggtggtgactccgggggcctctcggctgaaggcggcccagggccaggcgggcagccccgacaaaagcaaacatggcaagcagagggccgagtacatgcggatccaggcccagcagcaggccactaaaccatctaaagagatgagcgggtcgaatgagacctcgagcccagtctcagaaaagccctcggcttccagaacctctatccctgtattgacttcctttggggcaaggaattcttccatctccttctagaagcccctcaccccgctgccccgcctgtccccctccctcactcctgccatttctcccctctcttccttcatctccaccccaccccaccctactctccagacgccctgaggggtgtgccctgaagaggagggtgcggccctcctcagcgacccctacccatcatctgttggtgtttttggttttgtttttttttttttttttaacaattaacttttaattatctttttttaaacagtaaaactaaaaaccaaacacaccaccttccttgatcccagctggcctctcgctggccgcacctgtcacatctctccttcttctctttcaccactctttcccccagtccatcctgaagctcctgcacccccttcccgccttcccctcacttcccaagaatactccaaacaaactctgaaccacggagacttggagcagtgggagacccctctcccgtttctcgataccttcctggaggaacgcggggacatcggaccaacccatacatcaagccagagagcggggcttagggagactggccttggagatgccccactccctgtctaagctccgacaagactgtgacttcctctgtggctgctctgcctcctcccactcacacccaagtgggcctggagtagagacggacaggctggagacgaggccggagtttgagaggcctcagggtgggtgtgaggccatggagtctgtatccctggggaggcgctggcctcctgggccttgccgtccagtggggagtggagggcagaggccctttggtctgctggctgtggagggtgggttgcacggacagccggatatcggggacactgccttgggagagggcggcccggacgggtatttggtacttttagtttcctgatttagcactttaaatggcattaacttattgaatggggatggggtgggcaagagtgaggggcctagaaaaccaggttttgtggcttgcagttgggggaagggtctggtttgagggaaatgggagggtcgagaggggcttgacggggagcactgaagacacctgggacccgcaggtggggtgacttgaacttcagtcatcctcttggcaatttgagggttttcccaggaaaggatgagacgtagtttttcaatggggctctggtgaccctggtgagatgtctgaaggtccctgaggcctgaccatccagccagcgcccctggcctgtggacgccctgcctgccctgcagaggcggttggcagtgccgcctggcttttggccgggtcctggggaggcagagagaggccaattttggttctcactcctggccccccagagggcacagtgaggagccggtagggagaggataggagaagaggaggaggaggagcggggtccccggccgcaggattcccacttggagcacaaagtgaagtaagcacaggggagggggactagaatcagtcccccatagcaagcacagaaaggaggagctgcgcagaaggcagagccccccagaccctggggcctggctggggaaggtccgcacctggggagagctgggagctgttgaaggtttggggggaggggaaacgggttgtgtttcttcatttctttttttgtttttgcctttgttggttcatccttgttttctagctttggatcatttttgtaccaaggcgagcaagcctttttgaaaaataacaaaagaggaaaaaaaaaatccctcctggaaaaaaaaaaaaaccctggaaaatagaaaaaaaaaaaaggacctcataaatgatgcaattacttttaattgcaggcaactctttacatttaagtgaagtgtcttaacattttatattgttttaaaaatatatttacatattatatatataatatacgtaatataaatatatataaatatttaaaaaagaaaaaaaaaagaaaaccacggcactctccctggccactgttttggcgggggaggggggctggggggcgggcacgtcggcctggcttctgtggtcccagtgaaatggtctggtttgatttggctgtacagagaccccctgacttgggaggggaggggggagtggtgccccctcctccctccactccattactctctgcttgctacttcgcttgcccccagctcccaccctcagccctgtgactggaatgtgtgccccaccgtcattgtcctgagttgaatgtccctttgtgggggaggtggggggggcagtgtccatccacgaaggggcagaaggagggagccacgtgccccgccccacccgctcgggtgaagcccagtgggatttgcatctttctttctctttggttcctgcacatttatgggctgggaggcatccgtgtggaattgcgtgcagcctgtgtgtgtgctggcacaagcccatgcactgtgtgtgcagacgcatggggcctgcacccacaggcatggccgagcacatgtgtgggggaaggcgtgggcacataggtgcatgtaacctgtttgggcattggcacgtgcctacctgcatgttagcgtgagaggagctttgtgtgtgagaacatgtgtaatgtgtgtgcagacatgccgagagccagagacttgtgtgtgggccacgtacatgtggatagagacgcatacatggaggtgcatgtaatctgtgtctccgagtgtgtgtgtgcaggtatgtgtgctggtgcagacccaagtgtgtgggtgtgcctctgtgtgcgtgtgttccatcatccctgcaccactggctccagatcccttcctgagcccccgtccccgctggccctctcacagcctgcagcacatcagtgcccccagctgcatgcgcctcgctgctctgtccatcagtgtgtgcttgaccaagagaaaactaagacgtctcgggggacccctgtacctggtcctctcagcccccgcccactgtgctgtgttactcgcatgggggatttcctgccccttccacaatatgctgtttccccaggagcctcaggcctgaggctctgagtggggtccccagggggccccccggggtgagccccggctccacaccctgccccatccaccctgtagggcccatgttggtgtagcagtgatggcttctgtggatattctgtgacctctgtcggtgtaacttgacaatttctaaatggaaaagggttgctgtgttttctctgtctctcttttttaatgtccttttttcttctcccccgctccctgctctctttccttttcagtttttctagccaagtgtttggggctttaataaaacttgtttctttttcctctcctggatctccttc

SEQ ID NO: 20404 - DNA, 4644 bp, Homo sapiens
  ENST00000631564
ggcggggcccgcgcccccggcccgcccgcctggcaccgcgccccggggctggggccgagcgaggagcccgcgaggcggcgagagggcgagcgccaggcaggccggcccggggcccccgccccccgcgcccccgcccgatggggaacgctccgtcccaagatccggagcggagcagcccccccatgctgtctgcggacgatgcggagtacccgcgggagtaccggaccctggggggcgggggcggcgggggcagcgggggccggcgcttctccaacgtggggctggtgcacacgtccgagcggcggcacacggtgatcgcggcccagagtctggaggcgctcagcgggctccagaaggcggacgccgaccgcaagcgtgatgccttcatggaccacctgaagagcaagtacccacagcacgccctggccctgcgaggccagcaggacaggatgcgagagcaggttggcggctggaccgtggaccccgtatgcctcctcagctccctctgctcccacctccatggcgactccgccccctccggggctggccagccggcccagcagccaaactactggagtttcaagacccgcagctcacgccacactcagggagcccagcccgggctggcagaccaggcggcaaagctgtcctacgcctccgccgagtcgctggagaccatgtcggaggccgagctgcccctgggcttcagcaggatgaaccgcttccgacagagcctgcctctctcccgctcggccagccagaccaagctgcgctccccaggggtgctgttcctgcagttcggggaggagactcggcgcgtgcacatcacgcacgaggtcagcagcctggacacgctgcacgcactcatcgcgcacatgttcccgcagaagctcaccatgggcatgcttaagtcgcccaataccgccatcctcatcaaagacgaggctcgcaacgtcttctacgagctggaggacgtccgggacatccaggaccgcagtattatcaagatctacagaaaggagcccctctacgctgccttccctggctcacatctcaccaacggggacctccggagagagatggtgtacgcatcgcgggagtcctcgcccacgcggcgcctcaacaacctgtcaccagcgccgcacctggcatccggctcgccgccgcccgggctgccgtcggggctgccgtccgggctgcagtccggttcgccgtcgcgttcgcgcctatcgtacgccggggggcgcccgccttcgtacgccggcagcccggtgcaccacgcggccgagaggctgggaggcgccccggccgcccagggcgtcagccccagccccagcgccatcctggagcggcgcgacgtgaagccggacgaggacctggcgagcaaggcgggcggcatggtgctggtgaaaggcgagggcctctatgctgacccctacgggctgctgcacgagggccgtctgagcctggccgcggccgccggcgacccgttcgcctacccgggcgccggcggcctctacaagcgcggctcggtgcgctcgctcagcacctactcggccgccgcgctgcagtccgatctggaggactccctgtacaaggcggcgggcggcggcggcccgctgtacggcgacggctacggcttccgcctgccgccttcgtcaccgcagaagctggccgacgtggcagcaccccccggaggtcccccgccaccgcacagcccctactcggggccgcccagccgcggctcgccagtgcgccagtccttccgcaaggactcgggctcctcgtccgtctttgccgagagtcctggagggaagacccgcagcgcggggagcgcctcgacggccggagctcccccttcggagctcttccctgggcctggggaacgctcgctggttgggttcgggccgccagtgccagccaaggacacggagaccagggagcgcatggaggccatggagaagcagattgccagcctcacaggcctggtgcagagcgccttactgcgaggctctgagcctgagacccccagcgagaagattgaaggctccaatggagcagccaccccctcagcaccctgtgggtcaggcggccggagcagcggggccaccccggtgtccggcccgcccccgccctcggccagcagcacccccgcaggtcagcctaccgccgttagccggctgcagatgcagcttcacctgcgaggcctgcagaacagcgccagtgacttgcgcggccagctccagcagttgcgcaagctccagctacagaaccaggagtcggtgcgcgcgctgctgaagcgcacggaggcagagctgagcatgcgcgtgtcggaggcggcgcggcggcaggaggacccgctgcagcggcagcgcaccctggtggaagaggaacggctgcgctatctcaacgacgaggagcttattacccagcagctcaatgacctggagaaatcggtggagaagatccagagagacgtgtcccacaaccaccggctggtgcccggccctgagctggaggagaaggcactggtgctgaagcagctcggggagacgctgacagagctcaaggctcacttcccgggcctgcagagcaagatgcgggtggtgctgcgcgtggaggtggaggcggtgaagttcctgaaggaggagccccagcgcctggatgggctcctcaagcgctgccgcggggtcacggacacgctggcccagatccgaaggcaagtggatgagggtgtgtggccaccccccaacaatctcctgagtcagtcccccaagaaggtgacggcagagactgacttcaacaagagcgtggacttcgaaatgccaccccccagccccccgctgaacctgcatgagctgagcgggccagctgaaggagcctctcttacccccaaggggggcaaccccaccaaaggcctggacactcctggcaagagaagcgtggacaaagctgtgtctgttgaggctgcagagcgagactgggaggagaagcgggcagccctgacccagtacagtgccaaggacatcaaccggctgctggaagagacacaggcagagctgctcaaggccatccctgacctggactgtgccagcaaggcccatccaggcccggcccccactccagatcacaagccccccaaggccccccacggccagaaggcagccccccgaacggagcccagtgggaggaggggctcagatgagttgaccgtgccccgataccgcacagagaagccctccaagtcgcccccaccgccccctccccgccggagcttcccctcctcccatggcctgaccaccacacgtaccggagaggtggtggtcaccagcaagaaggactcggccttcatcaagaaggctgagtccgaggagctggaggtgcagaagccccaggtgaagctgcgccgggctgtgtctgaggtggcccgcccagcctccacaccacccatcatggcctcggccatcaaggacgaggatgacgaggatcgcatcatcgcagagctagagagtggcggaggcagtgtaccacccatgaaggtggtgactccgggggcctctcggctgaaggcggcccagggccaggcgggcagccccgacaaaagcaaacatggcaagcagagggccgagtacatgcggatccaggcccagcagcaggccactaaaccatctaaagagatgagcgggtcgaatgagacctcgagcccagtctcagaaaagccctcggcttccagaacctctatccctgtattgacttcctttggggcaaggaattcttccatctccttctagaagcccctcaccccgctgccccgcctgtccccctccctcactcctgccatttctcccctctcttccttcatctccaccccaccccaccctactctccagacgccctgaggggtgtgccctgaagaggagggtgcggccctcctcagcgacccctacccatcatctgttggtgtttttggttttgtttttttttttttttttaacaattaacttttaattatctttttttaaacagtaaaactaaaaaccaaacacaccaccttccttgatcccagctggcctctcgctggccgcacctgtcacatctctccttcttctctttcaccactctttcccccagtccatcctgaagctcctgcacccccttcccgccttcccctcacttcccaagaatactccaaacaaactctgaaccacggagacttggagcagtgggagacccctctcccgtttctcgataccttcctggaggaacgcggggacatcggaccaacccatacatcaagccagagagcggggcttagggagactggccttggagatgccccactccctgtctaagctccgacaagactgtgacttcctctgtggctgctctgcctcctcccactcacacccaagtgggcctggagtagagacggacaggctggagacgaggccggagtttgagaggcctcagggtgggtgtgaggccatggagtctgtatccctggggaggcgctggcctcctgggccttgccgtccagtggggagtggagggcagaggccctttggtctgctggctgtggagggtgggttgcacggacagccggatatcggggacactgccttgggagagggcggcccggacggg

SEQ ID NO: 20405 - DNA, 4635 bp, Homo sapiens
  ENST00000632724
gttcccgcagaagctcaccatgggcatgcttaagtcgcccaataccgccatcctcatcaaagacgaggctcgcaacgtcttctacgagctggaggacgtccgggacatccaggaccgcagtattatcaagatctacagaaaggagcccctctacgctgccttccctggctcacatctcaccaacggggacctccggagagagatggtgtacgcatcgcgggagtcctcgcccacgcggcgcctcaacaacctgtcaccagcgccgcacctggcatccggctcgccgccgcccgggctgccgtcggggctgccgtccgggctgcagtccggttcgccgtcgcgttcgcgcctatcgtacgccggggggcgcccgccttcgtacgccggcagcccggtgcaccacgcggccgagaggctgggaggcgccccggccgcccagggcgtcagccccagccccagcgccatcctggagcggcgcgacgtgaagccggacgaggacctggcgagcaaggcgggcggcatggtgctggtgaaaggcgagggcctctatgctgacccctacgggctgctgcacgagggccgtctgagcctggccgcggccgccggcgacccgttcgcctacccgggcgccggcggcctctacaagcgcggctcggtgcgctcgctcagcacctactcggccgccgcgctgcagtccgatctggaggactccctgtacaaggcggcgggcggcggcggcccgctgtacggcgacggctacggcttccgcctgccgccttcgtcaccgcagaagctggccgacgtggcagcaccccccggaggtcccccgccaccgcacagcccctactcggggccgcccagccgcggctcgccagtgcgccagtccttccgcaaggactcgggctcctcgtccgtctttgccgagagtcctggagggaagacccgcagcgcggggagcgcctcgacggccggagctcccccttcggagctcttccctgggcctggggaacgctcgctggttgggttcgggccgccagtgccagccaaggacacggagaccagggagcgcatggaggccatggagaagcagattgccagcctcacaggcctggtgcagagcgccttactgcgaggctctgagcctgagacccccagcgagaagattgaaggctccaatggagcagccaccccctcagcaccctgtgggtcaggcggccggagcagcggggccaccccggtgtccggcccgcccccgccctcggccagcagcacccccgcaggtcagcctaccgccgttagccggctgcagatgcagcttcacctgcgaggcctgcagaacagcgccagtgacttgcgcggccagctccagcagttgcgcaagctccagctacagaaccaggagtcggtgcgcgcgctgctgaagcgcacggaggcagagctgagcatgcgcgtgtcggaggcggcgcggcggcaggaggacccgctgcagcggcagcgcaccctggtggaagaggaacggctgcgctatctcaacgacgaggagcttattacccagcagctcaatgacctggagaaatcggtggagaagatccagagagacgtgtcccacaaccaccggctggtgcccggccctgagctggaggagaaggcactggtgctgaagcagctcggggagacgctgacagagctcaaggctcacttcccgggcctgcagagcaagatgcgggtggtgctgcgcgtggaggtggaggcggtgaagttcctgaaggaggagccccagcgcctggatgggctcctcaagcgctgccgcggggtcacggacacgctggcccagatccgaaggcaagtggatgagggtgtgtggccaccccccaacaatctcctgagtcagtcccccaagaaggtgacggcagagactgacttcaacaagagcgtggacttcgaaatgccaccccccagccccccgctgaacctgcatgagctgagcgggccagctgaaggagcctctcttacccccaaggggggcaaccccaccaaaggcctggacactcctggcaagagaagcgtggacaaagctgtgtctgttgaggctgcagagcgagactgggaggagaagcgggcagccctgacccagtacagtgccaaggacatcaaccggctgctggaagagacacaggcagagctgctcaaggccatccctgacctggactgtgccagcaaggcccatccaggcccggcccccactccagatcacaagccccccaaggccccccacggccagaaggcagccccccgaacggagcccagtgggaggaggggctcagatgagttgaccgtgccccgataccgcacagagaagccctccaagtcgcccccaccgccccctccccgccggagcttcccctcctcccatggcctgaccaccacacgtaccggagaggtggtggtcaccagcaagaaggactcggccttcatcaagaaggctgagtccgaggagctggaggtgcagaagccccaggtgaagctgcgccgggctgtgtctgaggtggcccgcccagcctccacaccacccatcatggcctcggccatcaaggacgaggatgacgaggatcgcatcatcgcagagctagagagtggcggaggcagtgtaccacccatgaaggtggtgactccgggggcctctcggctgaaggcggcccagggccaggcgggcagccccgacaaaagcaaacatggcaagcagagggccgagtacatgcggatccaggcccagcagcaggtctaatgagcaggcgcggaggctgtgtggagagtggacatacctcacctgtgggtgtttactgcccttgtggcctggtcagaggctgcagggtggctcctggacccagatgttgtgagagacccttagtgcactcgtttgatttagttaatatttatgagcagctcctgtatgacaggcccattctgggtgtgagggtgggggctgtgatatgtccagatgctctcacttaaagaaggttctagactcagaggcaagacgttagagaaggttctagactcagaggcaagaggttagagatgggtgagtccatctctttttcagatgagggggcagctcagaggaggagaggggcttcccaaaggtgcacagcaaggtggcatcacagccaggatcgggacctaggaatcttggaacccttccctgcactggccctgggacagccctgggcacccaaggccctgcctccctactggctcccaggagaatttctcaaaaagcagccctccagccccccgcagcctctccacagctcccacctgcctcctcatggcccccagacaccctgcgagccccacctccagatctttttcctgccactgccagggatgagttccccttgtcctgtccgggctggaccctcctgggtgcccagcagagcagctgacactgacagagctttcgctggggccaggcatgcgcattatctcatctcacactcaccacactgaggaaggtctattacccccatgtgacgggggcggaaactgaggcttaatccaaggccacacggctagcaagtggggggcaggacacaagtccagactgcctccctccccaccacaaagtgcttcagcctctccagcagccccttccctcagctctaatgatgttgcactgtttcccaccctagtccctccctccccagagcccagctcctccgctgtggtgtcagcctcatgcctttatggcccagcctccaccccatctccggggttgcctgggtctccagtgacatcgagatgggctcttttcacccccctcccccactgctctgcagcatgtggccttgtagaccccccccacacctgcatagggctgtgcagaccctctgttcctcagcatcctctccccagcctccacctggagcctctgggctcctttctgggtgactccctctattttttgagacggagtcttgctctgtctcccaggctggagtccagtggtgtgatctcagctcactgcagcctccgcctcctgggttcaagtgattctcgtgcctcagcctcccgagcagctgagactacaggctaattaccacactggctaatttttgtatttttagtagagacggggtttcaccatgttggccaggctggtctcaaactcctgagctcaggtgatcctcccacctcagcctcccaaagtgctgggattacaggcgtgagccattgcaccctgcctgggcgactctcctttgcctgcctcttcccttcctgtgccccactcctcagcctcttctcctcacaccatgccttcctctcctcaggcaccaggtgcactgcttagtccctgcccccacccaggtctccattctgagctccagtcacccacacacgcttccccgggcatccccaggctcctcgaatgcgtgtgtccagacataatgctcccccgaccacgctgccccagccggtacgaggctgccccagctgctgtctccctcaggaagggtcgcccacccccagccttcccaagcccctccgtgcccctgtctcacttccagtgctccagtagcctttcttataaacatggcttctttcttgtaaagtaataaatgtttacagtggaaa

SEQ ID NO: 20406 - DNA, 5204 bp, Homo sapiens
  ENST00000631905
cagccccttctccccaagcaaccccagctctctccatctctctctcgccctcagcatccccacccgacccctttccctccaagcctcctctctccctcttgcttccttttctgtccctttctttcatccctcccttctctcccatctcccttctctaactctctccaacctctctctccctcagctcacttcccctcagtttccgccccacctgctctgcccccacttccatttccttgtccaagttccttcaactgcctggagtccagtgggtgccttgagaggctggagagccggcctggcgcccccgccggcagcatgagaggtgcctgggtgcatctgcactcgggggcggcgtctagcctcagaccctgccgctgcggggctggcgcagctccgaaaagctccccgcgctctcctggagggcggcgtggagacggcagcagtgacagcgagggcggcgtctccttcgcaggggtgctgttcctgcagttcggggaggagactcggcgcgtgcacatcacgcacgaggtcagcagcctggacacgctgcacgcactcatcgcgcacatgttcccgcagaagctcaccatgggcatgcttaagtcgcccaataccgccatcctcatcaaagacgaggctcgcaacgtcttctacgagctggaggacgtccgggacatccaggaccgcagtattatcaagatctacagaaaggagcccctctacgctgccttccctggctcacatctcaccaacggggacctccggagagagatggtgtacgcatcgcgggagtcctcgcccacgcggcgcctcaacaacctgtcaccagcgccgcacctggcatccggctcgccgccgcccgggctgccgtcggggctgccgtccgggctgcagtccggttcgccgtcgcgttcgcgcctatcgtacgccggggggcgcccgccttcgtacgccggcagcccggtgcaccacgcggccgagaggctgggaggcgccccggccgcccagggcgtcagccccagccccagcgccatcctggagcggcgcgacgtgaagccggacgaggacctggcgagcaaggcgggcggcatggtgctggtgaaaggcgagggcctctatgctgacccctacgggctgctgcacgagggccgtctgagcctggccgcggccgccggcgacccgttcgcctacccgggcgccggcggcctctacaagcgcggctcggtgcgctcgctcagcacctactcggccgccgcgctgcagtccgatctggaggactccctgtacaaggcggcgggcggcggcggcccgctgtacggcgacggctacggcttccgcctgccgccttcgtcaccgcagaagctggccgacgtggcagcaccccccggaggtcccccgccaccgcacagcccctactcggggccgcccagccgcggctcgccagtgcgccagtccttccgcaaggactcgggctcctcgtccgtctttgccgagagtcctggagggaagacccgcagcgcggggagcgcctcgacggccggagctcccccttcggagctcttccctgggcctggggaacgctcgctggttgggttcgggccgccagtgccagccaaggacacggagaccagggagcgcatggaggccatggagaagcagattgccagcctcacaggcctggtgcagagcgccttactgcgaggctctgagcctgagacccccagcgagaagattgaaggctccaatggagcagccaccccctcagcaccctgtgggtcaggcggccggagcagcggggccaccccggtgtccggcccgcccccgccctcggccagcagcacccccgcaggtcagcctaccgccgttagccggctgcagatgcagcttcacctgcgaggcctgcagaacagcgccagtgacttgcgcggccagctccagcagttgcgcaagctccagctacagaaccaggagtcggtgcgcgcgctgctgaagcgcacggaggcagagctgagcatgcgcgtgtcggaggcggcgcggcggcaggaggacccgctgcagcggcagcgcaccctggtggaagaggaacggctgcgctatctcaacgacgaggagcttattacccagcagctcaatgacctggagaaatcggtggagaagatccagagagacgtgtcccacaaccaccggctggtgcccggccctgagctggaggagaaggcactggtgctgaagcagctcggggagacgctgacagagctcaaggctcacttcccgggcctgcagagcaagatgcgggtggtgctgcgcgtggaggtggaggcggtgaagttcctgaaggaggagccccagcgcctggatgggctcctcaagcgctgccgcggggtcacggacacgctggcccagatccgaaggcaagtggatgagggtgtgtggccaccccccaacaatctcctgagtcagtcccccaagaaggtgacggcagagactgacttcaacaagagcgtggacttcgaaatgccaccccccagccccccgctgaacctgcatgagctgagcgggccagctgaaggagcctctcttacccccaaggggggcaaccccaccaaaggcctggacactcctggcaagagaagcgtggacaaagctgtgtctgttgaggctgcagagcgagactgggaggagaagcgggcagccctgacccagtacagtgccaaggacatcaaccggctgctggaagagacacaggcagagctgctcaaggccatccctgacctggactgtgccagcaaggcccatccaggcccggcccccactccagatcacaagccccccaaggccccccacggccagaaggcagccccccgaacggagcccagtgggaggaggggctcagatgagttgaccgtgccccgataccgcacagagaagccctccaagtcgcccccaccgccccctccccgccggagcttcccctcctcccatggcctgaccaccacacgtaccggagaggtggtggtcaccagcaagaaggactcggccttcatcaagaaggctgagtccgaggagctggaggtgcagaagccccaggtgaagctgcgccgggctgtgtctgaggtggcccgcccagcctccacaccacccatcatggcctcggccatcaaggacgaggatgacgaggatcgcatcatcgcagagctagagagtggcggaggcagtgtaccacccatgaaggtggtgactccgggggcctctcggctgaaggcggcccagggccaggcgggcagccccgacaaaagcaaacatggcaagcagagggccgagtacatgcggatccaggcccagcagcaggtctaatgagcaggcgcggaggctgtgtggagagtggacatacctcacctgtgggtgtttactgcccttgtggcctggtcagaggctgcagggtggctcctggacccagatgttgtgagagacccttagtgcactcgtttgatttagttaatatttatgagcagctcctgtatgacaggcccattctgggtgtgagggtgggggctgtgatatgtccagatgctctcacttaaagaaggttctagactcagaggcaagacgttagagaaggttctagactcagaggcaagaggttagagatgggtgagtccatctctttttcagatgagggggcagctcagaggaggagaggggcttcccaaaggtgcacagcaaggtggcatcacagccaggatcgggacctaggaatcttggaacccttccctgcactggccctgggacagccctgggcacccaaggccctgcctccctactggctcccaggagaatttctcaaaaagcagccctccagccccccgcagcctctccacagctcccacctgcctcctcatggcccccagacaccctgcgagccccacctccagatctttttcctgccactgccagggatgagttccccttgtcctgtccgggctggaccctcctgggtgcccagcagagcagctgacactgacagagctttcgctggggccaggcatgcgcattatctcatctcacactcaccacactgaggaaggtctattacccccatgtgacgggggcggaaactgaggcttaatccaaggccacacggctagcaagtggggggcaggacacaagtccagactgcctccctccccaccacaaagtgcttcagcctctccagcagccccttccctcagctctaatgatgttgcactgtttcccaccctagtccctccctccccagagcccagctcctccgctgtggtgtcagcctcatgcctttatggcccagcctccaccccatctccggggttgcctgggtctccagtgacatcgagatgggctcttttcacccccctcccccactgctctgcagcatgtggccttgtagaccccccccacacctgcatagggctgtgcagaccctctgttcctcagcatcctctccccagcctccacctggagcctctgggctcctttctgggtgactccctctattttttgagacggagtcttgctctgtctcccaggctggagtccagtggtgtgatctcagctcactgcagcctccgcctcctgggttcaagtgattctcgtgcctcagcctcccgagcagctgagactacaggctaattaccacactggctaatttttgtatttttagtagagacggggtttcaccatgttggccaggctggtctcaaactcctgagctcaggtgatcctcccacctcagcctcccaaagtgctgggattacaggcgtgagccattgcaccctgcctgggcgactctcctttgcctgcctcttcccttcctgtgccccactcctcagcctcttctcctcacaccatgccttcctctcctcaggcaccaggtgcactgcttagtccctgcccccacccaggtctccattctgagctccagtcacccacacacgcttccccgggcatccccaggctcctcgaatgcgtgtgtccagacataatgctcccccgaccacgctgccccagccggtacgaggctgccccagctgctgtctccctcaggaagggtcgcccacccccagccttcccaagcccctccgtgcccctgtctcacttccagtgctccagtagcctttcttataaacatggcttctttcttgtaaagtaataaatgtttacagtgg

SEQ ID NO: 20407 - DNA, 5225 bp, Homo sapiens
  ENST00000631691
gcattgcagcaaagggcaccggcggcggcggccgcggctgcggaggcggccgggggagagaagagcccgggcgggtgggagtaggggccctccctccccagccggacgcaggacctggggctggggaccccgcacgtacacctgtggccgcagcagccaaactactggagtttcaagacccgcagctcacgccacactcagggagcccagcccgggctggcagaccaggcggcaaagctgtcctacgcctccgccgagtcgctggagaccatgtcggaggccgagctgcccctgggcttcagcaggatgaaccgcttccgacagagcctgcctctctcccgctcggccagccagaccaagctgcgctccccaggggtgctgttcctgcagttcggggaggagactcggcgcgtgcacatcacgcacgaggtcagcagcctggacacgctgcacgcactcatcgcgcacatgttcccgcagaagctcaccatgggcatgcttaagtcgcccaataccgccatcctcatcaaagacgaggctcgcaacgtcttctacgagctggaggacgtccgggacatccaggaccgcagtattatcaagatctacagaaaggagcccctctacgctgccttccctggctcacatctcaccaacggggacctccggagagagatggtgtacgcatcgcgggagtcctcgcccacgcggcgcctcaacaacctgtcaccagcgccgcacctggcatccggctcgccgccgcccgggctgccgtcggggctgccgtccgggctgcagtccggttcgccgtcgcgttcgcgcctatcgtacgccggggggcgcccgccttcgtacgccggcagcccggtgcaccacgcggccgagaggctgggaggcgccccggccgcccagggcgtcagccccagccccagcgccatcctggagcggcgcgacgtgaagccggacgaggacctggcgagcaaggcgggcggcatggtgctggtgaaaggcgagggcctctatgctgacccctacgggctgctgcacgagggccgtctgagcctggccgcggccgccggcgacccgttcgcctacccgggcgccggcggcctctacaagcgcggctcggtgcgctcgctcagcacctactcggccgccgcgctgcagtccgatctggaggactccctgtacaaggcggcgggcggcggcggcccgctgtacggcgacggctacggcttccgcctgccgccttcgtcaccgcagaagctggccgacgtggcagcaccccccggaggtcccccgccaccgcacagcccctactcggggccgcccagccgcggctcgccagtgcgccagtccttccgcaaggactcgggctcctcgtccgtctttgccgagagtcctggagggaagacccgcagcgcggggagcgcctcgacggccggagctcccccttcggagctcttccctgggcctggggaacgctcgctggttgggttcgggccgccagtgccagccaaggacacggagaccagggagcgcatggaggccatggagaagcagattgccagcctcacaggcctggtgcagagcgccttactgcgaggctctgagcctgagacccccagcgagaagattgaaggctccaatggagcagccaccccctcagcaccctgtgggtcaggcggccggagcagcggggccaccccggtgtccggcccgcccccgccctcggccagcagcacccccgcaggtcagcctaccgccgttagccggctgcagatgcagcttcacctgcgaggcctgcagaacagcgccagtgacttgcgcggccagctccagcagttgcgcaagctccagctacagaaccaggagtcggtgcgcgcgctgctgaagcgcacggaggcagagctgagcatgcgcgtgtcggaggcggcgcggcggcaggaggacccgctgcagcggcagcgcaccctggtggaagaggaacggctgcgctatctcaacgacgaggagcttattacccagcagctcaatgacctggagaaatcggtggagaagatccagagagacgtgtcccacaaccaccggctggtgcccggccctgagctggaggagaaggcactggtgctgaagcagctcggggagacgctgacagagctcaaggctcacttcccgggcctgcagagcaagatgcgggtggtgctgcgcgtggaggtggaggcggtgaagttcctgaaggaggagccccagcgcctggatgggctcctcaagcgctgccgcggggtcacggacacgctggcccagatccgaaggcaagtggatgagggtgtgtggccaccccccaacaatctcctgagtcagtcccccaagaaggtgacggcagagactgacttcaacaagagcgtggacttcgaaatgccaccccccagccccccgctgaacctgcatgagctgagcgggccagctgaaggagcctctcttacccccaaggggggcaaccccaccaaaggcctggacactcctggcaagagaagcgtggacaaagctgtgtctgttgaggctgcagagcgagactgggaggagaagcgggcagccctgacccagtacagtgccaaggacatcaaccggctgctggaagagacacaggcagagctgctcaaggccatccctgacctggactgtgccagcaaggcccatccaggcccggcccccactccagatcacaagccccccaaggccccccacggccagaaggcagccccccgaacggagcccagtgggaggaggggctcagatgagttgaccgtgccccgataccgcacagagaagccctccaagtcgcccccaccgccccctccccgccggagcttcccctcctcccatggcctgaccaccacacgtaccggagaggtggtggtcaccagcaagaaggactcggccttcatcaagaaggctgagtccgaggagctggaggtgcagaagccccaggtgaagctgcgccgggctgtgtctgaggtggcccgcccagcctccacaccacccatcatggcctcggccatcaaggacgaggatgacgaggatcgcatcatcgcagagctagaggtgtttgagagaagctcagtgtcttccctcccccccacgccccgccgccagctgatccccaccttgctgtccccccaggacctggggccccccgggggctcagccccaggccctacacggaagagtggcggaggcagtgtaccacccatgaaggtggtgactccgggggcctctcggctgaaggcggcccagggccaggcgggcagccccgacaaaagcaaacatggcaagcagagggccgagtacatgcggatccaggcccagcagcaggtctaatgagcaggcgcggaggctgtgtggagagtggacatacctcacctgtgggtgtttactgcccttgtggcctggtcagaggctgcagggtggctcctggacccagatgttgtgagagacccttagtgcactcgtttgatttagttaatatttatgagcagctcctgtatgacaggcccattctgggtgtgagggtgggggctgtgatatgtccagatgctctcacttaaagaaggttctagactcagaggcaagacgttagagaaggttctagactcagaggcaagaggttagagatgggtgagtccatctctttttcagatgagggggcagctcagaggaggagaggggcttcccaaaggtgcacagcaaggtggcatcacagccaggatcgggacctaggaatcttggaacccttccctgcactggccctgggacagccctgggcacccaaggccctgcctccctactggctcccaggagaatttctcaaaaagcagccctccagccccccgcagcctctccacagctcccacctgcctcctcatggcccccagacaccctgcgagccccacctccagatctttttcctgccactgccagggatgagttccccttgtcctgtccgggctggaccctcctgggtgcccagcagagcagctgacactgacagagctttcgctggggccaggcatgcgcattatctcatctcacactcaccacactgaggaaggtctattacccccatgtgacgggggcggaaactgaggcttaatccaaggccacacggctagcaagtggggggcaggacacaagtccagactgcctccctccccaccacaaagtgcttcagcctctccagcagccccttccctcagctctaatgatgttgcactgtttcccaccctagtccctccctccccagagcccagctcctccgctgtggtgtcagcctcatgcctttatggcccagcctccaccccatctccggggttgcctgggtctccagtgacatcgagatgggctcttttcacccccctcccccactgctctgcagcatgtggccttgtagaccccccccacacctgcatagggctgtgcagaccctctgttcctcagcatcctctccccagcctccacctggagcctctgggctcctttctgggtgactccctctattttttgagacggagtcttgctctgtctcccaggctggagtccagtggtgtgatctcagctcactgcagcctccgcctcctgggttcaagtgattctcgtgcctcagcctcccgagcagctgagactacaggctaattaccacactggctaatttttgtatttttagtagagacggggtttcaccatgttggccaggctggtctcaaactcctgagctcaggtgatcctcccacctcagcctcccaaagtgctgggattacaggcgtgagccattgcaccctgcctgggcgactctcctttgcctgcctcttcccttcctgtgccccactcctcagcctcttctcctcacaccatgccttcctctcctcaggcaccaggtgcactgcttagtccctgcccccacccaggtctccattctgagctccagtcacccacacacgcttccccgggcatccccaggctcctcgaatgcgtgtgtccagacataatgctcccccgaccacgctgccccagccggtacgaggctgccccagctgctgtctccctcaggaagggtcgcccacccccagccttcccaagcccctccgtgcccctgtctcacttccagtgctccagtagcctttcttataaacatggcttctttcttgtaaagtaataaatgtttacagtgg

SEQ ID NO: 20408 - DNA, 1150 bp, Homo sapiens
  ENST00000631684
gtccgaggagctggaggtgcagaagccccaggtgaagctgcgccgggctgtgtctgaggtggcccgcccagcctccacaccacccatcatggcctcggccatcaaggacgaggatgacgaggatcgcatcatcgcagagctagaggtgtttgagagaagctcagtgtcttccctcccccccacgccccgccgccagctgatccccaccttgctgtccccccaggacctggggccccccgggggctcagccccaggccctacacggaaggctgccccaggtcccagggccttctgcgtcccaaggatcatcttgacagagtgtgcccccaaccctccctccccgccagaggccagacttgaggaactgggacccaggacagctcccaccccaagacctcagaccctggctgacagcacgaggggctgggatggcccacagtccccaccaggggtagtgggggagacttctgggccgaggagcagcttcatgccccggaaggagggggcagctctgaagagactgggtggaggaggcagcagcctagaggatggaggagccagagtacagtgtcctcagggaccagcccaggatgggactccagagacctctactgctgacacctacccagaggagatcctcaaggactctggacatgatgcccaaacctgcagtagggagcatcagggccaggctgctgccaactcaggccgcaccacgtggggcgccactgcccagcagatggacagcttggaggagacgctccgggagctggaagccaccctgagcaacatgggcacaggccctgccatggggtcccctggcagccccccacccctacccctccgcccccaggtggctgcccgcttttcatcctcctctgctgccttcctcctccatttccagagtcagacagagtagggggcagcagaaatgccaggccagccccctcctcccaccggccttctctcagctcttaccactctcctgggagcctggtgccagagcagggtttgcaggcagagtccgggggaggctgggaagccggcctacccaggggccggccaatccccagccttggcaagaaccagggcctcccgcttctgctctgtatctgtaaaccaacaaataaagttctctccccaccttcca

SEQ ID NO: 20409 - DNA, 453 bp, Homo sapiens
  ENST00000631897
ggcacagagcagtgcgaggaacctctaggatgagctgtatggaaggggcgcctcctgggctggccatgcccttggcactttggcccctcccatccaagccctgcccctttccggctctgggagcccatcctgaggggcccagtggacaaggccttttgcccctggccgaccctctgcatcctgcggcagcatcgggcaacggagccgggcgagcgtgaggttgccctctctgccttcccagtcagcaccccccacttccaggctgccccaggtcccagggccttctgcgtcccaaggatcatcttgacagagtgtgcccccaaccctccctccccgccagaggccagacttgaggaactgggacccaggacagctcccaccccaagacctcagaccctggctgacagcacgaggggctgggatggcccacagtccccaccaggggtagtgggg

SEQ ID NO: 20410 - DNA, 1316 bp, Homo sapiens
  ENST00000613116
cgcccgagtccttcgccgctcactggcctctctccgaaccctttctccccttcccctttcttgagcttccgctccctcgctgaacctccacttcctcaccaaggccttatccctcgcccgtgaccccctcattgagccctccttctccttccctgagtccccatcgccctcctggagccccagtcacccactgagcccctccgtcgtcagtatccctcggggcagttccagttccttcctgccctgcatccctttccctgagtcagcgagagcccttcccccaagtcctctcagctcctccctcctgagccccaacagtctccccggccctgcttggcagatggtcccacctgtcaggagcttggcatcgccgagtccgctcctcaagcaggcccaggggccgtcagctacagaaccaggagtcggtgcgcgcgctgctgaagcgcacggaggcagagctgagcatgcgcgtgtcggaggcggcgcggcggcaggaggacccgctgcagcggcagcgcaccctggtggaagaggaacggctgcgctatctcaacgacgaggagcttattacccagcagctcaatgacctggagaaatcggtggagaagatccagagagacgtgtcccacaaccaccggctggtgcccggccctgagctggaggagaaggcactggtgctgaagcagctcggggagacgctgacagagctcaaggctcacttcccgggcctgcagagcaagatgcgggtggtgctgcgcgtggaggtggaggcggtgaagttcctgaaggaggagccccagcgcctggatgggctcctcaagcgctgccgcggggtcacggacacgctggcccagatccgaaggcaagtggatgagggtgtgtggccaccccccaacaatctcctgagtcagtcccccaagaaggtgacggcagagactgacttcaacaagagcgtggacttcgaaatgccaccccccagccccccgctgaacctgcatgagctgagcgggccagctgaaggagcctctcttacccccaaggggggcaaccccaccaaaggcctggacactcctggcaagagaagcgtggacaaagctgtgtctgttgaggtgctggggccagggattgtgggtggggccatgagccaggttcacacattcttacgaccatccttcctagagtggggagtgccaatcctgtgggtctttttccttgggggaggagggccagtgccctaatggaagcctaagaagcataatgagggtgacattagccctcctagacagaaagcgtattataaagctacaataatcaaa

SEQ ID NO: 20411 - DNA, 1431 bp, Homo sapiens
  ENST00000632117
acgcgtccccatgcagccctggcagtgcctccggcgctttgccctggcctggtgggagaggacggcggagggcagagcccgctctcccagggaggaggctggaccgagggaccctgggggccgaggggagccagatccggagcggagcagcccccccatgctgtctgcggacgatgcggagtacccgcgggagtaccggaccctggggggcgggggcggcgggggcagcgggggccggcgcttctccaacgtggggctggtgcacacgtccgagcggcggcacacggtgatcgcggcccagagtctggaggcgctcagcgggctccagaaggcggacgccgaccgcaagcgtgatgccttcatggaccacctgaagagcaagtacccacagcacgccctggccctgcgaggccagcaggacaggatgcgagagcaggttggcggctggaccgtggaccccgtatgcctcctcagctccctctgctcccacctccatggcgactccgccccctccggggctggccagccggcccagacccgcagctcacgccacactcagggagcccagcccgggctggcagaccaggcggcaaagctgtcctacgcctccgccgagtcgctggagaccatgtcggaggccgagctgcccctgggcttcagcaggatgaaccgcttccgacagagcctgcctctctcccgctcggccagccagaccaagctgcgctccccaggggtgctgttcctgcagttcggggaggagactcggcgcgtgcacatcacgcacgaggtcagcagcctggacacgctgcacgcactcatcgcgcacatgttcccgcagaagctcaccatgggcatgcttaagtcgcccaataccgccatcctcatcaaagacgaggctcgcaacgtcttctacgagctggaggacgtccgggacatccaggaccgcagtattatcaagatctacagaaaggagcccctctacgctgccttccctggctcacatctcaccaacggggacctccggagagagatggtgtacgcatcgcgggagtcctcgcccacgcggcgcctcaacaacctgtcaccagcgccgcacctggcatccggctcgccgccgcccgggctgccgtcggggctgccgtccgggctgcagtccggttcgccgtcgcgttcgcgcctatcgtacgccggggggcgcccgccttcgtacgccggcagcccggtgcaccacgcggccgagaggctgggaggcgccccggccgcccagggcgtcagccccagccccagcgccatcctggagcggcgcgacgtgaagccggacgaggacctggcgagcaaggcgggcggcatggtgctggtgaaaggcgagggcctctatgctgacccctacgggctgctgcacgagggccgtctgagcctggccgcggccgc

SEQ ID NO: 20412 - DNA, 7058 bp, Homo sapiens; identical to SEQ ID NO: 20403
  ENST00000617146

SEQ ID NO: 20413 - DNA, 4644 bp, Homo sapiens; identical to SEQ ID NO: 20404
  ENST00000621492

SEQ ID NO: 20414 - DNA, 4635 bp, Homo sapiens; identical to SEQ ID NO: 20405
  ENST00000622190

SEQ ID NO: 20415 - DNA, 5204 bp, Homo sapiens; identical to SEQ ID NO: 20406
  ENST00000622519

SEQ ID NO: 20416 - DNA, 5225 bp, Homo sapiens; identical to SEQ ID NO: 20407
  ENST00000621763

SEQ ID NO: 20417 - DNA, 1150 bp, Homo sapiens
  ENST00000613927
gtccgaggagctggaggtgcagaagccccaggtgaagctgcgccgggctgtgtctgaggtggcccgcccagcctccacaccacccatcatggcctcggccatcaaggacgaggatgacgaggatcgcatcatcgcagagctagaggtgtttgagagaagctcagtgtcttccctcccccccacgccccgccgccagctgatccccaccttgctgtccccccaggacctggggccccccgggggctcagccccaggccctacacggaaggctgccccaggtcccagggccttctgcgtcccaaggatcatcttgacagagtgtgcccccaaccctccctccccgccagaggccagacttgaggaactgggacccaggacagctcccaccccaagacctcagaccctggctgacagcacgaggggctgggatggcccacagtccccaccaggggtagtgggggagacttctgggccgaggagcagcttcatgccccggaaggagggggcagctctgaagagactgggtggaggaggcagcagcctagaggatggaggagccagagtacagtgtcctcagggaccagcccaggatgggactccagagacctctactgctgacacctacccagaggagatcctcaaggactctggacatgatgcccaaacctgcagtagggagcatcagggccaggctgctgccaactcaggccgcaccacgtggggcgccactgcccagcagatggacagcttggaggagacgctccgggagctggaagccaccctgagcaacatgggcacaggccctgccatggggtcccctggcagccccccacccctacccctccgcccccaggtggctgcccgcttttcatcctcctctgctgccttcctcctccatttccagagtcagacagagtagggggcagcagaaatgccaggccagccccctcctcccaccggccttctctcagctcttaccactctcctgggagcctggtgccagagcagggtttgcaggcagagtccgggggaggctgggaagccggcctacccaggggccggccaatccccagccttggcaagaaccagggcctcccccttctgctctgtatctgtaaaccaacaaataaagttctctccccaccttcca

SEQ ID NO: 20418 - DNA, 453 bp, Homo sapiens; identical to SEQ ID NO: 20409
  ENST00000621275

SEQ ID NO: 20419 - DNA, 1316 bp, Homo sapiens; identical to SEQ ID NO: 20410
  ENST00000612208

SEQ ID NO: 20420 - DNA, 1431 bp, Homo sapiens; identical to SEQ ID NO: 20411
  ENST00000612431

SEQ ID NO: 20421 - DNA, 23331 bp, Homo sapiens
  ENST00000355086
cgggacccttgagcgccggagccgacagctggaggcaggaagggagggttgtggcgcccgagctgggcgcgttcccagcgcctgccctccgccgctggccctgtcccgggcgcccggtgcgggtctcgaacaatggtgcggagcgccggcgcgagccccgcgcccgcccagcggccgtagaggaagtggccgggctcccggcgaggtgggcagggagacgtcccccgccactcgctggctggagtttgcctgcgcgtccggcctctcccccggggatcccctgggattaccgacggagctcaatttcgagagtatggtgccagcgcccgggctaatctagtcctctctactcgctctttttcccctcctcctcctacttctcctctccctcctcccttccctcgggtcggcgctgcctctggattgcctgcgtgtgggagtacaactctgcctctccaaggagaacgggttgtgaccactgaacaaaacttgcccattgaaagcaaacccggaacagctggataatgtccaccccgagccgattcaagaaggacaaagagatcatagccgagtatgaaagtcaagtcaaagaaattcgagctcaactggtagaacaacaaaaatgcctggagcagcaaacggagatgcgagttcagcttctccaggatctgcaagatttcttccgaaaaaaagctgaaattgagacggaatattcccggaatctagagaagttagcagaaaggttcatggcaaaaacaagaagcactaaggatcatcaacaatacaagaaagaccagaacctgttgtctccagtgaactgctggtatttgctcctgaaccaagtaaggagagaaagcaaagaccatgcaaccttgagtgacatctatctgaacaatgtgattatgcggttcatgcagataagtgaggattctaccaggatgtttaaaaagagcaaagagattgcattccaacttcatgaggatttaatgaaggttcttaatgagctttatacggtgatgaaaacataccatatgtatcatgcagagagcatcagtgcagagagcaagctgaaagaggccgaaaaacaagaggaaaagcaaattgggagatctggtgatccagtcttccatattcgactagaggagagacatcaacggcgaagctctgtaaagaaaattgaaaaaatgaaagaaaaaagacaagcaaaatattcagaaaataagctaaaatcaattaaggcacggaacgaatatctcctaacacttgaagccaccaatgcctcagttttcaagtactatattcatgatctttctgatttaattgattgctgtgatcttggctaccatgcaagtctgaacagagccctaagaacatatctgtctgcggagtacaaccttgaaacctccagacatgagggcttagacattattgagaatgcagttgataatttagagcccaggagcgataagcagagattcatggagatgtaccctgctgcgttctgtccaccaatgaagtttgagtttcagtctcacatgggtgatgaggtgtgccaggtcagtgcccagcagccagtccaggcagagctcatgctcaggtaccaacagttgcagtcccgccttgccacgctcaaaatcgagaatgaagaggttaagaaaacgactgaagccaccttgcagacgatacaagatatggtcaccatcgaggactatgatgtttctgaatgcttccagcacagtcgttccacagaatcagtgaagtccactgtctctgaaacctacctgagtaaacccagcatcgccaagagaagagccaaccagcaggaaactgaacagttctacttcatgaaactcagagaatatttggaaggcagtaatctcatcacaaaacttcaagccaaacatgacttgctgcagaggaccctgggagaaggtcatagagctgaatatatgactacaaggcctccaaatgttccccctaagccccagaaacacaggaagtccaggccccgctcacagtataatactaagttgtttaatggggatttggaaacattcgtcaaggactcaggacaggttattcccctcattgtggaaagctgtattcggttcatcaatctctatggtcttcagcatcaggggattttcagagtgtctggttcccaggtggaagtcaatgatattaaaaattcatttgagagaggtgaaaatcctttggctgatgaccagagtaaccatgatattaactcagttgctggcgttctgaagctctatttccgtgggctggaaaaccccctctttcctaaggaaagatttaacgatctgatttcttgtatcagaatagataatctctatgagagggcgcttcacatccgcaaactcctcctgactttgcccaggtcggtccttatagtgatgaggtacctctttgccttcctcaatcatctatcacagtacagcgatgagaatatgatggacccttataacctggccatttgctttggcccaacattgatgcctgtcccagaaatacaggatcaagtgtcttgccaggcacatgtgaatgaaattatcaaaaccatcatcatccaccatgagactattttcccagatgctaaagagctggatggccctgtttatgagaaatgtatggctggagatgactattgcgacagcccatacagtgagcacggtacattggaggaagtggaccaagatgctggtacagagccccacacaagtgaagatgaatgtgagccaatagaagcaatagccaagtttgactatgttgggcggtctgccagagaactatccttcaagaagggtgcctccctgctgctgtatcaccgtgcatctgaggactggtgggaaggcaggcacaacgggattgacgggctggtgcctcaccagtatatagtggtgcaggatatggatgatacgttttcagacactctgagccaaaaagccgacagtgaggccagcagtgggccagtcacggaagacaagtcctcatccaaggacatgaactccccgacagaccgtcatcctgacggctatttagccaggcaacgaaaaagaggagagccaccccctccagtaaggcgtcctggcaggaccagtgatggccattgcccgctccaccctccacatgccctttctaactcctcagttgacctagggtccccaagccttgccagtcacccccggggcctgctgcagaaccgtggcctcaacaatgacagtcctgagcggaggcgcaggcctggccatggcagcctgaccaacatcagccggcacgactccctcaagaagatcgacagccctcccattagaaggtccacgtcatcagggcaatacacgggcttcaatgaccacaagccactggacccagagacaattgctcaggatattgaagaaacgatgaacacagctttgaatgaactccgagaactggagagacagagcacagcaaagcatgcccctgatgtggtgctggataccctggagcaagtgaaaaactctcccacccctgccacttccacggaatctctcagccctttgcacaacgttgccctcaggagctccgagcctcagattcgacgtagcacgagctcctccagtgacacaatgagtactttcaagcctatggtggcacccagaatgggcgtgcagctgaagcctccagcccttaggccaaaacctgctgttcttccaaaaacaaatcctaccataggacctgccccacctccccagggtccaacagacaagtcatgcacaatgtaaaaaccagccaagcaaggccataaagggaggtgacttaaaaaagaaaatggattagtgacaaaagtcactgatccataactttccttagttttgtgcttataactggagatcttttggcttttctatgttgtcgaatgtaatgtctgagactagctaaattaacacgggcatttgtattttgtaatttttttaaataactggacatatgtcattttaaggacaatagaaacacttagacttacttgaaaatccaatgctgcaccacttgtaatgaaggcaacaccgctctccacattgtacagagcttcaggtttaatgtagcccagctgagtcagaaaggttgtgacctgaaggcagaagaacccgaatgccacacctcattggagtatagccagtgttggtctgtggcacttgggctgaaaggtgataatggcattgcgtggtagctgacaatgagcaccttcggttccatgtggagcggggtttagctcatgcaaaagacttgcaattgtctccatgggacgatcccagtgggactgtcagcccacagctcgagtgggttggatgcttgcctctttcctaacagttatttccccgggtccagcttaaagactcgatggaaggaggtagaacctctgctgttactgcttgaacttaacctgggaaaggagaggaagacaccatctccaaagctattaatgtcactccttttgcgagcatgattaggccccggagatttccaagtccccccatctacacttacaaacgattagaagggtttaattttaaagactttctggttacactactccacgaactcctccaaagatccgttattcaataactgcctagaaaatgtttccatctcctctaaatccctgtgttctcctctgtggaaatgaaggcagcaagaagcacctgaggccttggttcatgcagtgttctcttttgactaaatcacctaggttcctttaaacatgctacaaagcccaggcatggtggtgcacacctgtactcccagctactcgggtggtttacacaggaggatggctttgggcctagtagttcgagtccagcctgggcagcatagtgtgagaccctgtctcttaaaaaaaaaaaaaatgctacaaagtcctgatgatcctaaatttgaaatcccaactgtcctctccatttgtctttgagccaaccctgaactggccctggtacctgagtaagagccatgcagggccatcagcagaacatggccttgtggttctcacccagttgtgtacctcacaaccacaacttctttttctttgtcccttttcccctttttggttttggttttgtatgtgggctctatgtaactcccatagtcagctgaactctcaattggagaccctctttctctggcatcctagcacacaggcaattttttaagcctatatttatgctacattttcccccatcttaagaaaatttgctttgatttccattctcctactagcagcagctgatatcacctgtagacctatgagcattttatctattctatcattgaagttactgataaagatttttgttgttgttgttgttgttgggagaaatggatttcccacaactaatccctctggcccaccattaatttccttcttggtttcatttcaaactggcagccaattgcacgcccatctaagagctacacagtgtagattttacttcatcagcccattggtgaatgcatcgtgcagaaaagaactgggatctgtactaaaatcaagatcattactttgatctctacctcagtttgccagtgtagtcattctattgcaggaagagattaaattgatgagatattgttactttcagagtcacactgctgattgcttgcctggggcctaatttcacaaatgaatagtgacttttttcccatgtatttctaggtatggtaaacttttaaacctccaaattttcagagccatactttttgcccattttgaaaaagaagcccaggacagcaccttgtctagcccctccccatttctcctgagcttttggggtccttcagcacccttggacaccgtggagatccagccaagactgagctttgaatagcactagcccttttaaacaatcctcacaaattccttaggaatttaaactttccaaaataatcccccacttttttttttttttttttttttttttgagttggagtcttgctctgtcgcccaggccagagtacagtggtgcaatctcggctccctgcaacctccatctcccgggttcaagcaattctcctgagtagctgggattacaggcgccaccaccacgcccagctaatttttgtatttttagtagagatggggtgtcaccatgttggccaggctggtctcaaactcctgacctcaggtgacccaccagcctcagcctcccaaagtgctgggattacagatgtgagccaccatgcccggccattccaccacttctttaaaatagtaagaattcttaaaaaccatattccttgtttgatggaagagtaagatgttaacagagggcatcaaagggccagaggtgtctttgaatttattttttttcaatgtcttttctgagcttcagccttagcttttcagatcttcctcctacctgttcatttattcagccttctatctggtcatcctccccagcggctcctctctctgatgtgtccacctacggtggaacgaggattgcctttctgtgctccccatcaggactttgctgtcttggccggcaggagtcgtgctgctgcagagcctcacaggctgtgccttgtttcaggaaacagctcctaatactctcccatcactcactttacctgtctccatcttatttccctatactcctattgtcagcttgagactttttttttttttcaattccaaatgaagggtatgacctcagagtgagtgaggactcagtaaagactcacctctccttacttggtttattaaatgtcttcagattccagagataagacaaggtggccacttcacaaagaatccagaatcatgctcagtaaagctcattaaaagccactgcagctgagaaggttcacagcccttctttatagccacagaggcagcacacaggggaggtgggaagacacagggaaacgagagaagaaggataatgaggccttgaggtgttctgcccccaatttcaaggagcttatcaggcttcatgtgcaatttggggaggggagctttttgatggtgggtaaataatggctctacaaagattacctgactccactgacacaagaatatgtattctcagctgatataactgtgtgttcacatcccatccatagaactcactgaaggagattcatcaagtcagccttttggactgggttggggtttggggagtggatttggggatagagagaaaggtgtacttagtacacattttctaatgggcgttacgtgaactgtttgaacctgctgagtggcgctttgtagagctccatgttcacgttcagtgtcaacaccattcaacagctttgcacatcttcgtacaacataatctggctttggtgccccttgagccacctgtagaataatttatagcagggtcccacaatctactgcaatgatcgtgaacagttatcagtggatatagtgctccaagagtcaaattgtatccgttaagggttttctaacttttgctatcccccccgcgaccaaaaaaagggggggtttataatttaaagaaaaggaaaagaggcgtgggttggtagttgtgtccttaacatttaggaatgacatagcctctggagtctacaaactgaagaaactttcatctgatcagccttggaaatccaaagttaaagagcctatgtgtctcttgaggcgggggttagaggattcaaatttgggatgatgctcattgattcctgaccatagcagtgagaggccattttttgtgcaggaaatgtgcttaggactcagtcttgttttcgattatccaccacagaaaccctgagacacagagcagcttagaagtctctacccaggcgtaaatagagctccctactccagaccacctgccacccacctcccaagttgagaacacaagctccagctgggctggagagtcaggcttggtgcagggtgactttggcgaagttttgtcagatccataaagcaaactggaatttgagctttcacttaccctagtatacgttcttaaaaaaaaaaaaaagtctatgtggtataatcgagatggatacctgtgtctttaaattacgtagggaattttgtatgtttaaataattgtactgggttccataatgcttatcttagaaactttagtaaaagaaaatatatgaaccgtgcatttgtgaatgccccccttagagcattcatccaagttcagtgtgtagtgtgatggttattatagatatttaaagtatagtaagtggctgtgtaacaggagagactgctgtttacctacgtactgaagggtaactgctgcccgcgtaattaaatcagtattgtcctttcctgtcggtttgatcaattgcggtaccggtagcttcctgcttgtgactgttacctaattgtgtcaatgtacatctgtagtatgtacatgtgaaagtgcctttctattttagaggagttttagccttgctcttgtaccgttgccccgctctgtgccccacccccacctcctcctcccaattcctgctgcccactcgagtgtttcgaagcttcctccctgtcccccaccttccccatccccgccttcctgtgcctcggtgctcagtaatgtcccatctcacctccctgtcggtcctcagactgtctcgttttccttgtagacgtgattgtgcctttctcacccctgtgtcctcccatcccaccgcatcagtcccccgctcatgtgctgctgacagcatcgcattcgcccgtgctctgtactgcctctcaccatttcattccctcctctctgaggtgaaaataaagggggatgcttttacagtctggaaagaaaaaaaatgttttgttaatctgttgtgacaatgcacttttatgtatagtactgtacatttttggcatgtaccattacaggcttcagtatacagtcaggtttgttcttcacggtgtatctttataataaataagatagttctggctgcctttgtctgcttccagtttgatgtgcatctctgtggtgtctttgttcctttcctttcattcatcactactttctccttgacagctagcttgcattaaataatgtgaaacttttacctttaaaatatttttttatctcactttcatttcttgttcatttggaaatagggtgtcctgcacagggccctgcccatgaagctgtggtttttcagtcatggtttggaggctcaatgtgtagtcagagaaaagagtcttggcagacacttaactgagaagctgagagtgtacaagcctcctaaacatacaccagattgaaatctttcttttgagaaagactctagttaaccacggcaagcccatctttggtttcatttgaataaattgaaaaataatccttaggttatttttctgtgcttagaactccccgtgtattggtatttttctttacttttttttttttttttttgagacgaatctctctgtgtcacccaggctgtagtgcagtggtgcaatctcagctcactgcaacctccccctcctggattcaagcgattctcctgcctcagcctcctaagtagctgtaattacaggcacccgccaccacacccagctacttttcgtatttttagtggaaacggggtttcaccatgttggccaggctggtctcaaactcctgacctaaagtgatctatctacctgcctcagcctcccaagtgctgggattacaggtgtgagccattgcatctggccaggtatttttctttaaatataaaaaaaagataacttgaggtctagcaatatgtagtagatagctttgtaaaacaatgtaagttgtgcaagattgaatattgataagatataaagtttaaaaaatgacaggcaaatcaaggaaaaacactttttattaaagtgcagaatactaacaaaagtgtgcaaatcattagtgtaacagttctcacgagctgacacactgatgtatccaccacccagtttaagcaatagcacattatcagcatcccagaagctactgtgctcatgcctctgtgaatgtatcagtatcctgactaatcacaccatggtgtagttttgcctgtcatcttagctttctataaatgggttcatacagtatgtagattttgtgtctggctccttttgttgaaatgtatgtttgtaagagtcgtcattgttagtaaaatagtggtttttccatttttactgctatatagaattccattacatgaatatgctcaatattatatttattttagtatttcctgattaaactttgggtagtatatgcagatatctttaaacatggagaaatgaatggggggtgagggacccacctgtcaaaggaattgttttcccaaactatgacggaataatgttgaactaacctgttgaccggaaggcctactcaaaggcaaggatacttttctttctttccaaaaaagcactgtctgatatggagactggaaatattcatagatgacactgaaactagttgaagctttacttgatgcttatcaagtcatgttctcttacccgatgctggatgctttttcttcaatgcctactttaggaccacagagttggatttagaggctagcccaccaggaacaaatgcccaaatcagtctgtagagttgttccaggaaagactccaccatcctgctaccctcaaatcttaagctcctcagcctgccacgaccatctcctgttgagaaaattgcgcctgcctccccatctctcactcccgaaccagagtcccaacggggtgtaactggtcgtcagttcccacagttcatatgcctgcaccctgtaagaatcttagaaaggcagagcaagggtgtttgctggcttctgccttgagtagttgggactcctaaaaaggaaaattccccaagtttgacctagaatgtcaaaaaggtcctaaaagcacagaatgatggtaaattctatccacaggccatatagccctggaaaatattgggaaactgaggcatgggttggtaatttattgaagtttagtaaacgaatttgaattaattaggaccagataatcaatttttggcttacttatactatagtataagcaaataagtatttaaactttagtataaatatttttgctcacttaataatcacggtgaggttcatcacctcttcagtagccttttatctgtttctacatagtaaatagaaaacttgccttctataataaaaacaaaatagtttttctatcaaggtcagtctcagcaagagaaatgggactgggctggatatcaacacatgtgcttgtgtgcatgtgcacgtgtgtgggtgggagggtgcggaggggttgggaagagagattgctcctcccgcagtgctgaaacaacatgccttgttcagtattaacatcttgaaggcagttatggcagcatgatccaggagatcgtcagctctaggatatttgcgatccaattctggcgacttatggatggatccttcacacccaacagctgtctatcaggggtgcttccgagggtcactgggtttcttttagctgcttggctgtgcagctgaagttaggacttttgatgaattaccctctcaatgatggtgtattgttctaatcttctgtctctgacatacccaaggaaccccttgtgtaaaaatcatgtccctctaaatgcaagtggatgattgtgccaataagccaggagagaaggaaacatcttcagtggtccagtggcacattcaaaattgtacaatgacatgacattaactcaaaaatgaagtttgaggttctgggcctttgatggactgcatctattaaaaacaaaaagtggtgtctcatgcctgtaatcccagcactttgagaggccaaggcaggaggatcaaaaaatgcgaatttttatatttttttgtgagatcccatctctaccaaaaaaaaaaaaaatacaaaaattagccagacatagtagtacatgcctatagtactaggtacttgggaggctgaggcaggaagattgcttgagcccagatgtttgaggctgcaataagctatgattgcaccactgcactccaacctgggtggaagagtgagaagctatctcaaaaaaaaaaaaaaaaaaaaaaaaaacatggtcaagatttgtaatagaaattgccatttgaattttggtctgtaagcccaaagattgttactgtgttagtaactaaatattacgagatgcattaggaaaagaaggaaaagaaattttaagtaagccaaaaatctattatatagtcataagtcaaactcagttactagacttcaacaaataccaacccatgcctccatttcccaaacagaaataataatatgaacatcttagtatattgtcttctaatccttacattatgttatttttaagcagagtcaaactcatattctgtatataattgtatatacattgggtttttctcccttatagcaattcacactaggagtctcagtcaacatgattttttaatggctgtataatattctagcgtatgaacacatcattatttaaccattttcctgtcactgagtgagcctgtttgaaggttttgtttttttttcaattgaatgttatgttgtggtgagcagctctgtatataataattaattgtctgtgtttggatcataaagttagcattgactccaaaaagtgaaatcactgggtcagaggatgcaattatctgtaaggctcatgacaaatattgccgacctgttttccagcaaagttgtacaaatttacatccctgccagtaatgcataacagtacacgagtataaaacatggtcatgtttctttaccagtgtactaggtgagtgataggctcaatgcaaattcttagcagtttgttaatgtgcacacccacatttccagagtacaaatctctatttcactcacctctgtgtcctaaacttcagatgactctttattgtttcagctaaacatcagcaaacagagattttcctcaggcaccttaagctcaacagacccaaaaattaaacccactttgtttcattccaaaaaatattctgcagcccctctacatcctccaatctgttccgctgcctatctctgctctaagctaattctgtgcaccattccccttgccacaacgattgccgtagcttccacggtggtgtggctgtgcccactgtctcctccttgaaatgattatctacactgctgccaataaatcatctttctcaaaaacaaaatgagaaacctaacaaacaatcattgaaaatgtaccatgtactgacatcgttttcctcaacacgttgcatgtcaatagccaacatgtattgagtaccagactccatgctacaaatgttaaccctcataagaaagccaagagagccacagttattatcatcatctttatccgtaagaaaattaagccgcaggagttaaacacttgccctggtcacacagctagatagtgacagagcaggatttgattccacgccatctggtgctggaggctatgctcataaccactgctgcattctgacctctgtaacatgctcatgtcattaccctgctcaaaagccacacgtgggtccccactgctgcaggacggcatactactgtgtcttattcatctttgtatcttcaagcctaatgcatcactaactaaatagcaaatcggcggaactgaaatgaattcaatgtctgccgctttgacctcagcctgccatttcagccttcctgctcaccacctcctcttcggaacctttagtttcagccatagcaagctacctttctttgaaaatgtgatgctgtgtgctccctccgcatatacttcatgtcattcctcagcctaaaatgtcccctacttcatcctgacaactgcctgttgaaattatattcatcattccaaacccaacaaaatggttacatccttcatgaagggttccccaaacctcccagctggcattaattgttctgttacattttgttttcattaaatcaggctcccttccggggatctagctgtgaatgagacacacagggctcctggtctcatggagtgtacttcctggtatgatttaaaaaaaaaaaaaaaaaaaaaaaaaccactacataagccaacagctaaaccggcaaaataatttcaggtgttgataactgctacaaaaagcaaaagtgaaataaacagggtgatagaatttagagtgtctaggagaagcattttagatgggacagcttgaatgccaccttggatgtggtagcatttgagctaagacctgaataatgagaaggaaccagccatgtgaaaaggaagagaaagacccaagcagaaggaactgcacatgggaaaacaggaccatgctcacgtggttaaagagtcaaacacattcactgtgactgtaccaccataagcaagaagccctggagatgaaaataaaggccagaatgtggacagagatcagattttggaggccaaagtaaggtacttaaaattagccgggcttggtggtgcacaactgtaatcccacctactcgggaggctgaagcaggggaattgcttgaacccatgagacggaggttgcagtgacccgagattgtgccactgcactacagcctgggcggcacagtgagactccatctcaaaaaaaaaaaaaaaagtaaggtacttagatgtcattctaagttcaaggaaagccattggaagtttccaaaaaggaacatgacagcatctatatttttagaagatgaccctcaaaaccacaatgagatatcacctcatacccattaggatggccactctcaaatgatcaaactccagaaaataacaagtattggccagggtgtagagaaactgacacccttgtgcactgttggtgggaatgtaaaatggtagagccactaaggaaaacagtgtggaagttcctcaaaaaattaaaaataaaaccctcatatgatccaccaagcccacttctgggtacatatccaaaagaattgaaaacagaagagatatttgcacactcatgttcacgcagcttaattcacaatagccacaagagagaagcaacccatgaatggatgaatgggtaaagaaaatgtgccatacacataaaatagaatattatgcagccttaaaaaagaaggaattcctgtcatatgccacaatatggatgaaacttaaggatactaagctaagtgaaatgagccaatcaataaaggacaaacattgcatgattttacttctatgagatatctaaagtagtcaaactcttataaacagaaagcagaatggtgattgccagggatcgggatgaggaagaaaatggaaattgttgttcagtgtttacagggtttcagttttgcaagataaaaagttctaaagatctgttgtccaacaatatgcatgcagataacatcatattaaacatggttaagatagtaaattttatactatgtaattttttaaccacaattttaaacatcactgtagatgttgtagttgtgtttggggtccacgggtggggaggagcttgggaaggaatggcatgagggaagtgagagaccacaattaaggagcaacacaggagatgagggtggcttggactagatagccaggtagaaggagaggaagggatgaaccgggggttcgtttcagagtcaaaatcaagatttgctaataaattaaatatgggaataaagaaagaaaagaatcaagagtggctcctagtatttgtttgagcaaatgggtggaatatattgatatatacttaaaaagaatgactggggaaaggaagaagttggccaggatgtacaaccaagtattcacgtttgaatttatttaatttaagataggtattagacttccaagtggagaagtctaggaggcagatggacttgaagctcaggggaggatttctggccagaaggtgtaaatttgatatttaaagctatgggactcccggaaagagaaagagaaaggaaggtacagagcacataaccaagccctgggaagcccagcttgggagagcttgggtggagtgaggagctggcagaggagacagaaggagcagccagggcggaggaggaaaaccaggaggagcatgtaatgtgatcagtacccagggaagaaatgattgccatttctagtgtgcatttgttaacataaatatgataataaaaatagttaacatttgttaaatatatatatttttttctttttctttttcttttttttgagacagagtctcactctgtcacccaggctggagtgcagtggcatgatcttggctcaccgcaacctctgcctcccaggctcaagtgatcctcccacctcagcctcccaagtacgagggattacaggtgcatgcaaccatgcccagctagtttttgtatttttttgtagagacggggtttcaccatgttgcttgttaaggccgggcacggtggctcacgcctgtaatgccagcactttgggaggccgagacaggcggatcacctgaggtcaggagtttgagaccagcctggccaacatggcgaaaccccatctctactaaaaatacaaaaaaattagccgggtgtggtggcgcccgcctatagtcccagctgttcgggaggctgaggcaggagaattgcttgaaccagggaggtggaggttgcagtgagccaaggtcacgccacggcactccagcttgggtgatagagtgggactccgtctcaaaataaataaataaataaatatattaaaaaataaacaagttcaggcttgttaaatattttttatgtttgtttgtttgctttgttttttttgagacgtagtcccgctccgtctcccaggctggagtgcagtggcgcgacctcggctcaccacgacctcggctcaccgcaacctctgcctcccggtttcaagcgattctcctgcctcagcctccagagcagctgggactacaagtgcgcacaaccacacccagctaatttttttgtatttttagtacagccggggtttcgccatgttggccaggctggtcttgaactcctgacctcaggtgatccacccgcctcggtctcccaaactgttggcattacaggcatgagccaccacgcctggctgagttaaatattttctatgtgccaagcactgtgctaactgctttcatattatcggatttagtcctgtaagaccggaatcattattatccccatttttcagattaaaacaaacaaacaaaagctgaggtttaaagaaattatctcttgtaaaatcacacagctaacaattgagccagtatctggacctagatctattgcctacagagccgcacgtttaactactgttatcttgcctccttattgctccacacacttgaaatataaatttttaaagacattttattcttttttgtcttcatcagaatttattgaatcctgattattttttccttaatgttgattttgtagactcatttgcaggaagaacaatgtcaggtggagagaaggaattgaatgaatatttttaataaatttgtagatgttaatatgatttacttatttgcaattttcatagctatatgatattctatcccatttccagtgtttttgctcttttagtagcaaatactctgaatctctgcatatgttactcattttctatcatcctattccttgtgatggatacccaagggtactcatctacaggatgaaagggtatgagcacgtttctaggtgccctgaccccaagattaggggttttgttagaggcaaagctaaaaggaaatgataaaataaatgaatatttatagaagttaaatctattaatctagccttattacaccgagtacaacagggaataataagccatctatctgaacgtgcacggttagggcctcaaggaaagtgggctcagcaatgagtgttggtacacatggaaaatcacatttgccatgttttctatggctttgggctgctgctgcatcactgcagtttaataggaggaggctggtgaaaatgttaccaactgccaggggtcaatggcgaaagaacacatttctctaggaaagattaccttctctgaagaagtgatagggggaataaggcataaaattatctgacctgagagaccttaacagctaggcctgcactgctcatgctttgggaccagaaagcggatggtttgatatggtagctgcacttctaaaaaaaaaagggggcattcttggcaggagaaagggtgttacatggaaagatcagcgatagtacacacgccttcccatagagtgaggtggctttcccacccctcaacactccttcagacccccactgtaacaaagggatgtgtctacctctaaattcatcatttactgaacaaataactcatgagggttaccatatgtctgacactgtaggaagagctgaagcagggcctaaaacactatagtgcaagtatctgtttacacatctgtatgagagtaattgatgctagctgctgtaacaaacaaccccccaaactcagtaacacaatcaagctgtatttctccttcacatcatagcctggtgtgggtcaggtaggtgactcagggttctaggctccttccatttttttgtcgctgccacactggaaatgggatagaatatcgtatagctatgagaattgcaaataagtaaattatattaacatgtacaaatttattaaaaatactctttcaattccttctctctgcctgacattgttcttcctggaaatgagtctacaaaatcaacattaaggaaaaaatgatcaggattcaataaattctggatagaaaaaagaataaaatgtctttaaaaatttatatttcaagtgtgtgggggcaataaagaggccagataatagtagttaaatgtggggctctgtaggcaatagatctaggtcagatactggctcaattgttagctgtgtgatttcacaagagataactgatgctagctgctgtaacaaacaaccccccaaactcagtaacacaatcaagctgaatttctccttcacatcacaacttggtgtggatcgggcaggtgactcagggttctgggctccttccattttttttgttgctgccaccttagtacgtggccaccatgaagaggaagagaaagcacttgcaatgatgtgaggttttctgtcttggtatggaggagacatgaatcactactgtacatgtccaagtcacatggcaagggaggccaggaaatgtcatcttcctataatgcaagaaaaagaacccagggccgggcacagtggctcacgcctataatccccacaatttgggaggctgaggcaagaggattgcttgagcccagagcaattaaacactgcctggtgcatagttagtgctcaagaattgtgctataatcaatgttactaaattatctaggattagatgtttctaaattaaaactatttcctgctttgtatttgtcctttattccaaaaacttaaaaatttctcatttctggtttgtcagggatgaaatactaaagcaacttcatggattgtgatttcaagtatatgaaaagtttaagacccaattgcttttgaaggagattcatctagaaaaaccagggattcaaacccaacacatcgggtgctaaagtctaccctcttagttgacatagaattaaattaaaatcagtattgattggattatgctttgataaaaatgtaacttcatttaagtctagtaaataattaggattatgaggtcaggagtttgagaccagcctggccaatatggtgaaaccccgtctctactaatgatacgaaaattagccgggcatggtggcgtgcacctgtagtcccagctactcgggaggctgaggcagaagtatcacttgaacccgggaggtggacgttgcagtgagccaagatcgcaccactgcactccagcctgggtgacagggtgagactccatcttaagaagaaaaaaaaagcaattacttttgcaccaacctaataaaaatgaaaaatcccaatgaaaatgcatgaatatcatgtgccttgacaacttacggagcatttggaacatgtcaaacagtaatcagaggtcaggttgaggaaaaaatgataagaaccctctctgccccaccattcacatcattcagtggatctatgtactaaatctagccagtgggttgtgagcaaaaatgatctgtgtcacttgtgggttaaaatataaaagagtgctaggcacactggctcgcacctgtaatcccagcactttgggaggctaagtgggaggatcgcttgagcctaggagttcaagaccagcctgggcaacatagcaagaccccatccctacaaaacagttttttaaaaaactagctgtagggcaggcacggtggttcacacctgtaatcccagaactttagaaggccgaggtgggtggatcacttgaggtcaggagttcaggaccaacctgaccaacatggtgaaaccccatctctactaaaaatacaaaattagccaggcgtggtggcgcatgcctgtaatcccagctactcaggaggctgaggcaggagacttgctttaacccaggaagcggaggttgcagtgagccaagattgcaccattgcactccaacctgggcaacaaaagtgaaactccatctcaacaaacaaacaaacaaacaaacagtagctggttgtggtggtgtgtgactgtgatcccagctacttgggaggctgaagtgaaaggatcgcttgagcctgggaggtagacgctgcagtgagctgagatcatacctctgcacttcagcctgggtgacagagtgagatcctgtctcaaaaaataataacaataacgtatgagagaggattcaagctttccaagcagtctcttcccctgccatggcactcatagaagcctcccgttaagatggcagagctgtaatgctagaaaagcacagactgttaagtcactgcatggaggatggtcatcctggagaattgtttggactcgagtggactctacaacagcaggaaataaactactgttatatcaagctactgacattgagaattaggttgcatagttatgccacagcataatgtagcctttcctgatgcatacaattacttttcctttcttttttcttttccctggagttcataattacctttgtttcatttgcttagctttctatttacataaataggtaaaaattccttctcaaaaatcttttacagaagtgttctcaaactcaatgcattgaaacatgctatagtttataaatcttggatccatcacttaaagaggcatttgacctgtttcagtatggataagttgttctctaagtctactgcatagctgagagcctaagatctctggggactcactccacttttctcttgagttggttccactatttcctggaacctcatacagccatctcagctagtcatgactgacctagatttaacacagtatatccttaatcagcttcctgattgagagtgtattttgagacattccatgtctagaaagtgtctttatctcacatgtaattgtgatagtctggctgagtataaaatcttacttaggatgttaacttaaaatcaatgtggtcaaggaaaggaggaaaaatatgtcctcctagtaattcccagtgtaagtggaaatgacccagccctagatttacttggctttagtttccatcaccatagatttctcaatcaaaaggcaaatatatctcatatgtcggaagattaatgtatgaataatcagtaccactggcatatggctactctcctattttccttacccctttgtcttcacaaggaagcccagactctgtttgccagtggctgggtcctggggccgataacttcaagctaaacattcaatatcagtatggtaggtgaggaagattttctcagagtggctcattatctggaaagtgtaagaatgaggtggcagaaagaggtagaaacagcatgaaaaggcagagccaaggagagatcgacaaacaagaaggattgtgcccatatttctctattctctctagcattatgaatcatttcccctcaggattttggagatgttgcatcagtgttgctaccgaacattccaaagccattctaattctgttactttgtatgttcttttttttccctatacataatttactattgcatgtttttctcagggtttctgaaatttcagaatatcctgatgtggatctattttgattcattgtactgaagaccatttcagcccatcttacactttgattctggaaagtcttcttttccctggagcttataattacttttatttcatttgcttagctttctatgtacataagtagataaaaattaattcattctcaaaatcttccacagaaatgctttcaaactcaatgcattaaaaacatgctatagtttataaaccttcttggatctatcaaggaagatttatttgattattttatctcctccattccatctgttttcttataattcctaatatttggaggttggacctcatgaactgatcctataattttactaattttcctccagtttttcatctatttgactttttgctctattttcagggaaatatcctcaactttatctgctaactcttctgttaagtactttatttctgctctcatgcttttaatttccaaaagctctttttgtgagctggctgttcatttttttatagaatcctgtccttatttgacaggtcctatatatttttttattttgagattattagtgatagttcttctaagttttcttctctctgcacactgtatttcctctaagttgcttttttaaatttttgacctgtgtttgctttgctttcgtttatgttacaggctttcctaaaattcctggtgatccttggctatctgctcgaatttaaaaacaagcactaaagaagggcactaaaaaacagattgtcatagcagtattatccataatagccaaatgatagaagcaatgcaaatgtccatcaacagagggacaaatgaataagcaaatgtggtatattgatacaatggaatactattctgtaatgaagatgggaaagaacggagtactgatacacgctacaacatgggtaaactgaaaacattattacgtgaaataagccagtcataaaccacatattgtgtatattttatccataagaaatgttcagaataggcaaatctataaaaatacaaagtagatttgtagttgctgagggctgggaaaagggtttggggagagaaatgactgctaatgggagtatgggatgttcttttggggctgataaaatgttccaaaattcattgtgtgataactacacatctgtaaatatactaaaaaccactgaattgtatccaataaagtactaaattgtatgatatatg

SEQ ID NO: 20422 - DNA, 2976 bp, Homo sapiens
  ENST00000537556
ggaacagctggataatgtccaccccgagccgattcaagaaggacaaagagatcatagccgagtatgaaagtcaagtcaaagaaattcgagctcaactggtagaacaacaaaaatgcctggagcagcaaacggagatgcgagttcagcttctccaggatctgcaagatttcttccgaaaaaaagctgaaattgagacggaatattcccggaatctagagaagttagcagaaaggttcatggcaaaaacaagaagcactaaggatcatcaacaatacaagaaagaccagaacctgttgtctccagtgaactgctggtatttgctcctgaaccaagtaaggagagaaagcaaagaccatgcaaccttgagtgacatctatctgaacaatgtgattatgcggttcatgcagataagtgaggattctaccaggatgtttaaaaagagcaaagagattgcattccaacttcatgaggatttaatgaaggttcttaatgagctttatacggtgatgaaaacataccatatgtatcatgcagagagcatcagtgcagagagcaagctgaaagaggccgaaaaacaagaggaaaagcaaattgggagatctggtgatccagtcttccatattcgactagaggagagacatcaacggcgaagctctgtaaagaaaattgaaaaaatgaaagaaaaaagacaagcaaaatattcagaaaataagctaaaatcaattaaggcacggaacgaatatctcctaacacttgaagccaccaatgcctcagttttcaagtactatattcatgatctttctgatttaattgattgctgtgatcttggctaccatgcaagtctgaacagagccctaagaacatatctgtctgcggagtacaaccttgaaacctccagacatgagggcttagacattattgagaatgcagttgataatttagagcccaggagcgataagcagagattcatggagatgtaccctgctgcgttctgtccaccaatgaagtttgagtttcagtctcacatgggtgatgaggtgtgccaggtcagtgcccagcagccagtccaggcagagctcatgctcaggtaccaacagttgcagtcccgccttgccacgctcaaaatcgagaatgaagaggttaagaaaacgactgaagccaccttgcagacgatacaagatatggtcaccatcgaggactatgatgtttctgaatgcttccagcacagtcgttccacagaatcagtgaagtccactgtctctgaaacctacctgagtaaacccagcatcgccaagagaagagccaaccagcaggaaactgaacagttctacttcatgaaactcagagaatatttggaaggcagtaatctcatcacaaaacttcaagccaaacatgacttgctgcagaggaccctgggagaaggtgagttatccaaaatgtatgggaagatgacctggatgatacatcgtatcatgtatatattccagaaagagtatgaattgtatatttgtgctttaagaagcagaggacactctgtgtttagatttggttttgtttgtatatgtcatgattaagttctcctggcacgattttcttctaaagcatggtgctaaccttgaggaagcgtagtgaaatctagggagggctggaaagtcaataccgagctcctagggagggatcttcagagtgtggtgctcctgatcgtagaaaagtctggaaacactgcccctcccctacctgctgaccccccagtctcttcttccttcccttctcagacttctgcacccttccaaccccacccctgtttgttttaatgggcgagtatttgttgttccatctgttgcctgtttagactctggaaaccagttaaaccagtttgggtgatttttttctttcagcaggcattggctgtagttgagaaacaatcttaaagtataagtagattgctatgtctaataatagtaacaaaacaacagcaacagctaacacttgaaaggctttctctgtgccaggctttgttctgagttgtatattttactgtgcactaataatttctccgtttttacaaatgaggaaactgaggggaggcatgagaatacaggcaaaggggactgtataaatgttaatgtttctctttgtctttatgaaatttaaaaggaaaaaaataaatacaagccaagttcctgtcttaagtgcttcatagtctgtaactttatcttttattcacactagaccctgccagaagttagaaaaagtaaaagagaatgtggaagggagtgggaaatgagaggactgagttgtgtgagtaactcaggtcaaaaaagagattgcgcctcttagacctaaattcttgcctcccacaattctggaaccttccttaaccataaagtttctatcaccttatctcctggtttccaccaaagaactcatcatcctcagggaatgaccacatggagaaaggttatcatgacctaagaaccatgtctgacacagttaggatgaaaaggccaattacacctagaaggaaaaaaaaaaaacaacgcaaactactaaaaagtgtcattaaaaaataaaataaccaaatacaatgtatgaaccttcacacactagattaaattagatactgaatcaaaaagcaaaagttatgaaagacattttaagaacaattagggaagttgaaatacagactgtatattaaataatattattgaattagtgttaattttcctagatatgataatggtattgtgattataaagaagaacattcttattcttaagaaatgcttgctaaagtgtcatgatgtctgcaacttaccttcaaatggttctaaaaaaaaaaagagggagagagaaagaaggtacagtcaatgtggcaaacattaacagccggaaaatctacatgaaggggataaggatacttcctgtactgctcttttaactcttctgtaggtttgaactttaaaaaaaaaaaaaa

SEQ ID NO: 20423 - DNA, 5652 bp, Homo sapiens
  ENST00000543397
cttgctgttaatgaacttggttaaacatggtcaagtgtatgtatgtatatattatcagtactggccttctctatctaagaggaatagcaagaaatttagagacattatttggacattgatttctactaactccactgaattagattcagccttcactttttgggaaatgcacggacactgggaaagatgaaatgaagaagttttccagcatgatgttcttgtctttggagcttagccttacttaggtcttagaacaaaaacaagtcggtagttattagttactgtatctcattttccaaaacacacgtttctttgttacagtcatttacacatatttttgcatgccacatttttgcttttgagcttttgctgaatcactaaatgaccacctttcatgttcctaatgtattaaaattatcagaggattctttgaggattaaatgtgtcagtaagggtattattttgaacaatgcgtaaaaggtgaaggccagctgaagaggcctttttgttgtgaacagaataatatactggaatctgaggactgcactgttatgaatggattatttggctatggaaagaagttatttttaggcacagcatccctataagccctgaagctatgtgttttacaaactagaaattatgcactaaataaaaattaccagatgtcagtctctgtatgtgccaaatggcaaatgtgtaatggttcagagcctggaagaaatgatgcttatttctttgccattcaaactcaaaagggatagctgaggtagagtgctgttgaaaaaattgcagtgtttccagctacccaaagatgttacgaattgttatctgaaaggctttcattctttcccctcatggctcgttgtgtgtttgtggcattacaaatgtaacccacatatttattctaatttattacattctttcctgaggctcctcttgttcttttaaagggtcagcagataacttattttaagaatcaacctggacacagtattctaacaaaggtccaatacagagctaaataaataataggagtcatagccagacacagtgactcacgcctgtaatcccaacattttgggaggccaaggcgggtggattacctggtggtgcatgcctgtagtctcagctactcaggaggctgaggcaggagaatcacttgaacccgggacgcagaggttacagtgaaccgagattgcgccactgcactccagcctgggcaacagagcgagacctctatctcaaaaataaataaataaatacatttaaaatatatatatatatatatatatatatatatatatatatatatatatatatatatatatttatatatatttcgtgacttatatcttgcacataccagcatacctcattaattttaatgtaaccatccattggcttctcttctctccttagaaattcgagctcaactggtagaacaacaaaaatgcctggagcagcaaacggagatgcgagttcagcttctccaggatctgcaagatttcttccgaaaaaaagctgaaattgagacggaatattcccggaatctagagaagttagcagaaaggttcatggcaaaaacaagaagcactaaggatcatcaacaatacaagaaagaccagaacctgttgtctccagtgaactgctggtatttgctcctgaaccaagtaaggagagaaagcaaagaccatgcaaccttgagtgacatctatctgaacaatgtgattatgcggttcatgcagataagtgaggattctaccaggatgtttaaaaagagcaaagagattgcattccaacttcatgaggatttaatgaaggttcttaatgagctttatacggtgatgaaaacataccatatgtatcatgcagagagcatcagtgcagagagcaagctgaaagaggccgaaaaacaagaggaaaagcaaattgggagatctggtgatccagtcttccatattcgactagaggagagacatcaacggcgaagctctgtaaagaaaattgaaaaaatgaaagaaaaaagacaagcaaaatattcagaaaataagctaaaatcaattaaggcacggaacgaatatctcctaacacttgaagccaccaatgcctcagttttcaagtactatattcatgatctttctgatttaattgattgctgtgatcttggctaccatgcaagtctgaacagagccctaagaacatatctgtctgcggagtacaaccttgaaacctccagacatgagggcttagacattattgagaatgcagttgataatttagagcccaggagcgataagcagagattcatggagatgtaccctgctgcgttctgtccaccaatgaagtttgagtttcagtctcacatgggtgatgaggtgtgccaggtcagtgcccagcagccagtccaggcagagctcatgctcaggtaccaacagttgcagtcccgccttgccacgctcaaaatcgagaatgaagaggttaagaaaacgactgaagccaccttgcagacgatacaagatatggtcaccatcgaggactatgatgtttctgaatgcttccagcacagtcgttccacagaatcagtgaagtccactgtctctgaaacctacctgagtaaacccagcatcgccaagagaagagccaaccagcaggaaactgaacagttctacttcatgaaactcagagaatatttggaaggcagtaatctcatcacaaaacttcaagccaaacatgacttgctgcagaggaccctgggagaaggtcatagagctgaatatatgactacaagccgaggacgaagaaactcgcacacaagacatcaggactcaggacaggttattcccctcattgtggaaagctgtattcggttcatcaatctctatggtcttcagcatcaggggattttcagagtgtctggttcccaggtggaagtcaatgatattaaaaattcatttgagagaggtgaaaatcctttggctgatgaccagagtaaccatgatattaactcagttgctggcgttctgaagctctatttccgtgggctggaaaaccccctctttcctaaggaaagatttaacgatctgatttcttgtatcagaatagataatctctatgagagggcgcttcacatccgcaaactcctcctgactttgcccaggtcggtccttatagtgatgaggtacctctttgccttcctcaatcatctatcacagtacagcgatgagaatatgatggacccttataacctggccatttgctttggcccaacattgatgcctgtcccagaaatacaggatcaagtgtcttgccaggcacatgtgaatgaaattatcaaaaccatcatcatccaccatgagactattttcccagatgctaaagagctggatggccctgtttatgagaaatgtatggctggagatgactattgcgacagcccatacagtgagcacggtacattggaggaagtggaccaagatgctggtacagagccccacacaagtgaagatgaatgtgagccaatagaagcaatagccaagtttgactatgttgggcggtctgccagagaactatccttcaagaagggtgcctccctgctgctgtatcaccgtgcatctgaggactggtgggaaggcaggcacaacgggattgacgggctggtgcctcaccagtatatagtggtgcaggatatggatgatacgttttcagacactctgagccaaaaagccgacagtgaggccagcagtgggccagtcacggaagacaagtcctcatccaaggacatgaactccccgacagaccgtcatcctgacggctatttagccaggcaacgaaaaagaggagagccaccccctccagtaaggcgtcctggcaggaccagtgatggccattgcccgctccaccctccacatgccctttctaactcctcagttgacctagggtccccaagccttgccagtcacccccggggcctgctgcagaaccgtggcctcaacaatgacagtcctgagcggaggcgcaggcctggccatggcagcctgaccaacatcagccggcacgactccctcaagaagatcgacagccctcccattagaaggtccacgtcatcagggcaatacacgggcttcaatgaccacaagccactggacccagagacaattgctcaggatattgaagaaacgatgaacacagctttgaatgaactccgagaactggagagacagagcacagcaaagcatgcccctgatgtggtgctggataccctggagcaagtgaaaaactctcccacccctgccacttccacggaatctctcagccctttgcacaacgttgccctcaggagctccgagcctcagattcgacgtagcacgagctcctccagtgacacaatgagtactttcaagcctatggtggcacccagaatgggcgtgcagctgaagcctccagcccttaggccaaaacctgctgttcttccaaaaacaaatcctaccataggacctgccccacctccccagggtccaacagacaagtcatgcacaatgtaaaaaccagccaagcaaggccataaagggaggtgacttaaaaaagaaaatggattagtgacaaaagtcactgatccataactttccttagttttgtgcttataactggagatcttttggcttttctatgttgtcgaatgtaatgtctgagactagctaaattaacacgggcatttgtattttgtaatttttttaaataactggacatatgtcattttaaggacaatagaaacacttagacttacttgaaaatccaatgctgcaccacttgtaatgaaggcaacaccgctctccacattgtacagagcttcaggtttaatgtagcccagctgagtcagaaaggttgtgacctgaaggcagaagaacccgaatgccacacctcattggagtatagccagtgttggtctgtggcacttgggctgaaaggtgataatggcattgcgtggtagctgacaatgagcaccttcggttccatgtggagcggggtttagctcatgcaaaagacttgcaattgtctccatgggacgatcccagtgggactgtcagcccacagctcgagtgggttggatgcttgcctctttcctaacagttatttccccgggtccagcttaaagactcgatggaaggaggtagaacctctgctgttactgcttgaacttaacctgggaaaggagaggaagacaccatctccaaagctattaatgtcactccttttgcgagcatgattaggccccggagatttccaagtccccccatctacacttacaaacgattagaagggtttaattttaaagactttctggttacactactccacgaactcctccaaagatccgttattcaataactgcctagaaaatgtttccatctcctctaaatccctgtgttctcctctgtggaaatgaaggcagcaagaagcacctgaggccttggttcatgcagtgttctcttttgactaaatcacctaggttcctttaaacatgctacaaagcccaggcatggtggtgcacacctgtactcccagctactcgggtggtttacacaggaggatggctttgggcctagtagttcgagtccagcctgggcagcatagtgtgagaccctgtctctt

SEQ ID NO: 20424 - DNA, 360 bp, Homo sapiens
  ENST00000542381
tgaaaacataccatatgtatcatgcagagagcatcagtgcagagagcaagctgaaagaggccgaaaaacaagaggaaaagcaaattgggagatctggtgatccagtcttccatattcgactagaggagagacatcaacggcgaagctctgtaaagaaaattgaaaaaatgaaagaaaaaagacaagcaaaatattcagaaaataagctaaaatcaattaaggcacggaacgaatatctcctaacacttgaagccaccaatgcctcagttttcaagtactatattcatgatctttctgatttaattgatgtgagtacttgaagtttttgtcttttccatattaaaatgaaattaacaataa

SEQ ID NO: 20425 - DNA, 368 bp, Homo sapiens
  ENST00000537585
atttgctttggcccaacattgatgcctgtcccagaaatacaggatcaagtgtcttgccaggcacatgtgaatgaaattatcaaaaccatcatcatccaccatgagactattttcccagatgctaaagagctggatggccctgtttatgagaaatgtatggctggagatgactattgcgacagcccatacagtgagcacggtacattggaggaagtggaccaagatgctggtacagagccccacacaagtgaagatggtatgctctccccttatgctattataaagccagtctttatatccctattgtaaacaattgcttgtattaacattttagaggcaaagcacagtggctcctacctataatccca

SEQ ID NO: 20426 - DNA, 836 bp, Homo sapiens
  ENST00000542841
ccagcagtgggccagtcacggaagacaagtcctcatccaaggacatgaactccccgacagaccgtcatcctgacggctatttagccaggtaagtagagcctgggaatcaggcccctaagcctccgctcctcctggggccatgaggagccactgcacctcagccttgcagtactgcccggtgtgataagctcttctgttttctccctgtttctgtgaatgtctaggcaacgaaaaagaggagagccaccccctccagtaaggcgtcctggcaggaccagtgatggccattgcccgctccaccctccacatgccctttctaactcctcagttgacctagggtccccaagccttgccagtcacccccggggcctgctgcagaaccgtggcctcaacaatgacagtcctgagcggaggcgcaggcctggccatggcagcctgaccaacatcagccggcacgactccctcaagaagatcgacagccctcccattagaaggtccacgtcatcagggcaatacacgggcttcaatgaccacaagccactggacccagagacaattgctcaggatattgaagaaacgatgaacacagctttgaatgaactccgagaactggagagacagagcacagcaaagcatgcccctgatgtggtgctggataccctggagcaagtgaaaaactctcccacccctgccacttccacggaatctctcagccctttgcacaacgttgccctcaggagctccgagcctcagattcgacgtagcacgagctcctccagtgacacaatgagtactttcaagcctatggtggcacccagaatgggcgtgcagctgaa

SEQ ID NO: 20427 - DNA, 8406 bp, Homo sapiens
  ENST00000631006
gttgtgaccactgaacaaaacttgcccattgaaagcaaacccggaacagctggataatgtccaccccgagccgattcaagaaggacaaagagatcatagccgagtatgaaagtcaagtcaaagaaattcgagctcaactggtagaacaacaaaaatgcctggagcagcaaacggagatgcgagttcagcttctccaggatctgcaagatttcttccgaaaaaaagctgaaattgagacggaatattcccggaatctagagaagttagcagaaaggttcatggcaaaaacaagaagcactaaggatcatcaacaatacaagaaagaccagaacctgttgtctccagtgaactgctggtatttgctcctgaaccaagtaaggagagaaagcaaagaccatgcaaccttgagtgacatctatctgaacaatgtgattatgcggttcatgcagataagtgaggattctaccaggatgtttaaaaagagcaaagagattgcattccaacttcatgaggatttaatgaaggttcttaatgagctttatacggtgatgaaaacataccatatgtatcatgcagagagcatcagtgcagagagcaagctgaaagaggccgaaaaacaagaggaaaagcaaattgggagatctggtgatccagtcttccatattcgactagaggagagacatcaacggcgaagctctgtaaagaaaattgaaaaaatgaaagaaaaaagacaagcaaaatattcagaaaataagctaaaatcaattaaggcacggaacgaatatctcctaacacttgaagccaccaatgcctcagttttcaagtactatattcatgatctttctgatttaattgattgctgtgatcttggctaccatgcaagtctgaacagagccctaagaacatatctgtctgcggagtacaaccttgaaacctccagacatgagggcttagacattattgagaatgcagttgataatttagagcccaggagcgataagcagagattcatggagatgtaccctgctgcgttctgtccaccaatgaagtttgagtttcagtctcacatgggtgatgaggtgtgccaggtcagtgcccagcagccagtccaggcagagctcatgctcaggtaccaacagttgcagtcccgccttgccacgctcaaaatcgagaatgaagaggttaagaaaacgactgaagccaccttgcagacgatacaagatatggtcaccatcgaggactatgatgtttctgaatgcttccagcacagtcgttccacagaatcagtgaagtccactgtctctgaaacctacctgagtaaacccagcatcgccaagagaagagccaaccagcaggaaactgaacagttctacttcatgaaactcagagaatatttggaaggcagtaatctcatcacaaaacttcaagccaaacatgacttgctgcagaggaccctgggagaaggtcatagagctgaatatatgactacaagccgaggacgaagaaactcgcacacaagacatcaggactcaggacaggttattcccctcattgtggaaagctgtattcggttcatcaatctctatggtcttcagcatcaggggattttcagagtgtctggttcccaggtggaagtcaatgatattaaaaattcatttgagagaggtgaaaatcctttggctgatgaccagagtaaccatgatattaactcagttgctggcgttctgaagctctatttccgtgggctggaaaaccccctctttcctaaggaaagatttaacgatctgatttcttgtatcagaatagataatctctatgagagggcgcttcacatccgcaaactcctcctgactttgcccaggtcggtccttatagtgatgaggtacctctttgccttcctcaatcatctatcacagtacagcgatgagaatatgatggacccttataacctggccatttgctttggcccaacattgatgcctgtcccagaaatacaggatcaagtgtcttgccaggcacatgtgaatgaaattatcaaaaccatcatcatccaccatgagactattttcccagatgctaaagagctggatggccctgtttatgagaaatgtatggctggagatgactattgcgacagcccatacagtgagcacggtacattggaggaagtggaccaagatgctggtacagagccccacacaagtgaagatgaatgtgagccaatagaagcaatagccaagtttgactatgttgggcggtctgccagagaactatccttcaagaagggtgcctccctgctgctgtatcaccgtgcatctgaggactggtgggaaggcaggcacaacgggattgacgggctggtgcctcaccagtatatagtggtgcaggatatggatgatacgttttcagacactctgagccaaaaagccgacagtgaggccagcagtgggccagtcacggaagacaagtcctcatccaaggacatgaactccccgacagaccgtcatcctgacggctatttagccaggcaacgaaaaagaggagagccaccccctccagtaaggcgtcctggcaggaccagtgatggccattgcccgctccaccctccacatgccctttctaactcctcagttgacctagggtccccaagccttgccagtcacccccggggcctgctgcagaaccgtggcctcaacaatgacagtcctgagcggaggcgcaggcctggccatggcagcctgaccaacatcagccggcacgactccctcaagaagatcgacagccctcccattagaaggtccacgtcatcagggcaatacacgggcttcaatgaccacaagccactggacccagagacaattgctcaggatattgaagaaacgatgaacacagctttgaatgaactccgagaactggagagacagagcacagcaaagcatgcccctgatgtggtgctggataccctggagcaagtgaaaaactctcccacccctgccacttccacggaatctctcagccctttgcacaacgttgccctcaggagctccgagcctcagattcgacgtagcacgagctcctccagtgacacaatgagtactttcaagcctatggtggcacccagaatgggcgtgcagctgaagcctccagcccttaggccaaaacctgctgttcttccaaaaacaaatcctaccataggacctgccccacctccccagggtccaacagacaagtcatgcacaatgtaaaaaccagccaagcaaggccataaagggaggtgacttaaaaaagaaaatggattagtgacaaaagtcactgatccataactttccttagttttgtgcttataactggagatcttttggcttttctatgttgtcgaatgtaatgtctgagactagctaaattaacacgggcatttgtattttgtaatttttttaaataactggacatatgtcattttaaggacaatagaaacacttagacttacttgaaaatccaatgctgcaccacttgtaatgaaggcaacaccgctctccacattgtacagagcttcaggtttaatgtagcccagctgagtcagaaaggttgtgacctgaaggcagaagaacccgaatgccacacctcattggagtatagccagtgttggtctgtggcacttgggctgaaaggtgataatggcattgcgtggtagctgacaatgagcaccttcggttccatgtggagcggggtttagctcatgcaaaagacttgcaattgtctccatgggacgatcccagtgggactgtcagcccacagctcgagtgggttggatgcttgcctctttcctaacagttatttccccgggtccagcttaaagactcgatggaaggaggtagaacctctgctgttactgcttgaacttaacctgggaaaggagaggaagacaccatctccaaagctattaatgtcactccttttgcgagcatgattaggccccggagatttccaagtccccccatctacacttacaaacgattagaagggtttaattttaaagactttctggttacactactccacgaactcctccaaagatccgttattcaataactgcctagaaaatgtttccatctcctctaaatccctgtgttctcctctgtggaaatgaaggcagcaagaagcacctgaggccttggttcatgcagtgttctcttttgactaaatcacctaggttcctttaaacatgctacaaagcccaggcatggtggtgcacacctgtactcccagctactcgggtggtttacacaggaggatggctttgggcctagtagttcgagtccagcctgggcagcatagtgtgagaccctgtctcttaaaaaaaaaaaaaatgctacaaagtcctgatgatcctaaatttgaaatcccaactgtcctctccatttgtctttgagccaaccctgaactggccctggtacctgagtaagagccatgcagggccatcagcagaacatggccttgtggttctcacccagttgtgtacctcacaaccacaacttctttttctttgtcccttttcccctttttggttttggttttgtatgtgggctctatgtaactcccatagtcagctgaactctcaattggagaccctctttctctggcatcctagcacacaggcaattttttaagcctatatttatgctacattttcccccatcttaagaaaatttgctttgatttccattctcctactagcagcagctgatatcacctgtagacctatgagcattttatctattctatcattgaagttactgataaagatttttgttgttgttgttgttgttgggagaaatggatttcccacaactaatccctctggcccaccattaatttccttcttggtttcatttcaaactggcagccaattgcacgcccatctaagagctacacagtgtagattttacttcatcagcccattggtgaatgcatcgtgcagaaaagaactgggatctgtactaaaatcaagatcattactttgatctctacctcagtttgccagtgtagtcattctattgcaggaagagattaaattgatgagatattgttactttcagagtcacactgctgattgcttgcctggggcctaatttcacaaatgaatagtgacttttttcccatgtatttctaggtatggtaaacttttaaacctccaaattttcagagccatactttttgcccattttgaaaaagaagcccaggacagcaccttgtctagcccctccccatttctcctgagcttttggggtccttcagcacccttggacaccgtggagatccagccaagactgagctttgaatagcactagcccttttaaacaatcctcacaaattccttaggaatttaaactttccaaaataatcccccacttttttttttttttttttttttttttgagttggagtcttgctctgtcgcccaggccagagtacagtggtgcaatctcggctccctgcaacctccatctcccgggttcaagcaattctcctgagtagctgggattacaggcgccaccaccacgcccagctaatttttgtatttttagtagagatggggtgtcaccatgttggccaggctggtctcaaactcctgacctcaggtgacccaccagcctcagcctcccaaagtgctgggattacagatgtgagccaccatgcccggccattccaccacttctttaaaatagtaagaattcttaaaaaccatattccttgtttgatggaagagtaagatgttaacagagggcatcaaagggccagaggtgtctttgaatttattttttttcaatgtcttttctgagcttcagccttagcttttcagatcttcctcctacctgttcatttattcagccttctatctggtcatcctccccagcggctcctctctctgatgtgtccacctacggtggaacgaggattgcctttctgtgctccccatcaggactttgctgtcttggccggcaggagtcgtgctgctgcagagcctcacaggctgtgccttgtttcaggaaacagctcctaatactctcccatcactcactttacctgtctccatcttatttccctatactcctattgtcagcttgagactttttttttttttcaattccaaatgaagggtatgacctcagagtgagtgaggactcagtaaagactcacctctccttacttggtttattaaatgtcttcagattccagagataagacaaggtggccacttcacaaagaatccagaatcatgctcagtaaagctcattaaaagccactgcagctgagaaggttcacagcccttctttatagccacagaggcagcacacaggggaggtgggaagacacagggaaacgagagaagaaggataatgaggccttgaggtgttctgcccccaatttcaaggagcttatcaggcttcatgtgcaatttggggaggggagctttttgatggtgggtaaataatggctctacaaagattacctgactccactgacacaagaatatgtattctcagctgatataactgtgtgttcacatcccatccatagaactcactgaaggagattcatcaagtcagccttttggactgggttggggtttggggagtggatttggggatagagagaaaggtgtacttagtacacattttctaatgggcgttacgtgaactgtttgaacctgctgagtggcgctttgtagagctccatgttcacgttcagtgtcaacaccattcaacagctttgcacatcttcgtacaacataatctggctttggtgccccttgagccacctgtagaataatttatagcagggtcccacaatctactgcaatgatcgtgaacagttatcagtggatatagtgctccaagagtcaaattgtatccgttaagggttttctaacttttgctatcccccccgcgaccaaaaaaagggggggtttataatttaaagaaaaggaaaagaggcgtgggttggtagttgtgtccttaacatttaggaatgacatagcctctggagtctacaaactgaagaaactttcatctgatcagccttggaaatccaaagttaaagagcctatgtgtctcttgaggcgggggttagaggattcaaatttgggatgatgctcattgattcctgaccatagcagtgagaggccattttttgtgcaggaaatgtgcttaggactcagtcttgttttcgattatccaccacagaaaccctgagacacagagcagcttagaagtctctacccaggcgtaaatagagctccctactccagaccacctgccacccacctcccaagttgagaacacaagctccagctgggctggagagtcaggcttggtgcagggtgactttggcgaagttttgtcagatccataaagcaaactggaatttgagctttcacttaccctagtatacgttcttaaaaaaaaaaaaaagtctatgtggtataatcgagatggatacctgtgtctttaaattacgtagggaattttgtatgtttaaataattgtactgggttccataatgcttatcttagaaactttagtaaaagaaaatatatgaaccgtgcatttgtgaatgccccccttagagcattcatccaagttcagtgtgtagtgtgatggttattatagatatttaaagtatagtaagtggctgtgtaacaggagagactgctgtttacctacgtactgaagggtaactgctgcccgcgtaattaaatcagtattgtcctttcctgtcggtttgatcaattgcggtaccggtagcttcctgcttgtgactgttacctaattgtgtcaatgtacatctgtagtatgtacatgtgaaagtgcctttctattttagaggagttttagccttgctcttgtaccgttgccccgctctgtgccccacccccacctcctcctcccaattcctgctgcccactcgagtgtttcgaagcttcctccctgtcccccaccttccccatccccgccttcctgtgcctcggtgctcagtaatgtcccatctcacctccctgtcggtcctcagactgtctcgttttccttgtagacgtgattgtgcctttctcacccctgtgtcctcccatcccaccgcatcagtcccccgctcatgtgctgctgacagcatcgcattcgcccgtgctctgtactgcctctcaccatttcattccctcctctctgaggtgaaaataaagggggatgcttttacagtctggaaagaaaaaaaatgttttgttaatctgttgtgacaatgcacttttatgtatagtactgtacatttttggcatgtaccattacaggcttcagtatacagtcaggtttgttcttcacggtgtatctttataataaataagatagttctggc

SEQ ID NO: 20428 - DNA, 802 bp, Homo sapiens
  ENST00000462445
tttcctaatcaagaagttggcgtgcagctgggagagctagactaagttggtcatgatgcagaagctactcaaatgcagtcggcttgtcctggctcttgccctcatcctggttctggaatcctcagttcaagaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatcttgggacaaagaattttatagaaatttttaaacatctgaaaaagaagcttaagttttatcatccttttttttctcatgaattcttaaaggattatgctttaatgctgttatctattttattgttcttgaaaatacctgcattttttggtatcatgttcaaccaacatcattatgaaattaattagattcccatggccataaaatggctttaaagaatatatatatatttttaaagtagcttgagaagcaaattggcaggtaatatttcatacctaaattaagactctgacttggattgtgaattataatgatatgccccttttcttataaaaacaaaaaaaaaaataa

SEQ ID NO: 20429 - DNA, 1208 bp, Homo sapiens
  ENST00000242465
gaagttggcgtgcagctgggagagctagactaagttggtcatgatgcagaagctactcaaatgcagtcggcttgtcctggctcttgccctcatcctggttctggaatcctcagttcaaggttatcctacgcggagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatcttgggacaaagaattttatagaaatttttaaacatctgaaaaagaagcttaagttttatcatccttttttttctcatgaattcttaaaggattatgctttaatgctgttatctattttattgttcttgaaaatacctgcattttttggtatcatgttcaaccaacatcattatgaaattaattagattcccatggccataaaatggctttaaagaatatatatatatttttaaagtagcttgagaagcaaattggcaggtaatatttcatacctaaattaagactctgacttggattgtgaattataatgatatgccccttttcttataaaaacaaaaaaaaaaataatgaaacacagtgaatttgtagagtgggggtatttgacatattttacagggtggagtgtactatatactattacctttgaatgtgtttgcagagctagtggatgtgtttgtctacaagtatgattgctgttacataacaccccaaattaactcccaaattaaaacacagttgtgctgtcaatacctcatactgctttacctttttttcctggatatctgtgtattttcaaatgttactatatattaaagcagaaatataaccaaaggttaa

SEQ ID NO: 20430 - DNA, 1874 bp, Homo sapiens
  ENST00000378533
cccggccttcgcccgcccgctagcacgcagtcccttggtctcttcggtctcctgccgcccccgggaagcgcgctgcgctgccgaggcgagctaagcgcccgctcgccatggggagccccgcacatcggcccgcgctgctgctgctgctgccgcctctgctgctgctgctgctgctgcgcgtcccgcccagccgcagcttcccaggatcgggagactcaccactagaagacgatgaagtcgggtattcacaccctagatataaagataccccgtggtgctcccccatcaaggtgaagtatggggatgtgtactgcagggcccctcaaggaggatactacaaaacagccctgggaaccaggtgcgacattcgctgccagaagggctacgagctgcatggctcttccctactgatctgccagtcaaacaaacgatggtctgacaaggtcatctgcaaacaaaagcgatgtcctacccttgccatgccagcaaatggagggtttaagtgtgtagatggtgcctactttaactcccggtgtgagtattattgttcaccaggatacacgttgaaaggggagcggaccgtcacatgtatggacaacaaggcctggagcggccggccagcctcctgtgtggatatggaacctcctagaatcaagtgcccaagtgtgaaggaacgcattgcagaacccaacaaactgacagtccgggtgtcctgggagacacccgaaggaagagacacagcagatggaattcttactgatgtcattctaaaaggcctccccccaggctccaactttccagaaggagaccacaagatccagtacacagtctatgacagagctgagaataagggcacttgcaaatttcgagttaaagtaagagtcaaacgctgtggcaaactcaatgccccagagaatggttacatgaagtgctccagcgacggtgataattatggagccacctgtgagttctcctgcatcggcggctatgagctccagggtagccctgcccgagtatgtcaatccaacctggcttggtctggcacggagcccacctgtgcagccatgaacgtcaatgtgggtgtcagaacggcagctgcacttctggatcagttttatgagaaaaggagactcctcattgtgtccacacccacagcccgaaacctcctttaccggctccagctaggaatgctgcagcaagcacagtgtggccttgatcttcgacacatcaccgtggtggagctggtgggtgtgttcccgactctcattggcaggataggagcaaagattatgcctccagccctagcgctgcagctcaggctgttgctgcgaatcccactctactccttcagtatggtgctagtggataagcatggcatggacaaagagcgctatgtctccctggtgatgcctgtggccctgttcaacctgattgacacttttcccttgagaaaagaagagatggtcctacaagccgaaatgagccagacctgtaacacctgacatgatggttcctctcttggcaattcctcttcattgtctacatagtgacatgcacacgggaaagccttaaaaatatccttgatgtacagattttatttgtaattttaaaagtctattttattatgagctttctttgcacttaaaaattagcatgctgctttttgtacttggaagtgtttcaaaaaattatatgaccatatttactctttctaactttctttactccatcatggctgcttgattttgtagagaaattagaacccataaccatacacaggctatcaacatgttattcaatgtgacacctaactcttttctattttgttttttaagtaagacttttattaataaaacaaaatgttttggagcaaa

SEQ ID NO: 20431 - DNA, 760 bp, Homo sapiens
  ENST00000479015
ggcggctatgagctccagggtagccctgcccgagtatgtcaatccaacctggcttggtctggcacggagcccacctgtgcagccatgaacgtcaatgtgggtgtcagaacggcagctgcacttctggatcagttttatgagaaaaggagactcctcattgtgtccacacccacagcccgaaacctcctttaccggctccagctaggaatgctgcaggctgttgctgcgaatcccactctactccttcagtatggtgctagtggataagcatggcatggacaaagagcgctatgtctccctggtgatgcctgtggccctgttcaacctgattgacacttttcccttgagaaaagaagagatggtcctacaagccgaaatgagccagacctgtaacacctgacatgatggttcctctcttggcaattcctcttcattgtctacatagtgacatgcacacgggaaagccttaaaaatatccttgatgtacagattttatttgtaattttaaaagtctattttattatgagctttctttgcacttaaaaattagcatgctgctttttgtacttggaagtgtttcaaaaaattatatgaccatatttactctttctaactttctttactccatcatggctgcttgattttgtagagaaattagaacccataaccatacacaggctatcaacatgttattcaatgtgacacctaactcttttctattttgttttttaagtaagacttttattaataaaacaaaatg

SEQ ID NO: 20432 - DNA, 469 bp, Homo sapiens
  ENST00000461865
agcacagtgtggccttgatcttcgacacatcaccgtggtggagctggtgggtgtgttcccgactctcattggcaggataggagcaaagattatgcctccagccctagcgctgcagctcagtttcataacccttacaaagttggagccatggattttagtctctgaataatgatgtattaaagaagcagaattcaacaaccaaaaggctgttgctgcgaatcccactctactccttcagtatggtgctagtggataagcatggcatggacaaagagcgctatgtctccctggtgatgcctgtggccctgttcaacctgattgacacttttcccttgagaaaagaagagatggtcctacaagccgaaatgagccagacctgtaacacctgacatgatggttcctctcttggcaattcctcttcattgtctacatagtgacatgcacacgggaaagccttaaaaatatcctt

SEQ ID NO: 20433 - DNA, 1725 bp, Homo sapiens
  ENST00000432886
agaggcgagaggaggagttttccagcccggccttcgcccgcccgctagcacgcagtcccttggtctcttcggtctcctgccgcccccgggaagcgcgctgcgctgccgaggcgagctaagcgcccgctcgccatggggagccccgcacatcggcccgcgctgctgctgctgctgccgcctctgctgctgctgctgctgctgcgcgtcccgcccagccgcagcttcccaggatcgggagactcaccactagaagacgatgaagtcgggtattcacaccctagatataaagataccccgtggtgctcccccatcaaggtgaagtatggggatgtgtactgcagggcccctcaaggaggatactacaaaacagccctgggaaccaggtgcgacattcgctgccagaagggctacgagctgcatggctcttccctactgatctgccagtcaaacaaacgatggtctgacaaggtcatctgcaaacatatggaacctcctagaatcaagtgcccaagtgtgaaggaacgcattgcagaacccaacaaactgacagtccgggtgtcctgggagacacccgaaggaagagacacagcagatggaattcttactgatgtcattctaaaaggcctccccccaggctccaactttccagaaggagaccacaagatccagtacacagtctatgacagagctgagaataagggcacttgcaaatttcgagttaaagtaagagtcaaacgctgtggcaaactcaatgccccagagaatggttacatgaagtgctccagcgacggtgataattatggagccacctgtgagttctcctgcatcggcggctatgagctccagggtagccctgcccgagtatgtcaatccaacctggcttggtctggcacggagcccacctgtgcagccatgaacgtcaatgtgggtgtcagaacggcagctgcacttctggatcagttttatgagaaaaggagactcctcattgtgtccacacccacagcccgaaacctcctttaccggctccagctaggaatgctgcagcaagcacagtgtggccttgatcttcgacacatcaccgtggtggagctggtgggtgtgttcccgactctcattggcaggataggagcaaagattatgcctccagccctagcgctgcagctcaggctgttgctgcgaatcccactctactccttcagtatggtgctagtggataagcatggcatggacaaagagcgctatgtctccctggtgatgcctgtggccctgttcaacctgattgacacttttcccttgagaaaagaagagatggtcctacaagccgaaatgagccagacctgtaacacctgacatgatggttcctctcttggcaattcctcttcattgtctacatagtgacatgcacacgggaaagccttaaaaatatccttgatgtacagattttatttgtaattttaaaagtctattttattatgagctttctttgcacttaaaaattagcatgctgctttttgtacttggaagtgtttcaaaaaattatatgaccatatttactctttctaactttctttactccatcatggctgcttgattttgtagagaaattagaacccataaccatacacaggctatcaacatgttattcaatgtgacacctaactcttttctattttgttttttaagtaagacttttattaataaaacaaaatgttttggagcaaattt

SEQ ID NO: 20434 - DNA, 1842 bp, Homo sapiens
  ENST00000544439
agaggcgagaggaggagttttccagcccggccttcgcccgcccgctagcacgcagtcccttggtctcttcggtctcctgccgcccccgggaagcgcgctgcgctgccgaggcgagctaagcgcccgctcgccatggggagccccgcacatcggcccgcgctgctgctgctgctgccgcctctgctgctgctgctgctgctgcgcgtcccgcccagccgcagcttcccagataccccgtggtgctcccccatcaaggtgaagtatggggatgtgtactgcagggcccctcaaggaggatactacaaaacagccctgggaaccaggtgcgacattcgctgccagaagggctacgagctgcatggctcttccctactgatctgccagtcaaacaaacgatggtctgacaaggtcatctgcaaacaaaagcgatgtcctacccttgccatgccagcaaatggagggtttaagtgtgtagatggtgcctactttaactcccggtgtgagtattattgttcaccaggatacacgttgaaaggggagcggaccgtcacatgtatggacaacaaggcctggagcggccggccagcctcctgtgtggatatggaacctcctagaatcaagtgcccaagtgtgaaggaacgcattgcagaacccaacaaactgacagtccgggtgtcctgggagacacccgaaggaagagacacagcagatggaattcttactgatgtcattctaaaaggcctccccccaggctccaactttccagaaggagaccacaagatccagtacacagtctatgacagagctgagaataagggcacttgcaaatttcgagttaaagtaagagtcaaacgctgtggcaaactcaatgccccagagaatggttacatgaagtgctccagcgacggtgataattatggagccacctgtgagttctcctgcatcggcggctatgagctccagggtagccctgcccgagtatgtcaatccaacctggcttggtctggcacggagcccacctgtgcagccatgaacgtcaatgtgggtgtcagaacggcagctgcacttctggatcagttttatgagaaaaggagactcctcattgtgtccacacccacagcccgaaacctcctttaccggctccagctaggaatgctgcagcaagcacagtgtggccttgatcttcgacacatcaccgtggtggagctggtgggtgtgttcccgactctcattggcaggataggagcaaagattatgcctccagccctagcgctgcagctcaggctgttgctgcgaatcccactctactccttcagtatggtgctagtggataagcatggcatggacaaagagcgctatgtctccctggtgatgcctgtggccctgttcaacctgattgacacttttcccttgagaaaagaagagatggtcctacaagccgaaatgagccagacctgtaacacctgacatgatggttcctctcttggcaattcctcttcattgtctacatagtgacatgcacacgggaaagccttaaaaatatccttgatgtacagattttatttgtaattttaaaagtctattttattatgagctttctttgcacttaaaaattagcatgctgctttttgtacttggaagtgtttcaaaaaattatatgaccatatttactctttctaactttctttactccatcatggctgcttgattttgtagagaaattagaacccataaccatacacaggctatcaacatgttattcaatgtgacacctaactcttttctattttgttttttaagtaagacttttattaataaaacaaaatgttttggagcaaattt

SEQ ID NO: 20435 - DNA, 1780 bp, Homo sapiens
  ENST00000538295
agaggcgagaggaggagttttccagcccggccttcgcccgcccgctagcacgcagtcccttggtctcttcggtctcctgccgcccccgggaagcgcgctgcgctgccgaggcgagctaagcgcccgctcgccatggggagccccgcacatcggcccgcgctgctgctgctgctgccgcctctgctgctgctgctgctgctgcgcgtcccgcccagccgcagcttcccaggatcgggagactcaccactagaagacgatgaagtcgggtattcacaccctagatataaagataccccgtggtgctcccccatcaaggtgaagtatggggatgtgtactgcagggcccctcaaggaggatactacaaaacagccctgggaaccaggtgcgacattcgctgccagaagggctacgagctgcatggctcttccctactgatctgccagtcaaacaaacgatggtctgacaaggtcatctgcaaacaaaagcgatgtcctacccttgccatgccagcaaatggagggtttaagtgtgtagatggtgcctactttaactcccggtgtgagtattattgttcaccaggatacacgttgaaaggggagcggaccgtcacatgtatggacaacaaggcctggagcggccggccagcctcctgtgtggatatggaacctcctagaatcaagtgcccaagtgtgaaggaacgcattgcagaacccaacaaactgacagtccgggtgtcctgggagacacccgaaggaagagacacagcagatggaattcttactgatgtcattctaaaaggcctccccccaggctccaactttccagaaggagaccacaagatccagtacacagtctatgacagagctgagaataagggcacttgcaaatttcgagttaaagtaagagtcaaacgctgtggcaaactcaatgccccagagaatggttacatgaagtgctccagcgacggtgataattatggagccacctgtgagttctcctgcatcggcggctatgagctccagggtagccctgcccgagtatgtcaatccaacctggcttggtctggcacggagcccacctgtgcagccatgaacgtcaatgtgggtgtcagaacggcagctgcacttctggatcagttttatgagaaaaggagactcctcattgtgtccacacccacagcccgaaacctcctttaccggctccagctaggaatgctgcaggctgttgctgcgaatcccactctactccttcagtatggtgctagtggataagcatggcatggacaaagagcgctatgtctccctggtgatgcctgtggccctgttcaacctgattgacacttttcccttgagaaaagaagagatggtcctacaagccgaaatgagccagacctgtaacacctgacatgatggttcctctcttggcaattcctcttcattgtctacatagtgacatgcacacgggaaagccttaaaaatatccttgatgtacagattttatttgtaattttaaaagtctattttattatgagctttctttgcacttaaaaattagcatgctgctttttgtacttggaagtgtttcaaaaaattatatgaccatatttactctttctaactttctttactccatcatggctgcttgattttgtagagaaattagaacccataaccatacacaggctatcaacatgttattcaatgtgacacctaactcttttctattttgttttttaagtaagacttttattaataaaacaaaatgttttggagcaaattt

SEQ ID NO: 20436 - DNA, 8477 bp, Homo sapiens
  ENST00000267260
gtcacattgtgcgagagacaaaacccgggcgcgccggagctcacacgcgcacgcacacacatccgaccccgtcgcctcttctctcctggtgctgcccagaaagccagccctcccttcccttcttggggcgcagaggctcagccagctcagagcgcagcctggagccgacccagaagggcgaagaaagcccagcggacgagcctcctttctctgctgcctgcccgggctggggcgtcccatcccccgccctgaactccgatctctcccaccccacccctctctgggtttcacccggacagagccgggagctgggtgtcgcccccgtttggaatccacgtttcagcactttggacagcgccccggacgccccggcccctttgggttggcgatggcgagcgttcagcaaggcgagaagcagctttttgagaagttctggcgaggaaccttcaaagcggtggccaccccccgtcccgagagcatcattgtcgccagtatcacggcccgcaagccgctgccaaggacagagccccagaataaccccgttgtcccagctcaggatggaccctcagaaaagctgggtcagcatctggccaccgagcccttgggcaccaacagttgggagagagacaagacctgtcgggaactgggtgccaccagaggacacagtgcctctcatgacaaagacttgacaccaccaccttcctccaggggaaagaagaaaaagaagaaatccactcggaagaagagaaggaggtcctcatcctatagcccatcgcctgtcaagaaaaagaagaagaaaagttccaagaaacacaagcgacgcaggtcattctccaagaagagaaggcacagctcctctagcccaaaaagcaaaagaagagatgagaagaggcacaagaaacaatctcgaagccggccccgaaagtctcaccgccaccgccatcaccgctgcccctcgcggtcccagagctcggagtcccgcccctcaagctgtgagagcaggcaccgcggccggtcccctgaggaagggcagaagtcccgccgaaggcactcccgccgctgctccaagaccctctgcaaggacagccctgaggcccagtccagtcgcccgcccagtcaacccctccagatgcttggctacctgtcagccaggggtgtaatcactgggtcggggtctgctgctgacctctttaccaaaacagccagcccgctcaccacctcgcgaggacgttcccaggagtacgactcaggaaatgacacgtcctcgccaccctccacgcaaaccagctcagccaggtctcggggccaggagaaggggagccccagtgggggcttgagcaagagccgggagctcaacagtggcaacacctctgattcagggaactccttcaccacctcctcaccccagaacaagggggccatgttggagaatctctcccccaccagcaggggcagagagtcaaggggatttcagtcaccgtgtctggaatgtgccgaagtgaagaagtccagtttggtcccatccacagcccggagctcacccatgaaagggtgttcccgcagctcctcctatgccagcacccgatcctccagtcactcgtcccgatccccaaatcccagggcttcccccaggtacacccaaagccgatccacctcttctgaaaaaaggtcctactcccgctctcccagctattcctccaagtctggcaagaggagcccgcccagcagaagctctaggtcccgccgcagccctagctactcccgctacagccccagcagggagcgggatcccaaatacagtgagaaggactcgcagcagcgggagcgcgagcgagcgcgtcggagacgtcggtcctactcgcctatgagaaagcgccggagagactccccgagccacctggaggcccggaggataaccagtgcccggaaacgccccatcccctactatcggcccagcccctcctcatccggcagcctcagcagcacctcctcctggtacagcagcagcagtagccgctcggccagccgcagctactcccggagccggagtcggagccggagccggagacggagccggacccgcacgagcagcagctctagctcccgcagccctagtccgggctcccgcagccggagccggagcaggagccggagccggagccggagcaggagccagagccggagctacagctcagcagacagctactccagcacgaggcgctaagtgcccctgagccagctgcccgtgggggccccttcgcgctgccagcctcccccaaccacctgccctccccgccttcttggtgacaaatagtgagggctcctataccttgtccttcctgcttgcctaggggaagaggagaagagggtaagggggcttcactctctagatcagcctgctaggagcctctaccagcatcatcctggggcccagctcaggcctgggcatatggaaagaaccatcatcttgtggcacaaaaaaagaagaaagaaaagaaaacttcaaggttttgtgagaagcaatgggtctgtgactcaaaaattgagccctggccaggaaaatgtggagacagttcttctcctccactgctcacaggaggcccgtggtaattctccccacctccccggatgccccactagtccaacttcatggctgcacgtggatggacccccatgtctgagaggggtgaaagaggagaccaatggcagttcaggttcaagataacggggtcaggcctttaacttcctcaaacaggcccaagcaaaggctggaagacatttgggtcctagaagaagggatatccttgaataccagatggggacgtttgacttggtgggaggtgtcaggagataggagttggttaagatgatagatagaaaaacggaagggttcagctgctgctcccaatacctcagcatggtaaggggacagagcccagcagatcccagctgtgaagaggccactgcatggctgacacaaaacacctcttggccattcacaggggccctgcaacctcacgagaaaggagatagtggaagagtcaggacaggttggtctccagccccacttcccaaatatgcctcagccccactagctggcaccaacttaattccacgggaccatctgctgaacattccccagtgccatggccagttgccaggccccagcgccagccagtctggccttaccctccggttggcgcctgccagccccctcccctctgcccaggctgccacgccctggatgccacccagtgcagcctggcacctacccacccacccttcagcttaagccactccccttgcctctcaggaattttgccaggatggggcacagcagctcaggtttgggggaaaagacccgaatccagagtgcaggggagaggggcttggatatgccatgtcttgggctcctgctggcttctgaggtttcttgtcagcttgggaaagacccacctttatttttgccctcaccccaagtcccccctggctggggctgggcagagagggtaagctgatctccgatccacaaataccaccagctgcttcatccacagaaggcgctaagaacggggaggtgaggaataagatccttaaaataaactcttgggcatccccctcaccagctgactggctttccggaggcttgtgggtgagtttcaagtttgtggtggcaacagcagcaggacagggcacggagggagcgagggagagaggaccggtcccagcttttggatattttgggttatggggaagcaagggccaaacattctttatccctcccaccccagggaaaacatttggaaaatagtcctttttcttggaagcagtgacgtctccctacccaatctttcccatcctatcaacccatggggctagagactgccatgcaaccaccaccacgacagcccttcctccatcagaagacaggagtgagggccccgggcagcagtggacgacccagcctccccataccgggcctctggcccagacctaagccctgcccacaaagactaatggatgccagtgctgtcactgcagaaggccagatggcaggtgcctgggacaggggcaggtgccccggggagggcaagtacagccactgtaaataaccctcgtccctgcccaggaacccagactggacttcagtctccctccatggagacaaaggcttcccagagccaccaaaaaccttcttagcaggacagctgtgagaggcatcagaacctcacgttcggactgccttcatcaagacaactctaggggaccattttgcctggggctcctagcaaacctttttatttattttatttatttatctatttatttatttgatgactgtctctctttctcgccattagcagtattgaattatttatttatacagaggttttgtgtgtgtgtgtgtgtgtgtgtgtgtgtgtgtgtgtgtgtgtgtgtgtgttggggggatctcctaaattatttctgtgcatctcctttttttttctgctgttttttatggatgggatttgagaggccaaaggtgagtgggctattggccttctccctgaaggctctaagcctggaacaccctggggttggcccagaaggaggcacatcagtcccaaaattcatcacttaacccagcgtccaggagggtcaggcctgtaccccagcctcctgtcccccaggaacctcacaggggtatcaaaaagatgtaaacagcccagaggcttatgagctacagtgatgaattgacacagtggagttgcaacttaggtgggggttggagtcgaaagttggcaaatggggccaaggctgcacaaagtcgaaatcccttgtgaatgtcccttagggaggcaccagattggagacagatgtgctatctcctaacagagtgatgaggcttcagttgagtacttgctgaagtagttgccttgtattttgagggccatggtggatgaaaatgatgtctggtttagtactggaattgcacttggggttgacaaggtgctcacaccatgagaatggaggcaggaattgagctgactgagggaagatgcaccttgatctcaccctcactccaaggcacatagcaggatcactccctagcttctctgagcacacctagttggtttcatgtatgttacacatgcttccactccacagtacctaatttctctctgtcccctgagatctgaaggctaccttgggaagaggcatcagccatcttgcttgagaaccaccaagccaaaagcaaaagcttttatctatgatctcttgctgtttcatcaggggaaagcacaaagctatttctgaaattaggaaaaaaaaaaaaaaggtggaaggagcagccagatgttccacaggaccccaccaagaaggtcatttccaaacccatcctggaagggcccaggatccaaaggtcatcagtcctgcttatctgaccaactggcagtgtcttctggctgctggccggagacagctcttgccctttccaaagtcactgtccactgccttgcaattgccagcttgtctggtccagctttgggtttggtgagacttttgcaacatccctggttgtttccctggcaatgtgactatccagccctaacccaaagcaagggagtgcccctttcctgggtgaagtttacaagaaggctgcttaaatgcctgcttcggggaaatctctgcctctctctctctctgtctctctctctgtctctctctctgtctctctctctctctctctctctctctctctctcagtgtatttctctactttcttttacatttcctttttttctatccaaaaacaatgtgcttgttgaggcactggtaaccctgattaaccagaacctcccattcccagtatcgctgttcctacgcccatttcaccctcattaccttctgcttccaaggaatatgacagatcaccaggatgctgctcgtcgtgaggatttatctcaaaaaccaacatccaaaatgggagggagatgtggcttgaggtcaagcgccatgcatcccaagcctttgaccttcccgctatggaagtgcactggatgacagaaactgaatacattgctccctttccctagggcaaagttcgacctctgttaagtggagggatttgtgagataaaaattcaaaatgttggcctgaggcctgagagtgtcaccaaagacagagggagcttcactgagactcagagggaaaaggaaaagagcctcaaacatttttaggaggttgtccatcatgaaagtaaaaacgaaaagcaagatttgatctcccttcagttaattaggcaaggctaagtaactcaaagccccctattagtaacattctggttcactgaggtttgatcatattcctatctgcattccttcccttctttgaaggacagctgatctttcagaagcagaataaaattaagatgttagaacaaaggtctcagtctcagagaaccgcatcacttcatttgctcagacccatcctcttttgcaaaagggtctgcttggagaggccaaaattcagggtgctctcaaaggcaaagaaagcacattgttttccttctccagtccaactttcatcttttcttctgctgttttcttttcccctcttctttttcacaaatgttcaaaatggtctcatgcgcatgtgtcttgccccactttcccctttagctgaacagaaaattttgtctcagtaaaacgaagtcaaaaaacaggattcctccaaacatgcctcctcccgcactggccagccgagtccagctgagaaacttatgctagattcaatgtcattgagcaatgctttattgaagtctcgttcttctcacttctgcaccagtgagccaatgatactgacagaaatgtcatctctcttctatctgtggttgctgtttttggagtaaaagtttctgtgtgtgtttttttagttcttttgatggctgttgttttgcattgtaaataccatgatgggggacccccatcagaacatggcttatttaataatttatttcgtatttattgagtaatattgggaaaagagaaggaccacctctttccctgaattgctattgagaattggtccatctcccagctccaggtgctgctgtctgcagcaagggcattactgcccaggtaaggagtgctagaatcaccaagcaaattgaaattggcagaaatggaggcttcagtcacacaaattagactcaaatggaactaaaacactggttatctccaggaaaacctcatttagatggaaattaatggaagaataaaatgcctacacatgaaccaacttctattaaaaagtcacaactccttgaaaaaaaaaataaagaaaaattgtaaactcttttttttttctggccaaggaaagctatgcctcatcttctaacgagccaagccaaaaagactgcaatggtattcctatgtgtttctttggcctgtgtatcagtctgaatgaaatggaatgggtctctagcctcagtcttgtcatctgtaaaatggggcttgtcctatatattatctgcaagacgtgggaaatgggggctcaagccctgatgctatggactccatactgttggatatattgtctcttgtgtcttctgctgactgcagattaaagggtgtcaaccaaggaaggaaacaaaaaagtagggcctggacttcatttgcagaatgaggtcatagtcgttgagtcccacagtcatatatgggagacctcaagttgctgtcaccttgataactcttgtatcctgggttaaagccctctgtatttagtttgaacttctctctaagccccgtggtccaaagtcatcacgggagagaccaagatgggcttaccttgccctgctctggatttaaccattgttcattgtcaggctatatttttgtacaatcattcaaataacccagtgacataggtcatattgccacttttcagaggagaaaactgaggctcaggagggggagttgacatgcccaagctcccttgagctcagatcagcttgactcaatgtccaacattcccttggtagctttttctccggggtcctgtgctataagaacttctctctgcactgtatttttttttctcccaattcttagctatttcctcaagcaatgattggccaaggacctagcataatccaccacattggccaaggggacgtggtgcaccccaaggccatttctctgcattggaggctgcgaatctcctctggaaaattcccaacccgaggacccaccatgagcccagctcagcctgaccagacagcctctgcctggagcattcacatcagatggaaagaagctgctgtgtcctccagcatcctgggaccctgtcctctgcccagtgacacagcagccatggctagcttgatttctggtctccaaagctaagcataaccttcccggggtttctggtttttcagcctgtacgaaacatgtctctgttctaattaaagttcccatggtatggtgttctca

SEQ ID NO: 20437 - DNA, 461 bp, Homo sapiens
  ENST00000545224
attaagtccttatttaggtacttagtctgaagtgtgacccaatcagccatgagtgcctctcatgacaaagacttgacaccaccaccttcctccaggggaaagaagaaaaagaagaaatccactcggaagaagagaaggaggtcctcatcctatagcccatcgcctgtcaagaaaaagaagaagaaaagttccaagaaacacaagcgacgcaggtcattctccaagaagagaaggcacagctcctctagcccaaaaagcaaaagaagagatgagaagaggcacaagaaacaatctcgaagccggccccgaaagtctcaccgccaccgccatcaccgctgcccctcgcggtcccagagctcggagtcccgcccctcaagctgtgagagcaggcaccgcggccggtcccctgaggaagggcagaagtcccgccgaaggcactcccgccgctgctccaagaccct

SEQ ID NO: 20438 - DNA, 561 bp, Homo sapiens
  ENST00000537597
gagccagcatacatacagttcagagctgctttagcccaccaggccagggcagaagaagacaagcagtgaggccagagaactagatctcgaagccggccccgaaagtctcaccgccaccgccatcaccgctgcccctcgcggtcccagagctcggagtcccgcccctcaagctgtgagagcaggcaccgcggccggtcccctgaggaagggcagaagtcccgccgaaggcactcccgccgctgctccaagaccctctgcaaggacagccctgaggcccagtccagtcgcccgcccagtcaacccctccagatgcttggctacctgtcagccaggggtgtactttctcacctgagaaatgggcatgattatcccgcttgtctcccaggaggattgtggcaaagaaggcagctgttgagcccagtacttgatacaggtgcaaaacttgacaaataatatgatgacaacattccagatcctggctctgcacttaccagctgtgactccttgagcaagtttctgtgtctcagtttcctcaaaaactgcaaaacaaggatagcaata

SEQ ID NO: 20439 - DNA, 682 bp, Homo sapiens
  ENST00000641899
gcaccgcggccggtcccctgaggaagggcagaagtcccgccgaaggcactcccgccgctgctccaagaccctctgcaaggacagccctgaggcccagtccagtcgcccgcccagtcaacccctccagatgcttggctacctgtcagccaggggtgtagaggagttcttgcttgatcactgggtcggggtctgctgctgacctctttaccaaaacagccagcccgctcaccacctcgcgaggacgttcccaggagtacgactcaggaaatgacacgtcctcgccaccctccacgcaaaccagctcagccaggtctcggggccaggagaaggggagccccagtgggggcttgagcaagagccgggagctcaacagtggcaacacctctgattcagggaactccttcaccacctcctcaccccagaacaagggggccatgttggagaatctctcccccaccagcaggggcagagagtcaaggggatttcagtcaccgtgtctggaatgtgccgaagtgaagaagtccagtttggtcccatccacagcccggagctcacccatgaaagggtgttcccgcagctcctcctatgccagcacccgatcctccagtcactcgtcccgatccccaaatcccagggcttcccccaggtacacccaaagccgatccacctcttctgaaaaaag

SEQ ID NO: 20440 - DNA, 595 bp, Homo sapiens
  ENST00000613941
ggcggtggtccgccatttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaaggctggagtgcaatggtgtgatcttggctcgttgtaacctctgcctactgggttcaagtgattctcctgcctcagccgcctgagtagctgggattacagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagagtcaccatcatgtctcttctcacc

SEQ ID NO: 20441 - DNA, 544 bp, Homo sapiens
  ENST00000620242
atttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaaggtgatttaatgattacgctgataaaaatgtgttgcttgtgtttttcatatttaaaatctacaggatatgtggctcttagatggctttcccaatcactggccaattgtatctttagatacaattgggatctttttttttttttttttttttggtggggagacgagtcttgcactgtcactgggctggagtgcagtggtacagtctcccgctccccgcaacct

SEQ ID NO: 20442 - DNA, 1518 bp, Homo sapiens
  ENST00000339436
tttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagagtcaccatcatgtctcttctcaccaccctctgaatctgcattagccagtcaactagccctttcagcgtcatgtgaccagcgcgccccattcagcttggctggtgtcgtttcacatgacccaggctggccagtcgtcaggttgcaccgccctttggttcccgagcatgctgttttctctcagccttctctccaaccttaaccaaatcggcagcagccacctcgaccgcccacacattcctggccaatcagctcagctgtttatttaccaaatgtcttcacaacaactacagcagcagccttcggctaacaaaaaagcaggaaaaatccacaacacccccttcgccaaccaactaaatccaacgcaacatctggcaaaaccttttcagcaaattcttcctggccgtcagtccggcagcctcacctcaccatttctagcttgttgaaacccaaaactagtaagtttttcctgcttatacagtttactgctggttaaaataaggagtaagcggcttaaagtaattcttttttctggatcaaaggctggctgtgcataattgaatggtaacgtacatatatattgcttgaaaaacttttaagggtgatagggaactcgtaatgtaactaggccttcaagtgaaacttatttgcatgtgcaagatgccaaactaaaaattttaatatctctaacagattagcttttctggcaaaaatttgttgaatcctatcacctttaaatggttttactaacagtttcaaaatttaaaattttggggttgaagtgtgggccaagctaaggtaattttggtaagcctaaacacactcttaaatgtgacgatcacaaatgcagttctaatgtagcacttaatggcatcaatatttacacctaccgcgttttcacaaaattacactatccacctggtacctaagtcttgtcatggacttacaggtttgcatgggttccaaatactggtttatggtactgtttttggaactacttgtgggactatattttggtgtggtgtttgggtagtgaagttagtttgacatgaagttttgcatt

SEQ ID NO: 20443 - DNA, 4222 bp, Homo sapiens
  ENST00000373715
tttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagatctccaagaaggagaagcttctctcgcagccggagcaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgtttttttttaaatttaaatacagaaacaactggcaaaaattgaactaagatttacttttttttccatagctgggatataggctgcagctatagttgaacaagcagtctttaaaaactgctgtgaaacacaggccatcagggaaaacgaaatgctgcactattaaattagaggtttttgaaaaatccaactctcatcctgggcagaggttgcctagttggtatagaatgttaagtttcaagaaagtttacctttgctttaggtcataagttccttatttgattgctgtatatggatacatggctgttcgtgacattctttatgtgcaaatttgtgatttcaaaaatgtcctgccagtttaagggtacattgtagagccgaactttgagttactgtgcaagatttttttttcatgctgtcatttgtaatatgttttgtgagaatccttgggattaaagttttggttacaaattgttctttaacttgaaagcctgtttttccttgcaaactcaaatctgtgagcttggtaccaagtccaggtataacattcctattggaagccatacttatattttcttgtaaagtgcttttgaattaataaaatattagcataattgtgtatagtcagttgaacccactgttaccattgttcttatcccatgggaagcagttggttacacgattcttattttataagaaacagctgagaggcactatggattagtcttctgaagtgaaggaaatatagatgtcacctaagtgatagttaacccattttttttttttttaggcatagaagccagttcagggtccataatatttagtgaccaacattttaaagtatagcagcaacctggttcttaaacacaaagtaagttgcccattaacaaatggcttttatctttagcatgaaaactttccacaggtctaaaaattgcttccattttataatttgaggtgttgcatgggaattctaagctgatccatcatgatgtaaaagttcacaatatggttcaaatgtaacagtgcagaattgaatatggaggcatgcataaccttcctcttagaaaatggcaggtgttgtaatttcaaatttttgtgcaattagattaaatcataatgcaacagtcttgtggcttagtttccttaaatatgctcttaagatagttttggattatgcggtattgactgtcttaaatatgaaagataagtcattgcattaagagttcaagctaaatggatacattaagatacagttcctaaacaaattatttatttccaccttttacacaaatcttgggagaattggtgtcaggaaggttcagccttaaagttaagcatgttcaagaaagacacttttcagacagcctgtttatttactgagagctctggcattgggcattttgtctttagtattctcacatagcctacaacctgttcctgttaggaacaagccaagatagctaagaagttacggaagccatgcaatatgtcaattacattgctttttataaatggacaacttatgtgggcatttttgggcagtatatgacttccttgcaggctcttaagttggaagggtttctgtaaaaaggacagttacgggtataatatggctaagagaaataatacagaacctgaaataaaagtaacttcaccagggagttatcctgacttaggtgacatacagtcccagttggcagttactttaaccaggagccctagcataacctcaagactcttagaaactttagaacatggaaattgttaaaagctttgaattgcacatttagattgtggctattaggaatttttaaagttgtaattcctaaaataacaggtcacactaaccggtcttgtccatattcagggttgagtgtaaaaatgaaaggaatcacaaaactgaacttagacctgtggtttaaggatcaaggtgttcactagaagtcactgttactaatacttgatgacaatgtaaagaaacattaaggattatatttgattgttttcaaagacactggctggatgtggtggctcacacttgtaattcctagcactttgggaggctagggcgggtgggaggatctcttgaagccaggagttggagaccagtctgcccaacatggcaagattcacatttctattaaaaggaatatttagtttgatctctggttcacagttcattgtgggttgcttctgacctccatgtcttaagcagaaagtagggaagttgtagttttaccaagcacaggtaccctgtgtctaccatttgagtatcttagagatccttacaaacgtgatcccgtcagcgtccatgacactcccaccctgttagactgctgtcagtggctttcacacaaacccatatgtggatggaaaatccaggttattactacattcattttagtacagtgctgcctaattagaaattttgttgaagaggtatttcagaatagatacagccagactccaggctcattgacttagtttttcagggtgacctaaccctgtgtaattttgaggagttctacatgataaatacccttggtgatgtgagaaccactagtttagtattttgtccaagtatgctttttttcagagttctgaatgagatttagttgtcatacctagttggtggtaatttcttagttgtatatttttgtactaccagattgttgccttctggttttccatcttttcgagaaagatttctagttaaagttactgaagaaaaactgggttggaagtacatttttctctaaataatccagtagtgttgaatttgattttatgtccactctaatttttttcatcctgttttattagggggattcatcgggtacctgaagataattcagctgtagaccccttaaggttctgagacaaggtcattgaaatttgttttggctgggtgtgatggctcatgcctgtaatcccggtgcattgggaggttgaggcaggtggatcacttgtggtcaggagttggagaccagcttggtcaacatggtgaaaccccgtctctactaacagtacaaaaattagctgggtgtggtggcaggcgcctataatgccagccacttgggaggctgaggcaggagaagtgcttaaacctggtgggtggaggttgccatgagccgagatgtagccacttcactccagcctgagtgaaagcaaaacttcgtctccaaaaaaaaaaaaaaagtttgttttggtaagcctagtataattgattagttttgtccatgcaactttccccttgttggactctgtacttaataatacagtatttagattctca

SEQ ID NO: 20444 - DNA, 1095 bp, Homo sapiens
  ENST00000477442
gagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagagtcaccatcatgtctcttctcaccaccctctgaatctgcattagccagtcaactagccctttcagcgtcatgtgaccagcgcgccccattcagcttggctggtgtcgtttcacatgacccaggctggccagtcgtcaggttgcaccgccctttggttcccgagcatgctgttttctctcagccttctctccaaccttaaccaaatcggcagcagccacctcgaccgcccacacattcctggccaatcagctcagctgtttatttaccaaatgtcttcacaacaactacagcagcagccttcggctaacaaaaaagcaggaaaaatccacaacacccccttcgccaaccaactaaatccaacgcaacatctggcaaaaccttttcagcaaattcttcctggccgtcagtccggcagcctcacctcaccatttctagcttgttgaaacccaaaactaatctccaagaaggagaagcttctctcgcagccggagcaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacagg

SEQ ID NO: 20445 - DNA, 869 bp, Homo sapiens
  ENST00000620941
gtgacgttcagcacggggcggtggcgggggctcccggcccatcggagggtttcctagtcttggagtggaagtctttatattcctcattggggcatgagccaggatgggggttacctgggagttgggaaccacaaaggggagccgatagccgagttgtattccagaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagatctccaagaaggagaagcttctctcgcagccggagcaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaatacca

SEQ ID NO: 20446 - DNA, 2655 bp, Homo sapiens
  ENST00000620389
gaccaataaagggggctaaaaaagaagtaatcccagtcatctgttcttcaatcccaaataggagaaaattcagtttttttataattgaaaatggcatcattcttggaccaggcagtattgtctgggtgctaactccacatctcctcagacctccaaaatagtttctataggactaaatttacctcttacaggtgagtggagtccttctaggagacaggagttcaaaatcttgccccttttgctattttgaaaaacaacagcacactgttgcccatcataataaagagtatttgttagctaatagatggttgtactgatggcttgtttttcattttttttgtgctttttggtccatctattaataaaaatgaaccccgttacagagtcaccatcatgtctcttctcaccaccctctgaatctgcattagccagtcaactagccctttcagcgtcatgtgaccagcgcgccccattcagcttggctggtgtcgtttcacatgacccaggctggccagtcgtcaggttgcaccgccctttggttcccgagcatgctgttttctctcagccttctctccaaccttaaccaaatcggcagcagccacctcgaccgcccacacattcctggccaatcagctcagctgtttatttaccaaatgtcttcacaacaactacagcagcagccttcggctaacaaaaaagcaggaaaaatccacaacacccccttcgccaaccaactaaatccaacgcaacatctggcaaaaccttttcagcaaattcttcctggccgtcagtccggcagcctcacctcaccatttctagcttgttgaaacccaaaactagtaagtttttcctgcttatacagtttactgctggttaaaataaggagtaagcggcttaaagtaattcttttttctggatcaaaggctggctgtgcataattgaatggtaacgtacatatatattgcttgaaaaacttttaagggtgatagggaactcgtaatgtaactaggccttcaagtgaaacttatttgcatgtgcaagatgccaaactaaaaattttaatatctctaacagattagcttttctggcaaaaatttgttgaatcctatcacctttaaatggttttactaacagtttcaaaatttaaaattttggggttgaagtgtgggccaagctaaggtaattttggtaagcctaaacacactcttaaatgtgacgatcacaaatgcagttctaatgtagcacttaatggcatcaatatttacacctaccgcgttttcacaaaattacactatccacctggtacctaagtcttgtcatggacttacaggtttgcatgggttccaaatactggtttatggtactgtttttggaactacttgtgggactatattttggtgtggtgtttgggtagtgaagttagtttgacatgaagttttgcattggacagatctgctgtgaagcattctttgttaaagtgaatccatggttggaatacctgcttttcacttgagctttttgtttcttaatccttctgtgccttttttttcttttcttttttttctttttttttttttttttttttttttggacgatgggtgccagttcttcggcacattcactgggcccaacagtgagattgaaaagttgggaaatgcctcacgccataaatactaattgatgatgagcctaattttcctgtttctgcttttagatctccaagaaggagaagcttctctcgcagccggagcaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgtttttttttaaatttaaatacagaaacaactggcaaaaattgaactaagatttacttttttttccatagctgggatataggctgcagctatagttgaacaagcagtctttaaaaactgctgtgaaacacaggccatcagggaaaacgaaatgctgcactattaaattagaggtttttgaaaaatccaactctcatcctgggcagaggttgcctagttggtatagaatgttaagtttcaagaaagtttacctttgctttaggtcataagttccttatttgattgctgtatatggatacatggctgttcgtgacattctttatgtgcaaatttgtgatttcaaaaatgtcctgccagtttaagggtacattgtagagccgaactttgagttactgtgcaagatttttttttcatgctgtcatttgtaatatgttttgtgagaatccttgggattaaagttttggttacaaattg

SEQ ID NO: 20447 - DNA, 2376 bp, Homo sapiens
  ENST00000614136
ttgaaaaacttttaagggtgatagggaactcgtaatgtaactaggccttcaagtgaaacttatttgcatgtgcaagatgccaaactaaaaattttaatatctctaacagattagcttttctggcaaaaatttgttgaatcctatcacctttaaatggttttactaacagtttcaaaatttaaaattttggggttgaagtgtgggccaagctaaggtaattttggtaagcctaaacacactcttaaatgtgacgatcacaaatgcagttctaatgtagcacttaatggcatcaatatttacacctaccgcgttttcacaaaattacactatccacctggtacctaagtcttgtcatggacttacaggtttgcatgggttccaaatactggtttatggtactgtttttggaactacttgtgggactatattttggtgtggtgtttgggtagtgaagttagtttgacatgaagttttgcattggacagatctgctgtgaagcattctttgttaaagtgaatccatggttggaatacctgcttttcacttgagctttttgtttcttaatccttctgtgccttttttttcttttcttttttttctttttttttttttttttttttttttggacgatgggtgccagttcttcggcacattcactgggcccaacagtgagattgaaaagttgggaaatgcctcacgccataaatactaattgatgatgagcctaattttcctgtttctgcttttagatctccaagaaggagaagcttctctcgcagccggagcaggtaaatgactaccttttttggctacgttcttagaaatggcagtgtttctgctattcctaaacttttccaggtggcttagttaatgggaataaaccttggctttaatagtgaatcaagttgtaaggatgagtcagctttctttgagttttcaaaggctttttagaaagtatttaattttttaaaaaaggatctgtcacccaggctggagtgcagtggtgtgattatagctcactgtagcctttaactcctggccttggagtgatcctccctcttcagcctcctgagtagcttggactacaggcaagtactgccatacctggctaatttattttttgtggagatgggatctcactttgttgtccaatctgttctcaaactcttggcttcaagtgagcctcctgcctctgcctcccaaaatattggaattattggcatgagtcaccatgccagatcaagaaaatatttatgtataattttatcatacctcattggtcctaatgtttttttgcttgtttaggtccctttctagagataggagaagagagagatcgctgtctcgggagagaaatcacaagccgtcccgatccttctctaggtctcgtaggtaagatctttgataacttgtatttaagactttgcatacatagtatgctaaggcctgtcttctaagccataaattttttaccttaaagttctatttcgatatgtcactaaagtgtcaccaagttacagatgtaatgttttgttttctttttttttttttttttttagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgtttttttttaaatttaaatacagaaacaactggcaaaaattgaactaagatttacttttttttccatagctgggatataggctgcagctatagttgaacaagcagtctttaaaaactgctgtgaaacacaggccatcagggaaaacgaaatgctgcactattaaattagaggtttttgaaaaatccaactctcatcctgggcagaggttgcctagttggtatagaatgttaagtttcaagaaagtttacctttgctttaggtcataagttccttatttgattgctgtatatggatacatggctgttcgtgacattctttatgtgcaaatttgtgatttcaaaaatgtcctgccagtttaagggtacattgtagagccgaactttgagttactgtgcaagatttttttttcatgctgtcatttgtaatatgttttgtgagaatccttgggattaaagttttggttacaaattgtt

SEQ ID NO: 20448 - DNA, 13040 bp, Homo sapiens
  ENST00000326495
cggctccaggaggccccgggcccggcccgggcggcggtggcggtggcggctctagctcgagacgtctgtggcgccctcgcaccgcgccgcagccatggccctggtgaccctgcagcgctcgcccacgcccagcgccgcctcctcctcggccagcaacagcgagttggaggctggcagcgaagaagatcgaaaattaaacctcagcttaagtgagagctttttcatggtgaaaggcgcagccctcttcttacaacagggaagcagccctcaaggccagcggagtcttcagcacccccacaagcatgcaggtgatctgcctcaacatcttcaggtgatgatcaaccttctgcgttgcgaagacagaatcaagctggcagtgcgcctggagagcgcctgggcggaccgggtccggtacatggtggtggtgtacagcagcgggcgccaggacaccgaggagaatatcttgctgggagtggacttttccagtaaggaaagtaaaagctgcaccattgggatggttctccgactgtggagcgacacgaaaatccaccttgatggagatggtgggttcagcgtgagcacagcaggaaggatgcacatatttaagcctgtgtctgtccaggccatgtggtctgccctgcaggtgcttcacaaggcctgcgaagtggcccggaggcacaactacttccccgggggtgtagctctcatctgggctacctactatgagagctgcatcagctccgagcagagctgcatcaacgagtggaacgccatgcaggacctggagtctacgcggcccgactcccccgcgctatttgtggacaagcccactgaaggggaaaggaccgagcgcctcatcaaagccaagctccgaagcatcatgatgagccaggatctagaaaatgtgacttccaaagagattcgtaatgaattagagaaacagatgaattgtaacttgaaggaactcaaggaatttatagacaatgagatgctacttatcttgggacagatggacaagccctcccttatcttcgatcatctttatctcggctctgaatggaatgcatccaatctggaggaactgcagggctcaggggttgattacattttaaatgttaccagagaaatcgataatttttttcctggcttatttgcatatcataacatccgagtctacgatgaagagaccacagacctcctcgcccactggaatgaagcgtatcattttataaacaaagcgaagaggaaccattccaagtgcctggtgcattgcaaaatgggcgtgagtcgctcggcctccacagtcatagcctatgcaatgaaggaattcggctggcctctggaaaaagcatataactatgtaaagcagaagcgcagcatcacgcgccccaacgcgggctttatgaggcagctgtctgagtatgaaggcatcttggatgcaagcaaacagcggcacaacaagctgtggcgtcagcagacagacagcagcctccagcagcctgtggatgaccctgcaggacctggcgacttcttgccagagaccccagatggcaccccggaaagccagctgcccttcttggatgatgccgcccagcccggcttagggccccccctcccctgctgtttccggcgactctcagacccccttctgccttcccctgaggatgaaactggcagcttggtccacctggaggatccggagagggaggctctgttggaggaagctgctccacctgcagaggtgcacaggccggccagacagccccagcaaggttccggactctgtgagaaggatgtgaagaagaaactagagtttgggagtcccaaaggtcggagcggctccttgctgcaggtggaggagacggaaagggaggagggcctgggagcagggaggtgggggcagcttccaacccagctcgatcaaaacctgctcaactcggagaacctaaacaacaacagcaagaggagctgtcccaacggcatggaggatgatgctatatttgggatccttaacaaagtgaagccttcctataaatcctgtgccgactgcatgtaccctacagccagcggggctcctgaggcctccagggagcgatgtgaggaccccaatgctcccgccatctgcacccagccagccttcctaccccacatcacgtcctcccctgtggcccacttggccagcaggtcccgtgttccggagaagccagcctctggcccaaccgaacctcccccgttcctaccaccagcaggctccaggagggcagacaccagtggccctggggctggagctgccctagagccaccagccagccttttggaaccttccagagagaccccaaaagtcctgccaaagtccctccttttgaagaattctcactgtgataagaaccctcccagcacagaagtggtaataaaggaagaatcgtcacccaagaaagatatgaagccagccaaggacctgaggcttctgttcagtaatgaatctgagaagccgacaaccaacagctacctgatgcagcaccaggagtccatcattcagctgcagaaggcaggcttggtccgcaagcacaccaaagagctagagcggctgaagagcgtgcctgcagacccagcacctccctccagggatggccctgccagcaggctggaggccagcatccccgaggagagccaggatccagccgcgctccacgagctgggccccctggttatgcccagccaggccgggagtgatgagaagtcagaggccgcccccgcttcattggaaggaggctcactgaagagcccccctcctttcttctaccgcctggaccacaccagtagtttctcaaaagactttctgaagaccatctgctacacccccacctcctcttccatgagctccaacctgacccggagctccagcagcgatagcatccacagtgtccgtgggaagcccgggctggtgaagcagcggacacaggagattgagacccggctccggctggcgggcctcaccgtctcttccccactgaagcgctcacactctcttgccaagctggggagtctcaccttctcaacggaagacctgtccagtgaggctgacccgtccaccgtcgctgactcccaggacaccactttgagtgaatcttccttcttgcatgagccccagggaaccccgagggacccagctgcaacctccaaaccatcagggaaacccgccccagaaaacttaaagagcccttcgtggatgagcaaaagctgacccgccttttgctgcgtcaggctgggcggatattttcatatgatccctccctcactttcactgtggatttggatcgaccccttacatcttgatttcccttaaacgagtgaagtcatcctaacttttcccctactcttgccatagagaggaggagaagaaactaaccaacatgcagcacaagaaggggagctgtcagtcgtgtggcctgggagaaccaggagccgccggccaggagacacaaaactccgctcccaccgtgtcttcaagaagaaccatgttttaggaagaacgtgcacacataggcgcacacatccagactgttcccttcgcatcctgcagaagagtcctggtggtggcagcctcaccgcggcacacgttctagctcattcttggcctcgcagaaaactctcggatggcaacattaagtcctacctctgttctcgctgcgctttttatttttaaaacacacgaatgaccaaggcttgttccagggaataatgctctgtctgaaagcgtttttccaaaaaaagaatttttcgttttgtgttttggttgggaccccagacgtgtcaagacttttaacccgacagccccaagcactgctgagtaaagtcatcagatgagtagtcccacgctgttgttgagctgactctgtgcccgaatggtggtgcaggcgccctgtcctggttgtgttgttacgtgtttgaccagcacaggggtccggtggggaaaatgtatgggttgttctcagttgttgctaatgctgaagtttaaatctcaaggggaagggcccacctgcattgttgagtgtctgctgctgaaacacatgattgtgtttaggtttgaaattgctcaagtgtctggctcaggtggtggttctgagacacatcgtcctgctgagagcccagatgcttaggtccactagggcccatctagggaagggaaaggagatttcagcggcttccccgaaaggaacgggactgtcgggatgcttcccggatgtctacagttgccccttcctgcagtgagattactgcttcctgtttccctccagctcttcccagcagcagtgagggagtataagagggatctgtagtcgctgcctggctctgtgggcggcccctttaagactcaggtgagctcagccagtcccgctgcgccaggcttgaatcaaaggtgtcagcaagctagatgtcaaaacatttcgagagagaggcagcttgcagaaaagcagaaaggttgaattcaggggtcagcaaactatggcatgtggccccgtgagctaggaatggtttttcctctttaagacagggcctggctctgtcacctaggctggagtacagtagtgcaatcatgactcactgcagcatcaacctccctggctcaagcgatggcttttacctttttaaggagttgtaaaaaaaagaaataatatgtgacagaattcatgtggcccacaaagcctgaggtacttactgtcaggccctttgtagaaaaagttgctgacccctggtttgatttgccacacagggctgctcatggccctgtaggaagaaactgggtaaatgtgaagccctctgcctctctgacacctaaggccagacccttccctcctcccgaccacaagctttgccagccccgcactagcctcacctgtgcaggatggagtaggttgcgtacatgggggaaggcaggtgaacacagttggctgaagctcttccacaattccatcttgccctcagctgggtccgccagattaactcagtgaaaccagaaagccttcaaggaccagctgaattctgaaagtgagtgagtgagccatcatcttaacattggccagaactgtgttccccaaagctattctagaaagcaccccaggagggatctgcaggaacaaggctagttcatattttacctagtgagcacagtttttgcaaaaatcctccctccaggactttgtctccttggagtgatttttaaaaatacatacattactttatagggagctgttttcccactagtgtcaattaaaatcaccttaaaaggtgattatccacttattcctaaacccctgtgggttgttccccctttccctcagccaacaaaagcatagcctcaaaaaatatcaagttcggtatgttttgccaaatcaaatttcatgtggtagatcaatttttgtgtcaaaataatcttttaaatttagtgatgacaggcttttgttggttttttaaccacgtctatgtatgagaatgatatatttttgaaaactttaattttgaaagccataatttttcttatctaaagagttggggggtggggtgtggaatctggagagtacaagttggtctttggcttctggcaaacttacccattcatttttggaagcacagctagcatatcaacatccagacgagagcgctggtcccgtccacagagcagagtgaagcattctggacttgatgcttaatagcctggcctggagaaaagggtaaggtttatttttggaaacccagatcagttgcatgtaaacagatggcacatggctatttaaaatgctgtatgatggggccgggcgcggtggctcacgcctgtaatcctagcactttgggaggccgaggcaggcggatcatctgaggtcaggagttctagaccagcctggccaacatggtgaaaccccgtctctactaaaaatacaaaaacttagctgggtgtggtagtgcgtgcctgtaatcctagctacttaggaggctgaggcaggagaatcgcttgaacctgggtggcggaggttgcaatgagccgagatcgcgccactgcactccagcctgggtgcaatgaaactgggagtgaaactccgtctcaaaaaaataaaatgctgtatgaacaagatgagcattctgtcaggtgtcgggacacctgggcaaagacgaattcatgctgtctgtgaaaaggaagtttgcactgtaacatatgccatagcttggcccttgctttgtatgcaaccttagctgatggggaaaattccaaacataagtggcacaggaaagaggcaggcagaggaggcaggggtctgtgctgtgcaagtcactggttttttatgactatcattttcattgaatgcatttgttgaattgggacaaaaggaacattttctaaatcagcttgatactctttataaaaaacagctgaatcttatcttctgcctcacattaattcatgtggcatgccaaaagttagactgaacttttctacatcttcaccttgcattgatacaggaaagtcttctctttaagtcttgctaagtataagggggatagtggtcacgggaagaggagaaccggggctgctctcggatggtaattgacaatgccgatttccatttctttgtcttacggctacttccgagccttctagcaaggtccctggttgcatgtatttcctaagagcagagtttatttctctttacattccctgcttccttgctctccatgcagggaccccagccaacctctgggctgttgaatagctctctgctgggtggcaagcccttctccttggcaccctgttgcttaagcatacagattgctcaccaggtgcacacagacagctgtactgtccaagcccattctgctccaccctgtcctcttcagctaaagagcattccagtaatctaaagcccttttcccctggagaagtccagagtttgcagcagtgtggagctgagcttgaacagaacagaccctcagcacggccctggactaatgcactcttatctgagggcagtccattctagaaggttgatgaatttccctaccactctcctggggaccttttctctctagtgggaacaaatgctacataatttagtcaagatcctattaagtcatctcacctgaggcatctggagagggagttgccttccattggtgggaaattgttggtgccagaatacattttgcccaaaactcttctcattggctggccacctagcagggctcctctaaacacgcaactcagcgaggggacccccttcacctctggcaagagagctgggtagatcagaaacttggtgacacctggctagcacagagcaggctcacttgtcttggtcccactacccagattcctgcagacattgcaaaccaaatgaaggttgttgaatgacccctgtccccagccacttgttttgttatcatctgctctgcagtggaatgcctgtgtgtttgagttcactctgcatctgtatatttgagtatagaaaccgagtcaagtgatcatgtgcatccagacacactgtgtcacctgagccacagagcaaatcaccttaacgatctggaatgaaactgtgaccagtgccgccctgggtggttctggagagactgccgtcttcttgtttggccataggtgctggggccccggcttcagtcactgtctcagacaggagtcccgataagcagatcaccagtcctccactgtccttcctgtcggccttgctgcatgagaagatagctgcttcctccctcttttcctacactgtaattattgttttacaattgagtgccttaataatagtttacaaatactatgtatttatgcaaaactgttaaagtctcatctgttatgattggatacttggtcttgtcagtagtggtcagcattgggttgtgagcttgtcctactccatacgtgtttatcctgctatgcagttttacattgtgtgttcacatctattccaaggagccttgctagaaacaacactggcggttcctgcaggccaggcaggcattggcccatgctgtgtcccataggagccaatgaaagaacgtagcttggtctgctagccagccgtggggtggcgcaggccaggcagcctctgcaccagagtccagcacctgcccattccccagtcacacaatcatactcttctttcatagagattttattaccacctagaccaccctagttttcctctctgttagtgtcctgagctcttttgcaacaaaatgtaggtacagaccaatccctgtcccttccccaatcaggagctccacaccatgagttgtttggttttccagaagctgccagtgggttcccgtgaattgcgttaagatatcgatgattttttttattgtttttcttcttgtttttttaaataatatatttaaaggcagtatcttttgtactgtgaatttgcagtagaagatgcagaatgcactttttttttacttctgttggtgtgtattgtatatagtgtgtgtgcttcttgtgatgaaaataaactttttctttataaattcctgatgactgagtttatataaaaggaaactgcttcctcagcccttgccaaaacagtctgatacatcgtcatcatcatcgtcattgacatggccagtctttattgagcatctattacatgctcagttctttgctagaaaacctggacaagttacaccaaagaaaggaccacaggaagaaatgatagttcctcctggaactagtctgttttctttctaattttgtcagtaagcaagaacaggcccacctgtgggtggtcctttgtgtaccaaaaaaaaaaagttacccaccaggaaaggatttggactttgggtgggttctcttcccgtacaagtaggaaatgtaaagccagaggtgtgcactaaagaacatctaacctgctcccaccagccctggtgggagagggaggaccctggaggctaagtactgctggtttccaaggtgcatgctcatgtcccagtccacttcaccccaggcagcttttggtggctcttctcccttggacactcaggaggcagagctgcttccatttttttttttttaatttttttttttttttttttgagactgggtctggctctcttgctcaggctggagttcagtggtgccatcatagctcactgcaacctcgacttcctaggctaaagtgatcctcctgcctcaagcaatcctcccacctcagcctccccagtagctgggactacaggcgtgcaccaccttgccccgctaatttttacaatttattatagacatgaagtctcgctttgctgcccaggctggtctttaattcctgtcttcaagtgatcctcccaccttggcctcccaaagtgctgggattacaggtgtgagccacctcaacttccatcttaaaattctgcctccttagagttctttgctttctgctgtgtagtcagggaggagtcacattcactcagtctcctctgtctggatgcgatacatcatttctacttgctttccagtgggcagggcccagtcacagggtcccaatgcaacagccagggagactgggaaatgtatggggcacatgtatttggtgagcactaactgtcacaagtacctgggcgtgacccctaaattccagtgcctgcagagccaggaagtattttgttcagttcatctggacttgctctgtctctcaactggactcaaaagactgatgaataaaccagaatgcaagtttattactttaccaaaagaattataatcatcaagcagaccagattgctcacatgctgattagcacatttagtcctgctaggtaagtctttctttttttgagacagcctggagtgcagtggcagtcatggctcactgaagtgttgatctcctgggctccagcaatcctgcctcagcctcccaagtagctgggaccagagccacacactgctgcacccagctaaatttatttatttatttatttaaaagatagggtctcactatgttgcccagactggtcttgaactcctggtttctgatgatcctcctgcctcagcctcccaaagtgttgagattataggcatgagccactgtgcccagccccttctaggtaaatctctatggggtgccaaattttggttaagaattgcttattgaatattaaaagtttagtgggatgcttcttttttttttttcttttgagatggagtttagctcttgttgcccagactggagtgcaatggtgtgatctcagctcaccgcaacctctgcctcctgggttcaagtgattttcctgcctcagcctcccgagtagctgggaatacaggcatgtgccaccacgcctggctaattttgtatttttaatcgaaatggggtttctccatgttggtcaggctgttctcaaactcccaacctcaggtaatccacccgccttggcctcccaaagtgctgggattataggcatgagccaccgcgccaagccacaggatgcttctaatagtgttatcaagctataatgcagccctctctgtaaaatgttttaaaaacaaatcactgagggtcatggttcaagacactgttctctggcaaggttgaagatagctaacaaattctctttgggttccagccatgaatggggtgggatgggccccagcaatctgtatgtttctgagattccctgggaattctgatggccaagtttagaaaccatcaaaataagaatatgatgcaactgagtaggctcacgctttgctaattacattgcacacatgctttttggagacaacacccacactaccctaacaatgtgtgttcataaaactcatccgatacttatttgttcaaggccctaggacaatattcctgtaatgggctgcttttgccctgatttcctcctcagagtaactgtctcgcggttgggcacgatcccagatcacatctacagtggaggtggttttgctggggaggatccgcatgcttgtttgtgtttatgcctggggaaccccctcttggcaagatgttcgggagaggctccaaaggcagcacagaggacggcttggaacttagggggattcactttatggtaaagaagccctttctaaaggagagctccacccaggaaacaccacccacccacgcatccttgcctcctaaaaccaggttatgtttatcacataccttctatgtgctttacataaagaatcccctggaattctccaaactgggcattgtggtctgtgatgcatatctcaaaagaggtgagagggttgggcacggtggctcacgcctgtaatcccagcactttgggaagccaaggcaggtggatcacttgaggtcagaagctcaagaccagcctggctcacatggtgaaacgccgtctcaactaaaaatacaaaaattagccgggcatgatggcgggcgcctgtaatcccagctactcgggaggctgaggcaggagaatcgcttgaacccaggaggtggaggttgctgtgagccaagattgcaccactgcactccagcctgggtgacagagtgagactctgtctcaaaaaacaaaaaaaagaaaaaaaaaggtagaggagagtcctttttctaactttcttgaactctttggactaccttgggatccttctattaactgccttgttggcattattctcagtttatgaaaaaacaggcccacagagtggaagtaatttgcctacaggtacatctaaaaattgatgaagccagataggaactgctccctcatcatctgaaacccttcccagagctgtctctcccaccccagaagtagaaagaagccagacaaagatgcatcttgatctcccttgtggtttcagcaaggaagcagatgagttggagatgaagcccccagcccctgggaaattggacccacttcttgctccaaaggctattggggtgacacaaggtgtgtttctttcccgtagatcatattcaccatattttgcctttaaatggaaattgtgcatcctgaagtaccttgttaagagtccattttcaacctgaaattccttttttttgtaaaccacttcagcaaatacagtgtggcatttacattagcaacctcccagcctaggagaggatgctccagcatccgactctaaaagacaaatttgggcacggtggcttgacgcctgttatcccaacaccttgagaggccgaggcaggcagattgcttgagcccaggagttcaagaccagcccaggtaacatggtgaacccccatctctaccaataatacaaaaattagccaggcatggtggtgtgccagtggtcccagctacttgagtggctgaggtgaaggatctcctgagcctgggaggcagaggttgcagtgagccgagatcgaaccactgcactccagcttatgcaacagagcaagaccgtgtctcaaaaacaaataaaaataaaagattttaaaaagacaaattatcccacaaatggtacattgtggtggtggtggtggtggtggtggtagacctccctcttgctcttgaaattggatcagaacaaactgacaatgctacctacttcatggggtcattggtgaattcactgataatgcatgcaaatccccttctgcctggcacactacctaataaataaatggtggttgttattgttggaattggaggatatattcctagttgcaagggtttcacatgtattaccaagttaatcctcaccgcagatatgattctgttttacagaggaagcagtggatgctcagagaggttaggtaacgtgggtcagggacacacagccaggaaggggcagaggctgggagtgcctgactccaaattcatgcaatttctaccccaccatcttctccccaaggaaaatagtccctaatgcatgtgtgcaatgcttagagggcagtagatgctcaacagatgctgagagagtgagggagtaaatgagatatgccatgaaaaggagcccctgtggacttatgcgtgcgtttgtttaacttgtgggcaagtacttatagacaggtgcaaacaataaatctccttttgcaactg

SEQ ID NO: 20449 - DNA, 5621 bp, Homo sapiens
  ENST00000546433
acgccatgcaggacctggagtctacgcggcccgactcccccgcgctatttgtggacaagcccactgaaggggaaaggaccgagcgcctcatcaaagccaagctccgaagcatcatgatgagccaggatctagaaaatgtgacttccaaagagattcgtaatgaattagagaaacagatgaattgtaacttgaaggaactcaaggaatttatagacaatgagatgctacttatcttgggacagatggacaagccctcccttatcttcgatcatctttatctcggttgattacattttaaatgttaccagagaaatcgataatttttttcctggcttatttgcatatcataacatccgagtctacgatgaagagaccacagacctcctcgcccactggaatgaagcgtatcattttataaacaaagcgaagaggaaccattccaagtgcctggtgcattgcaaaatgggcgtgagtcgctcggcctccacagtcatagcctatgcaatgaaggaattcggctggcctctggaaaaagcatataactatgtaaagcagaagcgcagcatcacgcgccccaacgcgggctttatgaggcagctgtctgagtatgaaggcatcttggatgcaagcaaacagcggcacaacaagctgtggcgtcagcagacagacagcagcctccagcagcctgtggatgaccctgcaggacctggcgacttcttgccagagaccccagatggcaccccggaaagccagctgcccttcttggatgatgccgcccagcccggcttagggccccccctcccctgctgtttccggcgactctcagacccccttctgccttcccctgaggatgaaactggcagcttggtccacctggaggatccggagagggaggctctgttggaggaagctgctccacctgcagaggtgcacaggccggccagacagccccagcaaggttccggactctgtgagaaggatgtgaagaagaaactagagtttgggagtcccaaaggtcggagcggctccttgctgcaggtggaggagacggaaagggaggagggcctgggagcagggaggtgggggcagcttccaacccagctcgatcaaaacctgctcaactcggagaacctaaacaacaacagcaagaggagctgtcccaacggcatggaggatgatgctatatttgggatccttaacaaagtgaagccttcctataaatcctgtgccgactgcatgtaccctacagccagcggggctcctgaggcctccagggagcgatgtgaggaccccaatgctcccgccatctgcacccagccagccttcctaccccacatcacgtcctcccctgtggcccacttggccagcaggtcccgtgttccggagaagccagcctctggcccaaccgaacctcccccgttcctaccaccagcaggctccaggagggcagacaccagtggccctggggctggagctgccctagagccaccagccagccttttggaaccttccagagagaccccaaaagtcctgccaaagtccctccttttgaagaattctcactgtgataagaaccctcccagcacagaagtggtaataaaggaagaatcgtcacccaagaaagatatgaagccagccaaggacctgaggcttctgttcagtaatgaatctgagaagccgacaaccaacagctacctgatgcagcaccaggagtccatcattcagctgcagaaggcaggcttggtccgcaagcacaccaaagagctagagcggctgaagagcgtgcctgcagacccagcacctccctccagggatggccctgccagcaggctggaggccagcatccccgaggagagccaggatccagccgcgctccacgagctgggccccctggttatgcccagccaggccgggagtgatgagaagtcagaggccgcccccgcttcattggaaggaggctcactgaagagcccccctcctttcttctaccgcctggaccacaccagtagtttctcaaaagactttctgaagaccatctgctacacccccacctcctcttccatgagctccaacctgacccggagctccagcagcgatagcatccacagtgtccgtgggaagcccgggctggtgaagcagcggacacaggagattgagacccggctccggctggcgggcctcaccgtctcttccccactgaagcgctcacactctcttgccaagctggggagtctcaccttctcaacggaagacctgtccagtgaggctgacccgtccaccgtcgctgactcccaggacaccactttgagtgaatcttccttcttgcatgagccccagggaaccccgagggacccagctgcaacctccaaaccatcagggaaacccgccccagaaaacttaaagagcccttcgtggatgagcaaaagctgacccgccttttgctgcgtcaggctgggcggatattttcatatgatccctccctcactttcactgtggatttggatcgaccccttacatcttgatttcccttaaacgagtgaagtcatcctaacttttcccctactcttgccatagagaggaggagaagaaactaaccaacatgcagcacaagaaggggagctgtcagtcgtgtggcctgggagaaccaggagccgccggccaggagacacaaaactccgctcccaccgtgtcttcaagaagaaccatgttttaggaagaacgtgcacacataggcgcacacatccagactgttcccttcgcatcctgcagaagagtcctggtggtggcagcctcaccgcggcacacgttctagctcattcttggcctcgcagaaaactctcggatggcaacattaagtcctacctctgttctcgctgcgctttttatttttaaaacacacgaatgaccaaggcttgttccagggaataatgctctgtctgaaagcgtttttccaaaaaaagaatttttcgttttgtgttttggttgggaccccagacgtgtcaagacttttaacccgacagccccaagcactgctgagtaaagtcatcagatgagtagtcccacgctgttgttgagctgactctgtgcccgaatggtggtgcaggcgccctgtcctggttgtgttgttacgtgtttgaccagcacaggggtccggtggggaaaatgtatgggttgttctcagttgttgctaatgctgaagtttaaatctcaaggggaagggcccacctgcattgttgagtgtctgctgctgaaacacatgattgtgtttaggtttgaaattgctcaagtgtctggctcaggtggtggttctgagacacatcgtcctgctgagagcccagatgcttaggtccactagggcccatctagggaagggaaaggagatttcagcggcttccccgaaaggaacgggactgtcgggatgcttcccggatgtctacagttgccccttcctgcagtgagattactgcttcctgtttccctccagctcttcccagcagcagtgagggagtataagagggatctgtagtcgctgcctggctctgtgggcggcccctttaagactcaggtgagctcagccagtcccgctgcgccaggcttgaatcaaaggtgtcagcaagctagatgtcaaaacatttcgagagagaggcagcttgcagaaaagcagaaaggttgaattcaggggtcagcaaactatggcatgtggccccgtgagctaggaatggtttttcctctttaagacagggcctggctctgtcacctaggctggagtacagtagtgcaatcatgactcactgcagcatcaacctccctggctcaagcgatggcttttacctttttaaggagttgtaaaaaaaagaaataatatgtgacagaattcatgtggcccacaaagcctgaggtacttactgtcaggccctttgtagaaaaagttgctgacccctggtttgatttgccacacagggctgctcatggccctgtaggaagaaactgggtaaatgtgaagccctctgcctctctgacacctaaggccagacccttccctcctcccgaccacaagctttgccagccccgcactagcctcacctgtgcaggatggagtaggttgcgtacatgggggaaggcaggtgaacacagttggctgaagctcttccacaattccatcttgccctcagctgggtccgccagattaactcagtgaaaccagaaagccttcaaggaccagctgaattctgaaagtgagtgagtgagccatcatcttaacattggccagaactgtgttccccaaagctattctagaaagcaccccaggagggatctgcaggaacaaggctagttcatattttacctagtgagcacagtttttgcaaaaatcctccctccaggactttgtctccttggagtgatttttaaaaatacatacattactttatagggagctgttttcccactagtgtcaattaaaatcaccttaaaaggtgattatccacttattcctaaacccctgtgggttgttccccctttccctcagccaacaaaagcatagcctcaaaaaatatcaagttcggtatgttttgccaaatcaaatttcatgtggtagatcaatttttgtgtcaaaataatcttttaaatttagtgatgacaggcttttgttggttttttaaccacgtctatgtatgagaatgatatatttttgaaaactttaattttgaaagccataatttttcttatctaaagagttggggggtggggtgtggaatctggagagtacaagttggtctttggcttctggcaaacttacccattcatttttggaagcacagctagcatatcaacatccagacgagagcgctggtcccgtccacagagcagagtgaagcattctggacttgatgcttaatagcctggcctggagaaaagggtaaggtttatttttggaaacccagatcagttgcatgtaaacagatggcacatggctatttaaaatgctgtatgatggggccgggcgcggtggctcacgcctgtaatcctagcactttgggaggccgaggcaggcggatcatctgaggtcaggagttctagaccagcctggccaacatggtgaaaccccgtctctactaaaaatacaaaaacttagctgggtgtggtagtgcgtgcctgtaatcctagctacttaggaggctgaggcaggagaatcgcttgaacctgggtggcggaggttgcaatgagccgagatcgcgccactgcactccagcctgggtgcaatgaaactgggagtgaaactccgtctcaaaaaaataaaatgctgtatgaacaagatgagcattctgtcaggtgtcgggacacctgggcaaagacgaattcatgctgtctgtgaaaaggaagtttgcactgtaacatatgccatagcttggcccttgctttgtatgcaaccttagctgatggggaaaattccaaacataagtggcacaggaaagaggcaggcagaggaggcaggggtctgtgctgtgcaagtcactggttttttatgactatcattttcattgaatgcatttgttgaattgggacaaaaggaacattttctaaatcagcttgatactctttataaaaaacagctgaatctt

SEQ ID NO: 20450 - DNA, 2354 bp, Homo sapiens
  ENST00000551165
cggctccaggaggccccgggcccggcccgggcggcggtggcggtggcggctctagctcgagacgtctgtggcgccctcgcaccgcgccgcagccatggccctggtgaccctgcagcgctcgcccacgcccagcgccgcctcctcctcggccagcaacagcgagttggaggctggcagcgaagaagatcgaaaattaaacctcagcttaagtgagagctttttcatggtgaaaggcgcagccctcttcttacaacagggaagcagccctcaaggccagcggagtcttcagcacccccacaagcatgcaggtgatctgcctcaacatcttcaggtgatgatcaaccttctgcgttgcgaagacagaatcaagctggcagtgcgcctggagagcgcctgggcggaccgggtccggtacatggtggtggtgtacagcagcgggcgccaggacaccgaggagaatatcttgctgggagtggacttttccagtaaggaaagtaaaagctgcaccattgggatggttctccgactgtggagcgacacgaaaatccaccttgatggagatggtgggttcagcgtgagcacagcaggaaggatgcacatatttaagcctgtgtctgtccaggccatgtggtctgccctgcaggtgcttcacaaggcctgcgaagtggcccggaggcacaactacttccccgggggtgtagctctcatctgggctacctactatgagagctgcatcagctccgagcagagctgcatcaacgagtggaacgccatgcaggacctggagtctacgcggcccgactcccccgcgctatttgtggacaagcccactgaaggggaaaggaccgagcgcctcatcaaagccaagctccgaagcatcatgatgagccaggatctagaaaatgtgacttccaaagagattcgtaatgaattagagaaacagatgaattgtaacttgaaggaactcaaggaatttatagacaatgagatgctacttatcttgggacagatggacaagccctcccttatcttcgatcatctttatctcggctctgaatggaatgcatccaatctggaggaactgcagggctcaggggttgattacattttaaatgttaccagagaaatcgataatttttttcctggcttatttgcatatcataacatccgagtctacgatgaagagaccacagacctcctcgcccactggaatgaagcgtatcattttataaacaaagcgaagaggaaccattccaagtgcctggtgcattgcaaaatgggcgtgagtcgctcggcctccacagtcatagcctatgcaatgaaggaattcggctggcctctggaaaaagcatataactatgtaaagcagaagcgcagcatcacgcgccccaacgcgggctttatgaggcagctgtctgagtatgaaggcatcttggatgcaagcaaacagcggcacaacaagctgtggcgtcagcagacagacagcagcctccagcagcctgtggatgaccctgcaggacctggcgacttcttgccagagaccccagatggcaccccggaaagccagctgcccttcttggatgatgccgcccagcccggcttagggccccccctcccctgctgtttccggcgactctcagacccccttctgccttcccctgaggatgaaactggcagcttggtccacctggaggatccggagagggaggctctgttggaggaagctgctccacctgcagaggtgcacaggccggccagacagccccagcaaggttccggactctgtgagaaggatgtgaagaagaaactagagtttgggagtcccaaaggtcggagcggctccttgctgcaggtggaggagacggaaagggaggagggcctgggagcagggaggtgggggcagcttccaacccagctcgatcaaaacctgctcaactcggagaacctaaacaacaacagcaagaggagctgtcccaacggcatggaggtaggcagagcccggcctgcagggtggcacaccccatcccttccatcccactctaattggcctacctcagcctctgtagtagggactacaggcacccgccaccacacccagctgatttttttctattgtctcctctgggcccccagctcccatctccagggacctgagggttctttcacagggtgattctgctggtgggtacgtagtgcataccttatatagcaaattgagaatctgttgggaataacacatatctctgcacaccatcttcaccccatgtaccttattcataccctgggcagggcttccaactcaatttctttttgtgtatgtaaaattaaaacatataatttatcagccaacttca

SEQ ID NO: 20451 - DNA, 2432 bp, Homo sapiens
  ENST00000326470
tttttcagccaaaatatcagaggaagacaagagttccacaagagccatttgcttttcgggtaggactctgaggaggagttggctccccagccctcgtggaagcactcggcagcctcctggcttttcctgatctccatagggagcagatggccagagctcggagggcagttgtagggagcgttagagatgtgagcactgcagccacgaacctcttttattttaccgacttctgcatcttccttcagccaacccactgcttctgctgtccagaggtttccagctcaaattacttaagtgagagctttttcatggtgaaaggcgcagccctcttcttacaacagggaagcagccctcaaggccagcggagtcttcagcacccccacaagcatgcaggtgatctgcctcaacatcttcaggtgatgatcaaccttctgcgttgcgaagacagaatcaagctggcagtgcgcctggagagcgcctgggcggaccgggtccggtacatggtggtggtgtacagcagcgggcgccaggacaccgaggagaatatcttgctgggagtggacttttccagtaaggaaagtaaaagctgcaccattgggatggttctccgactgtggagcgacacgaaaatccaccttgatggagatggtgggttcagcgtgagcacagcaggaaggatgcacatatttaagcctgtgtctgtccaggccatgtggtctgccctgcaggtgcttcacaaggcctgcgaagtggcccggaggcacaactacttccccgggggtgtagctctcatctgggctacctactatgagagctgcatcagctccgagcagagctgcatcaacgagtggaacgccatgcaggacctggagtctacgcggcccgactcccccgcgctatttgtggacaagcccactgaaggggaaaggaccgagcgcctcatcaaagccaagctccgaagcatcatgatgagccaggatctagaaaatgtgacttccaaagagattcgtaatgaattagagaaacagatgaattgtaacttgaaggaactcaaggaatttatagacaatgagatgctacttatcttgggacagatggacaagccctcccttatcttcgatcatctttatctcggctctgaatggaatgcatccaatctggaggaactgcagggctcaggggttgattacattttaaatgttaccagagaaatcgataatttttttcctggcttatttgcatatcataacatccgagtctacgatgaagagaccacagacctcctcgcccactggaatgaagcgtatcattttataaacaaagcgaagaggaaccattccaagtgcctggtgcattgcaaaatgggcgtgagtcgctcggcctccacagtcatagcctatgcaatgaaggaattcggctggcctctggaaaaagcatataactatgtaaagcagaagcgcagcatcacgcgccccaacgcgggctttatgaggcagctgtctgagtatgaaggcatcttggatgcaagcaaacagcggcacaacaagctgtggcgtcagcagacagacagcagcctccagcagcctgtggatgaccctgcaggacctggcgacttcttgccagagaccccagatggcaccccggaaagccagctgcccttcttggatgatgccgcccagcccggcttagggccccccctcccctgctgtttccggcgactctcagacccccttctgccttcccctgaggatgaaactggcagcttggtccacctggaggatccggagagggaggctctgttggaggaagctgctccacctgcagaggtgcacaggccggccagacagccccagcaaggttccggactctgtgagaaggatgtgaagaagaaactagagtttgggagtcccaaaggtcggagcggctccttgctgcaggtggaggagacggaaagggaggagggcctgggagcagggaggtgggggcagcttccaacccagctcgatcaaaacctgctcaactcggagaacctaaacaacaacagcaagaggagctgtcccaacggcatggaggtaggcagagcccggcctgcagggtggcacaccccatcccttccatcccactctaattggcctacctcagcctctgtagtagggactacaggcacccgccaccacacccagctgatttttttctattgtctcctctgggcccccagctcccatctccagggacctgagggttctttcacagggtgattctgctggtgggtacgtagtgcataccttatatagcaaattgagaatctgttgggaataacacatatctctgcacaccatcttcaccccatgtaccttattcataccctgggcagggcttccaactcaatttctttttgtgtatgtaaaattaaaacatataatttatcagcc

SEQ ID NO: 20452 - DNA, 625 bp, Homo sapiens
  ENST00000547862
gctggtctcgaactcctgacctcaagtgatctgcctaccttggcctcccaaagtgctgggattacaggcctgaaccaccatgcccagccaagaattttctcttcatttttaactcccagagggaaaggtagaacactgaaagtgttgatcttgcattggagatgggagggaggcaccacctccaaaggcaggttagtgagagcatgtctgccctgttccaggcagtgcgcctggagagcgcctgggcggaccgggtccggtacatggtggtggtgtacagcagcgggcgccaggacaccgaggagaatatcttgctgggagtggacttttccagtaaggaaagtgggttcagcgtgagcacagcaggaaggatgcacatatttaagcctgtgtctgtccaggccatgtggtctgccctgcaggtgcttcacaaggcctgcgaagtggcccggaggcacaactacttccccgggggtgtagctctcatctgggctacctactatgagagctgcatcagctccgagcagagctgcatcaacgagtggaacgccatgcaggacctggagtctacgcggcccgactcccccgcgctatttgtggacaagtaagtgaggtgcctctggtg

SEQ ID NO: 20453 - DNA, 602 bp, Homo sapiens
  ENST00000548522
cgcaccgcgccgcagccatggccctggtgaccctgcagcgctcgcccacgcccagcgccgcctcctcctcggccagcaacagcgagttggaggctggcagcgaagaagatcgaaaattaaacctcaggtgatctgcctcaacatcttcaggtgatgatcaaccttctgcgttgcgaagacagaatcaagctggcagtgcgcctggagagcgcctgggcggaccgggtccggtacatggtggtggtgtacagcagcgggcgccaggacaccgaggagaatatcttgctgggagtggacttttccagtaaggaaagtaaaagctgcaccattgggatggttctccgactgtggagcgacacgaaaatccaccttgatggagatggtgggttcagcgtgagcacagcaggaaggatgcacatatttaagcctgtgtctgtccaggccatgtggtctgccctgcaggtgcttcacaaggcctgcgaagtggcccggaggcacaactacttccccgggggtgtagctctcatctgggctacctactatgagagctgcatcagctccgagcagagctgcatcaacgagtggaacgccatgcaggacct

SEQ ID NO: 20454 - DNA, 476 bp, Homo sapiens
  ENST00000547381
ccaagtacacatgtggcctccgccagcagagcaccagccctgggcagctgcctccctgctgtagagtgggcgtgcggtcagcccacactgcacccaaaagcctcagctgagcacttacggagttgtgtccacagggccatcccagacctgtgtcttctagaattcatcagtgaacggttcctatgcagacagcctactcccacacgtacgtccaacagcccgtcctggaccaggtggtgagctggaaaggctgtacacgtaggtgggtagacgctgactccacatgtcttctctcccccatcgcagtaaaagctgcaccattgggatggttctccgactgtggagcgacacgaaaatccaccttgatggagatggtgggttcagcgtgagcacagcaggaaggatgcacatatttaagcctgtgtctgtccaggccatgtggtctgccctgcaggtgcttcacaaggcctgcgaag

SEQ ID NO: 20455 - DNA, 583 bp, Homo sapiens
  ENST00000546697
aacatggaggaggaacagctggccttgtaagtgatcacagagtgaaaccagcctagtctgttgcattgttcctttttttttccaaaggaaatataagggaaaccaaggggaatttttgctcatggtttccaaggcaaaggtcatcgttaatggttggctgtttccagcgtgcttgggtttctgcttaagtgagagctttttcatggtgaaaggcgcagccctcttcttacaacagggaagcagccctcaaggccagcggagtcttcagcacccccacaagcatgcaggtgatctgcctcaacatcttcaggtgatgatcaaccttctgcgttgcgaagacagaatcaagctggcagtgcgcctggagagcgcctgggcggaccgggtccggtacatggtggtggtgtacagcagcgggcgccaggacaccgaggagaatatcttgctgggagtggacttttccagtaaggaaagtaaaagctgcaccattgggatggttctccgactgtggagcgacacgaaaatccaccttgatggagatggtgggttcagcgtgagcacagcaggaaggatgcacatattt

SEQ ID NO: 20456 - DNA, 588 bp, Homo sapiens
  ENST00000546812
gttacttgattgtcgtgggggaacagaggcagagtgttccagggccccaatcaatgccatcctgacttcatgcgtagagcaggagtccctgattcttatcagtgtaggaacatggaggaggaacagctggccttgtaagtgatcacagagtgaaaccagcctagtctgttgcattgttcctttttttttccaaaggaaatataagggaaaccaaggggaatttttgctcatggtttccaaggcaaaggtcatcgttaatggttggctgtttccagcgtgcttgggtttctgcttaagtgagagctttttcatggtgaaaggcgcagccctcttcttacaacagggaagcagccctcaaggccagcggagtcttcagcacccccacaagcatgcaggcagtgcgcctggagagcgcctgggcggaccgggtccggtacatggtggtggtgtacagcagcgggcgccaggacaccgaggagaatatcttgctgggagtggacttttccagtaaggaaagtaaaagctgcaccattgggatggttctccgactgtggagcgacacgaaaatccaccttgatggagatgggt

SEQ ID NO: 20457 - DNA, 4295 bp, Homo sapiens
  ENST00000267377
tggtcatcgcacggcggcagctcctcacctggatttagaagagctggcgtccccgcccgcccaagcctttaaactctcgtctgccagaacccgccaactctccaggcttagggccagtttccgcgattctaagagtaattgcgtgggcacctgtgctggggccaggcgcaaagaagggagttggtctgcgcgaagatcgtcaacctgctaacagaccgcacatgcactttgcaccgaccatctacgtctcagtctggaggttgcgcactttggctgctgacgcgctggtggtgcctattaatcatttaccagtccagagccgcgccagttaatggctgtgccgtgcggtgctcccacatcctggcctctcctctccacggtcgcctgtgcccgggcaccccggagctgcaaactgcagagcccaggcaaccgctgggctgtgcgccccgccggcgccggtaggagccgcgctccccgcagcggttgcgctctacccggaggcgctgggcggctgtgggctgcaggcaagcggtcgggtggggagggagggcgcaggcggcgggtgcgcgaggagaaagccccagccctggcagccccactggcccccctcagctgggatgttccccaatggcaccgcctcctctccttcctcctctcctagccccagcccgggcagctgcggcgaaggcggcggcagcaggggccccggggccggcgctgcggacggcatggaggagccagggcgaaatgcgtcccagaacgggaccttgagcgagggccagggcagcgccatcctgatctctttcatctactccgtggtgtgcctggtggggctgtgtgggaactctatggtcatctacgtgatcctgcgctatgccaagatgaagacggccaccaacatctacatcctaaatctggccattgctgatgagctgctcatgctcagcgtgcccttcctagtcacctccacgttgttgcgccactggcccttcggtgcgctgctctgccgcctcgtgctcagcgtggacgcggtcaacatgttcaccagcatctactgtctgactgtgctcagcgtggaccgctacgtggccgtggtgcatcccatcaaggcggcccgctaccgccggcccaccgtggccaaggtagtaaacctgggcgtgtgggtgctatcgctgctcgtcatcctgcccatcgtggtcttctctcgcaccgcggccaacagcgacggcacggtggcttgcaacatgctcatgccagagcccgctcaacgctggctggtgggcttcgtgttgtacacatttctcatgggcttcctgctgcccgtgggggctatctgcctgtgctacgtgctcatcattgctaagatgcgcatggtggccctcaaggccggctggcagcagcgcaagcgctcggagcgcaagatcaccttaatggtgatgatggtggtgatggtgtttgtcatctgctggatgcctttctacgtggtgcagctggtcaacgtgtttgctgagcaggacgacgccacggtgagtcagctgtcggtcatcctcggctatgccaacagctgcgccaaccccatcctctatggctttctctcagacaacttcaagcgctctttccaacgcatcctatgcctcagctggatggacaacgccgcggaggagccggttgactattacgccaccgcgctcaagagccgtgcctacagtgtggaagacttccaacctgagaacctggagtccggcggcgtcttccgtaatggcacctgcacgtcccggatcacgacgctctgagcccgggccacgcaggggctctgagcccgggccacgcaggggccctgagccaaaagagggggagaatgagaagggaaggccgggtgcgaaagggacggtatccagggcgccagggtgctgtcgggataacgtggggctaggacactgacagcctttgatggaggaacccaagaaaggcgcgcgacaatggtagaagtgagagctttgcttataaactgggaaggctttcaggctacctttttctgggtctcccactttctgttccttcctccactgcgcttactcctctgaccctccttctattttccctaccctgcaacttctatcctttcttccgcaccgtcccgccagtgcagatcacgaactcattaacaactcattctgatcctcagcccctccagtcgttatttctgtttgtttaagctgagccacggataccgccacgggtttccctcggcgttagtccctagccgcgcggggccgctgtccaggttctgtctggtgcccctactggagtcccgggaatgaccgctctccctttgcgcagccctaccttaaggaaagttggacttgagaaagatctaagcagctggtcttttctcctactcttgggtgaaggtgcatctttccctgccctcccctgtccccctctcgccgcccgcccgccaccaccactctcactccacccagagtagagccaggtgcttagtaaaataggtcccgcgcttcgaactccaggctttctggagttcccacccaagccctcctttggagcaaagaaggagctgagaacaagccgaatgaggagtttttataagattgcggggtcggagtgtgggcgcgtaataggaatcaccctcctactgcgcgttttcaaagaccaagcgctgggcgctcccgggccgcgcgtctgcgttaggcagggcagggtagtgcagggcacaccttccccggggttcggggttcggggttcggttgcagggctgcagcccgccttggctttctccctcacccaagtttccggaggagccgacctaaaagtaacaatagataaggtttcctgctccagtgtatctcaaaagaccgggcgccaggggcgggggacctagggcgacgtcttcagagtccgccagtgttggcggtgtcgccgcaacctgcaggctcccgagtggggcctgcctggtctctagagggttgctgcctttcaagcggtgcctaagaagttattttcttgtttaacatatatatttattaatttatttgtcgtgttggaaaatgtgtctctgctttccttttctctgcttgcctagccccaggtcttttctttgggaccctgggggcgggcatggaagtggaagtaggggcaagctcttgccccactccctggccatctcaacgcctctcctcaatgctgggccctcttatctcatcctttcctctagcttttctatttttgattgtgttgagtgaagtttggagatttttcatacttttcttactatagtctcttgtttgtcttattaggataatacataaatgataatgtgggttatcctcctctccatgcacagtggaaagtcctgaactcctggctttccaggagacatatataggggaacatcaccctatatataatttgagtgtatatatatttatatatatgatgtggacatatgtatacttatcttgctccattgtcatgagtccatgagtctaagtatagccactgatggtgacaggtgtgagtctggctggaacactttcagtttcaggagtgcaagcagcactcaaacctggagctgaggaatctaattcagacagagactttaatcactgctgaagatgcccctgctccctctgggttccagcagaggtgattcttacatatgatccagttaacatcatcactttttttgaggacattgaaagtgaaataatttgtgtctgtgtttaatattaccaactacattggaagcctgagcagggcgaggaccaataattttaattatttatatttcctgtattgctttagtatgctggcttgtacatagtaggcactaaatacatgtttgttggttgattgtttaagccagagtgtattacaacaatctggagatactaaatctggggttctcaggttcactcattgacatgatatacaatggttaaaatcactattgaaaaatacgttttgtgtatatttgcttcaacaactttgtgctttcctgaaagcagtaaccaagagttaagatatccctaatgttttgcttaaactaatgaacaaatatgctttgggtcataaatcagaaagtttagatctgtcccttaataaaaatatatattactactcctttggaaaatagatttttaatggttaagaactgtgaaatttacaaatcaaaatcttaatcattatccttctaagaggatacaaatttagtgctcttaacttgttaccattgtaatattaactaaataaacagatgtattatgctgttgcaa

SEQ ID NO: 20458 - DNA, 530 bp, Homo sapiens
  ENST00000579323
tcccagcggcgcagccacccatgcgcgcgcgctcgcaagaccaccagcgcccagagccccagtctgaggcttggcgccgggggtctgcgggcgaggggagctctctacgtgcgaggggctagcgggagccggcacaagagggtcgaggagccaggaaccccaaacgtccggcgccaggcgctagccaagctgctgcgcgccccggcgcccagctggctcggggacagccgctgggtgtcggagaccggagctagcggattgcagcggaaaagcaaagcaaggaagtaacacaggagtcagttgcttcaaaccaaagcccagttatcagccgttcggtctctaggccactgaggagcagaggggatgccttgagacgtgcaaaagacttggggccaggtggcctgtgttcacatcccagctccaccaattatgtgcaagagaatgggatgtcacactggatccttggcctccagggtccattaaggtgagaataagatctctgggctggctggaactagcctaagactgaa

SEQ ID NO: 20459 - DNA, 7683 bp, Homo sapiens
  ENST00000357585
tcccagcggcgcagccacccatgcgcgcgcgctcgcaagaccaccagcgcccagagccccagtctgaggcttggcgccgggggtctgcgggcgaggggagctctctacgtgcgaggggctagcgggagccggcacaagagggtcgaggagccaggaaccccaaacgtccggcgccaggcgctagccaagctgctgcgcgccccggcgcccagctggctcggggacagccgctgggtgtcggagaccggagctagcggattgcagcggaaaagcaaagatgtcacactggatccttggcctccagggtccattaaggtgagaataagatctctgggctggctggaactagcctaagactgaaaagcagccatggacatggcggatgagccactcaatggaagccacacatggctatccattccatttgacctcaatggctctgtggtgtcaaccaacacctcaaaccagacagagccgtactatgacctgacaagcaatgcagtcctcacattcatctattttgtggtctgcatcattgggttgtgtggcaacacacttgtcatttatgtcatcctccgctatgccaagatgaagaccatcaccaacatttacatcctcaacctggccatcgcagatgagctcttcatgctgggtctgcctttcttggctatgcaggtggctctggtccactggccctttggcaaggccatttgccgggtggtcatgactgtggatggcatcaatcagttcaccagcatcttctgcctgacagtcatgagcatcgaccgatacctggctgtggtccaccccatcaagtcggccaagtggaggagaccccggacggccaagatgatcaccatggctgtgtggggagtctctctgctggtcatcttgcccatcatgatatatgctgggctccggagcaaccagtgggggagaagcagctgcaccatcaactggccaggtgaatctggggcttggtacacagggttcatcatctacactttcattctggggttcctggtacccctcaccatcatctgtctttgctacctgttcattatcatcaaggtgaagtcctctggaatccgagtgggctcctctaagaggaagaagtctgagaagaaggtcacccgaatggtgtccatcgtggtggctgtcttcatcttctgctggcttcccttctacatattcaacgtttcttccgtctccatggccatcagccccaccccagcccttaaaggcatgtttgactttgtggtggtcctcacctatgctaacagctgtgccaaccctatcctatatgccttcttgtctgacaacttcaagaagagcttccagaatgtcctctgcttggtcaaggtgagcggcacagatgatggggagcggagtgacagtaagcaggacaaatcccggctgaatgagaccacggagacccagaggaccctcctcaatggagacctccaaaccagtatctgaactgcttggggggtgggaaagaaccaagccatgctctgtctactggcaatgggctccctacccacactggcttcctgcctcccacccctcacacctggcttctagaatagaggattgctcagcatgagtccaattcagagaacggtgtttgagtcagcttgtctgattgaatgataatgtgctaaattgattacctcccccttaaagcgaacactgaaatgcaggtagacaattcaaagtctggagaagagggatcatgcctggatatgatctttagaaacaacaaaaatagaaaaaaataagtatctgtgtgtttgtgtattgaaaactcaatatgtaatcttgtgtttttatatgtatacttgtatattcctatttattctctgtataggcattacctacgttcctgtgtttacatacacaagtagcaaattcgagtatgcatagtgtagatggacatttgccacaacacactgcccgcagaaatggacttaccgtgaagccaataaagttcaagcttcagggatctctcttgcacgggccttgccaaggcccaggagggacttgggcagtatgttcatgtggtcatatgtttttgtaaaaaattgtgaaagtaagatatgtttgtattgtttttcttaaagaggaacctcgtataagcttcaagcctcacaaaccttctagcctctgcccttggggatttgcttcattaatttcaggcaagtgaggtcaatgtaagaagggaaagggagaagatatttgaagaaccagaatgtaaattcatgtgtttccacttctcagatatagtcagagaattattcatttgcccaaaaggacttaagtggttgtggtcatccatcattgtatttatcaagacaaagccaactttgttataagattgcatttttttcttttcaaattgctttagtttttcttagggagctatgagggggaaaaatcactaacatgaaaggcaaaaaatggactatgattcctgtggggaaacaatttcattctctccatcgtgaaaataagtgaataagagtgaagcaaaattacacctttatgagaaaccataaaattgtttttatttttcaggccagacatagcttcctaatgaaagaaaatggaaatgtaattcgacgactcctcaaaggggactttagaggacttcatacaaagctgggcattaagaaaaccacaatgcatggccgggcgtggtggcttacacctgtaatcccagcactttgggaggccgaggtgggtggatcacccgaggtcaggagttcgagaccagcctggccaacatggtgaaaccccatcactactaaaaatatgtaaattagtcgggcgtggtgtcacgtgcctgtaatcctagctgctcgggaggctgaggcaggagaatcacttgaacttgggaggtggaggttgcagtaagctgagattgtgccactgcactctagcctgagcaacaagagcaaaactcagtctcaaaaaaaaaaaaaaaaaaaaaaaaaaaaaaaaaaaaggaaaaccacaatgcgtactaaagaccagaagacattgttcacaaaacaaaagcaccctcacctgccaatgaatatgcagcgtgcagggggtgtggtgtgagtgttggtggggccccacctctcggagatactgctgtgctgccttcctcactgactgtatacatagtaactgtcatatctttaatgccatggactcactgagccgctctgcaaggactattgtagacaggcacttcacaccataaagtggcatttttttcgttccccaaactgacatttacaagcgataagaaaagagacaatatccatttcattgactgatcattttctagagtatgaagaaatacacacctgggtgtctgcaaggatgtcatcatctttgggtttcatctgagagcatcactcagcatctcacacatagatgttaccatatttttaaatgagctttcctcatccggctccctaagcaagcgctgttggccggtgggagtgactaagtgctccacctgtgggtgtccttcttaatgtgctgcttttgttctgtataaattcacaccacctcactcccaaaagtacttcctgtggctcagaaaaatatgttcaataagattttggatagataaatccatacaaaaataaaaagaggtatagttataaaacaagactacagaaaaagttgtggcagaaattgcatgcaggaaaatcccacaccattagtaaaagtaaggtcaactgtaagttcagctcagggcttcctagcagccatgtttagcgaagtgtgatttttttttttaaacaaaaacaagcaaagatttggaagaaaatgctttagacctaactttacaattattataacataagatgttccagggtccttgaataaatgctgagttttagggaaatgattccaagggaccaagaattggtagaaataatttcaaggcagagaagactaattctacaggccgggcgtggtggcttatgcctgtaatcccacactttgggaggctgaggtgggtggattgcctgaggtcaagagttcaagaccagcctggccaacatggtgaaaccctgtctctactaaaaatacaaaaaattacccaggcatggtggcgggcgcctgtaatcccagctacttgggaggctgagacaggagaatggcttgaacccaggaggtggagattgcggtgagctgagatcgtgccattgcactccagcctgggcaacaagagcgaaacttcatctcaaaaaaaaaaaacaaagactaattctatagtacccatgaccctgcaaccagagaaactgcctgtagggaggccagagtccaaagcagccacctgtaacctgaaaatgaaacgcagacccaggcatctgtgggtcttcatcagcaggatgaccattctaaggctaaaagacaggcctttaaatctgatgctataattccatccaaatacacagttaggtttctaccatagggaaagctattctctactttttgaagtatctgtttcaaagataacttgctctctggttctcttttatctaaaagagagaatcaacatgctaatttaaaggttaacatcattttaattcaaaaattttagtctccattccatatttaatgatgaagacaaatctgctgggtgctgggagggaataaaaagtaatgcaccccattgatttcagagtatctgatcacttgggttatgcaagctgctacttacccgccattagcatgggtagttaagtgctgattaaacctaagtggactcagtgaaaaagatattgggaaaaataatatgatattgtggcctatgttgaatgatgttagcttgtgtttcagtaacagagttgggtaatactggacgtgtagatgaagctttagcagggctgggcacggtggctcatgcctgtaatcccagcactttgggaggctgaggcgggtggattacctgaggtcaggagttcaagaccagcctggccaacatggggaaaccctgtctctactaagaatacaaaaattagctgggtgtggtggcgtgtgcctgtaatcccagctactcaggaggctgagacaggagaatcgcttgaacccgggaggcgaaggttgcagtgagccaagatcgcgccactgcacttcagcctgggtgacagcacaagactccatctcaaaaaaaaaaaaaaaaggaagaagaaaaagaaacttaagtggggttcatacatagcatggcagagggacactggagaataaaatggcatgcagagaggaacacgcgggccagtggatgaggcttctagacctggcagtgaactggagtctatttgcttacacaaatttaaccttctctccatgatggaatacaagtgtttcttgccaaaactcgcagccccagctgccctagatgaggagcaccgtgctggaaaagtgcacaggctgatcacagagacaggtaggaagcaatggactgttaaaatgcatgttccgggctggggatggtggctcacacctgtgatctcagcactttgggaggccgaggctggggaatcgcttgagcccaggattttgagactagcctaggcaatatggtgagaccctgcccttaaaaaaaaaaaagaaaagaaaagaaaagaaaaaaagattcatattcctgatcagctctgaatgtgactattcaatgaagacagtaaagttacagtgtaaggcacacatgacctttggccttgctaaagaagagtggctgaaggtctagcaaattaatgcttgtcttaggttacctgttgatttaaaaacaacaacaacaaaaacccataaaaatagtaaaatataaaaacaaattagtgttttatagaccctggggaaaagaattttcagcaaagtacaaaaatttaaagcattcctttctttaattttgtaattctttactgtagaacagctcaaaatatcagttctgttttaagtaacagaattgataactgagcagggaaacgtaatttggattgtaaaattcttgctttaataaaaattctttaaacagtcaaaatagaaagaaagaaagaaaggtggcaagagaattatcaaaagtttccatagatggttgggaagatctgattagtgtttccaaaatgcttatcattctaagaatcccaatagctggcaagccaagcagtggaacttatagtaacaacaatcaatcacttgtctcatcccacatttttgccaaattcaaaaacaccaaatttcccatcaaatgttctgtcagagtaaacctttacctaagtgcttgttttgcttttaatatgtgaatttctgggaacattcccatgggcagcctctaattttttttttttttttttgagacagagtttcgctttttcacccaggctggagcgcagtggcacgatcttggctcactgcaacctccacctaccggattcaagtgattctcctgcctcagcctcccaagtagcagggactacaggcacgtgccaccacgcccagctaatttttgtatttttagtggagatgggtttttgccatgttggccaggcaggtcttgaactcttgacctcaggtgatccgcctgcctcagtgtcccaaagtgttgggattacaggcacgagccaccgcgctcagccaatttttcctcaactctctctttcctggacgggctgcgttggggggaggtgcagggaaagaacacctctttgcttagacattggtgtcgacagtggggatactaagttcatctcctgatcctgctaggcctggaagcaggaaagaaatgtcctggttagagataaaattgttctatccttttagaaaagcctgttaaggaatatgatgcaaagccaccttcgacgaaatctgaaatgataccccacagccttgtccaccccaattattcagtgacagggctccagttgcttaagccatagagaaggcccctttgcagtgggagtcactgaagacagaaagggaagcccaggatgaacccagtcctaagggctgctgggggccaccaaataagactgttttagccctggacacagagggagacacagtcatcccagatccttacaaagaatacattgccaaggaccccgaaggaaatctgcttgtcttaagagaggaagacccacgaccagctctctgggactacctgtcaactcagcaggtgcagccagggagcagccatgcttcttctgccctcccagtaggctgggctatcagttcctgggaggggtcctgtccccatgtaaggggatatgtacattgctgagtacgctgatatctttttcatgggtatgattttttaacaagaaagctaaatggttctcgtgtaacataactgatatagtttggctgtgtccccacccaaatcttatcttgaactgcagctcccataatccccaggtgttgtgggagggacccagtgggaggtaattgaatcatgggggtggttaccgccatgctgttctcgtgatagcgagtgagttctcacgagatctgatggttttataaggggctttccccctccttcgctctgcacttctccttgctgccatgcgaagaaggatgtgtttgcttccccttctgccatgattgtaagtttcctgaggcctccccagccatgttaaactttgagttaattaaacctctttcctttataaatta

SEQ ID NO: 20460 - DNA, 3595 bp, Homo sapiens
  ENST00000216218
atgccccgagctgggaccgaccctccggctccacgcccttttttttttttttttttaggtcccgggcgttgagctctactcagtgcacgcagccacacaatatgctcttggacgtcgccccctggaggggatgttatctcccgcctccttgaagtcgcccatttctggggttgccccatccagggagctggttcctagttaagaatatgagaatgtatgcgcagggaggcaggcaacagcacgaacagccacgcttctagaagattctagggagcgcgcaggagcagcgcagagggagtaggaatgagcaggcggaggacccgaggtcacgagaccgttgggtgggaggagccagcggccggggaggttctagtctgttctgtcttgcggcagccgcccccttctgcgcggtcacgccgagccagcgcctgggcctggaaccgggccgtagcccccccagtttcgcccaccacctccctaccatggacccccgcaaagtgaacgagcttcgggcctttgtgaaaatgtgtaagcaggatccgagcgttctgcacaccgaggaaatgcgcttcctgagggagtgggtggagagcatgggtggtaaagtaccacctgctactcagaaagctaaatcagaagaaaataccaaggaagaaaaacctgatagtaagaaggtggaggaagacttaaaggcagacgaaccatcaagtgaggaaagtgatctagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctgtaaattggattatgatgaagatgctagtgcaatgctgaaagaagttcaacctagggcacagaaaattgcagaacatcggagaaagtatgagcgaaaacgtgaagagcgagagatcaaagaaagaatagaacgagttaagaaggctcgagaagagcatgagagagcccagagggaggaagaagccagacgacagtcaggagctcagtatggctcttttccaggtggctttcctgggggaatgcctggtaattttcccggaggaatgcctggaatgggagggggcatgcctggaatggctggaatgcctggactcaatgaaattcttagtgatccagaggttcttgcagccatgcaggatccagaagttatggtggctttccaggatgtggctcagaacccagcaaatatgtcaaaataccagagcaacccaaaggttatgaatctcatcagtaaattgtcagccaaatttggaggtcaagcgtaatgtccttctgataaataaagcccttgctgaaggaaaagcaacctagatcaccttatggatgtcgcaataatacaaaccagtgtacctctgaccttctcatcaagagagctggggtgctttgaagataatccctacccctctcccccaaatgcagctgaagcattttacagtggtttgccattagggtattcattcagataatgttttcctactaggaattacaaactttaaacactttttaaatcttcaaaatatttaaaacaaatttaaagggcctgttaattcttatatttttctttactaatcattttggatttttttctttgaattattggcagggaatatacttatgtatggaagattactgctctgagtgaaataaaagttattagtgcgaggcaaacataactcatttgaggataaagtttgtgttggatatgtggttcctgatgcattttgacttgtctttttaaatgctttatctttttctttaaagatttatttcaataaaactaattgggaccacccgtatttcagtaggacctgggtagggattggaagtacttggcagggcagcagcaatcttgctgtgtttgatataacatgcatccttgggcaggttgcccttaaatcttacactgtggtgaagggatgttttttttgtaatgctgcagtagagttggagtacttagttctcttgttgtccagtatatctaataagtgtttttcatattatttccacgtaagggaaataaggtagtacttttctttttatatttctatgcttaaaattctctttcctagtcaaaaattgcccaaatctgtgtttgctttctgcttgctacatttgtctcccttacttttcttgagctaaagacaggctttttccaccggcatcatcactgctatcatcattaacagcgtaattatacaagcatatttaatgctgagtttaatttaatatgtaatacatatggtaattgtagggtaatacccacaacaactgtagtttcttacttggccaagagaatgcttatttaagtgttagacttccattctggcaaaatcttgccttatcagaagacattggaaagagggattccctttggtgtttggtcttctacttagaaaaacctattgcagttagtttatcttgtagtattcatctttgtattctgaagataaggtttgaattaaattgatacacacagaggggaaccgattttttttatccaatgtgaattataaatgagataatccacagttattcattgtggagttgttgagactatgaaagactcattgtctttgtattcagctcttaaatagtgtaactatatccccacctctgcttgctttctttccctcccctccaatgataaagaaaatgataaattttctgttgtgcattcaattcttattttaaataagactaagtataggcattgtacctgacattgctacgtttctaccagtgtttcaatttaaagtgctagtgtttaaaaacattttcaagggataaggccttctgtactttgcttatttgaagaatcagtggtaggagcagtgaagtaaattctatggagtacatttctaaaataccacatttctgaaatcataaataagtttattcaggttctaaccctttgctgtacacaagcagacagaaatgcatctgttacataaatgagaaaaagctattatgctgatggagcatgctttttaaatcctttaaaaacactcaccatataaacttgcatttgagcttgtgtgttcttttgttaatgtgtagagttctcctttctcgaaattgccagtgtgtacttggcttaactcaagaacagtttcttctggattccttatttgatttatttaacctaattatattctaatattgcaaatattaccataagtgggtaaaagtaaaattcctcttctgaaaatgtgtcctgtgcttttagatttttaaattccataatatacattcttaattttcaactcaa

SEQ ID NO: 20461 - DNA, 592 bp, Homo sapiens
  ENST00000480048
acttttgtttcactttaggtgaactccagaaagccattgacttattcacagatgccatcaagctgaatcctcgcttggccattttgtatgccaagagggccaggtgagaactctaaacagaaaagcatcccctggcaaataatttctgcacatttgtttaaatagagttgcttctgtgttgatcccaaaacttttactgaaatgaatactttttaataacacacttatttttcagtgtcttcgtcaaattacagaagccaaatgctgccatccgagactgtgacagagccattgaaataaatcctgattcagctcagccttacaagtggcgggggaaagcacacaggcacagaaaattgcagaacatcggagaaagtatgagcgaaaacgtgaagagcgagagatcaaagaaagaatagaacgagttaagaaggctcgagaagagcatgagagagcccagagggaggaagaagccagacgacagtcaggagctcagtatggctcttttccaggtggctttcctgggggaatgcctggtaattttcccggaggaatgcctggaatgggagggggcatgcctggaatggctgga

SEQ ID NO: 20462 - DNA, 798 bp, Homo sapiens
  ENST00000455824
cgcggtcacgccgagccagcgcctgggcctggaaccgggccgtagcccccccagtttcgcccaccacctccctaccatggacccccgcaaagtgaacgagcttcgggcctttgtgaaaatgtgtaagcaggatccgagcgttctgcacaccgaggaaatgcgcttcctgagggagtgggtggagagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctgtaaattggattatgatgaagatgctagtgcaatgctgaaagaagttcaacctagggcacagaaaattgcagaacatcggagaaagtatgagcgaaaacgtgaagagcgagagatcaaagaaagaatagaacgagttaagaaggctcgagaagagcatgagagagcccagagggaggaagaagccagacgacagtcaggagctcagtatggctcttttccaggtggctttc

SEQ ID NO: 20463 - DNA, 630 bp, Homo sapiens
  ENST00000413424
gattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctgtaaattggattatgatgaagatgctagtgcaatgctgaaagaagttcaacctagggtgtgtacaaccactttataaagcaagaagaccttgtggaagttaagaagtttcaggctttccggccaggcgcggtggctcatgcctgtaatcccagcactttgggaggccgaggcaggtggatcatgaggcacagaaaattgcagaacatcggagaaagtatgagcgaaaacgtgaagagcgagagatcaaagaaagaatagaacgagtta

SEQ ID NO: 20464 - DNA, 549 bp, Homo sapiens
  ENST00000411695
aacagtgtcctcctgacttgtgctggagtgattgtgcctatgtagagaattccactttaagcatgggtggtaaagtaccacctgctactcagaaagctaaatcagaagaaaataccaaggaagaaaaacctgatagtaagaaggtggaggaagacttaaaggcagacgaaccatcaagtgaggaaagtgatctagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaag

SEQ ID NO: 20465 - DNA, 425 bp, Homo sapiens
  ENST00000495652
aaaactttttattaatatttttatcctctgaatatttctcgataacttttgtttcactttaggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacaggtaaataattgaatttaattattttcagaactctttacatttaaatctgatgttttaagatgctttgtttaaacaaaaacacaaaagttcctaatgacttaattttcaaattagtgtgtacttagtatcaagaagtgagatagcttgtagacagctgcttaaaaggt

SEQ ID NO: 20466 - DNA, 944 bp, Homo sapiens
  ENST00000620312
cagtttcgcccaccacctccctaccatggacccccgcaaagtgaacgagcttcgggcctttgtgaaaatgtgtaagcaggatccgagcgttctgcacaccgaggaaatgcgcttcctgagggagtgggtggagagcatgggtggtaaagtaccacctgctactcagaaagctaaatcagaagaaaataccaaggaagaaaaacctgatagtaagaaggtggaggaagacttaaaggcagacgaaccatcaagtgaggaaagtgatctagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctggactcaatgaaattcttagtgatccagaggttcttgcagccatgcaggatccagaagttatggtggctttccaggatgtggctcagaacccagcaaatatgtcaaaataccagagcaacccaaaggttatgaatctcatcagtaaattgtcagccaaatttggaggtcaagcgtaatgtccttctgataaataaagcccttgctgaaggaaaagcaacctagatcaccttatggatgtcgcaataatacaaaccagtgtacctctgaccttctcatcaagagagctggggtgc

SEQ ID NO: 20467 - DNA, 6187 bp, Homo sapiens
  ENST00000276480
ctttttgtagggagaagggcaggatgtttttaactgaatgtgacctcaggggaatactagagaaaataataaaatttctgaatggggcagcgtggagaaatcctaagagaaatagcataagagcattttggaacacatccaggaaaagataactttcgacacacctgtagacgttcgccaggtaaaggagtgatggaaactctccagttcagatccagtagcttttagggaaggaactacagttgctgacttaagttgaagaagcatctatttaatgtctggtcaaatcctacaagaaacacagaaatctatgattaaaaagctgagcactttgatatactgcaaagggtagagaaggcaggacggtagaaattttctgcaagaaagaatgaatttcaggatttatcactaaataagacaaagtcatttatttagtccccctgacacagcagggcaaactgagttgacatacaagttacctggagaaaaagagagcaattccaggacttcctcttcagcctaaaagaaggtaccagatctgtgcactggggcgatgtggaagagacctgcttattgcccctgatgtaagctccagtaagaaaagacgtcaagtacaagtactaggaaatcactttatacatctgtttataggaatgacctcaggactttgtgttcatgttatagatggatgcagaggctgaagataaaacgctgcgtactcgctctaaaggaaccgaggtgccaatggattcactaatccaggagctcagtgttgcctatgattgctccatggcaaagaagagaacagctgaagatcaggctttgggggttccagtcaacaaaaggaaatccctgctaatgaagccccgacactacagcccaaaagcagactgccaagaagaccgcagtgacaggacagaggacgatggccccttggaaacacatggtcactctaccgcagaggaaatcatgataaaacctatggatgaaagtcttctttcaactgcacaagaaaactccagtaggaaggaagacagatactcttgttatcaagagctcatggtcaagtctttaatgcacttggggaaatttgaaaaaaatgtatctgttcagactgtaagtgaaaatttaaatgacagtggcatccagtctttaaaagcagagagcgatgaagcagacgagtgctttctgattcattctgatgatggaagagacaagattgatgattctcagccacccttctgctcctctgatgacaatgaaagtaactctgaaagtgcagaaaatggctgggacagtggctccaacttctcagaagaaaccaaaccacctagagtcccaaagtatgttttaacagatcataaaaaagacctattggaagttcctgaaataaaaactgaaggtgacaaatttatcccttgtgagaacaggtgtgattctgaaacagaaaggaaagacccgcagaatgctctcgcagaacccctggatggcaatgcccagccctcattccctgacgttgaggaggaagatagcgagagcctggcagtaatgacggaagagggtagtgacctggaaaaggccaaggggaatttaagtttgctggagcaggcaattgctctgcaggctgagcgaggttgtgttttccataacacctacaaagagctggataggttcctgctggagcacctagcaggggaaaggaggcaaaccaaagttatcgacatgggtggaagacaaatctttaacaataaacattcaccaaggcctgaaaagagggagaccaagtgcccgatccctggatgtgatggcacgggacacgtgacagggctctacccgcaccaccgcagcctttcggggtgcccccacaaagtgcgggttcccctggaaattcttgccatgcatgaaaatgtgctcaagtgtcccacgccgggatgcacaggaaggggtcatgtgaacagcaaccgcaacacccacaggagtctttctggttgtccaattgctgcagctgaaaaattggcaatgtcccaggataaaaatcagcttgattctccccaaactgggcagtgtcctgaccaggcccacaggacaagtttggtgaagcaaattgaattcaatttcccgtcacaagccatcacctctcccagagccacagtgtcaaaagaacaagagaagtttggaaaagtaccatttgattatgccagttttgatgcccaagttttcggtaaacgccctctcatacaaacagtgcaaggacgaaaaacaccaccatttcctgaatcaaagcattttccaaatccagtgaaatttcctaatcgactgcctagtgcaggcgcccacacccagagccctggccgtgccagctcttatagctacggtcaatgtagtgaagacacccacatagcagcagctgctgccatcctgaacctttccacccgctgcagggaagccacagacatcctctccaacaagccacagagtctgcatgccaagggagccgaaatagaagtggatgaaaatggcacattggacttaagcatgaaaaaaaatcgaatcctggacaagtctgcacccctaacttcctctaacacttctattccaactccttcctcttccccattcaaaacaagcagcattctggtcaatgcagcattctatcaggctctttgtgaccaagagggctgggacactcctatcaactatagcaaaactcacgggaagacagaggaggagaaagagaaagacccagtgagctctctagaaaatttagaggaaaaaaagtttcctggagaggcctctataccaagccctaaacccaagcttcatgcaagagatctcaaaaaggaactaatcacctgtccaacaccaggatgtgatggaagtggccacgtgacaggaaactatgcatctcatcgcagtgtttctggatgtcctttagcagataagactctaaaatccctcatggctgccaactctcaggagcttaagtgtccaaccccaggctgcgatggctcggggcacgtgactggaaactatgcttcccacagaagcttgtccggatgccctcgtgcaaggaaaggtggtgtcaaaatgacccctaccaaggaagaaaaagaagaccctgaactgaaatgtcctgtgatagggtgtgatggccaaggtcacatatcaggtaaatacacatcacaccgcacagcttctggctgtcctctggctgccaagagacagaaggagaatcctctcaatggagcctccctctcctggaaactgaacaaacaagagctaccacattgtcccttgccaggctgcaatgggctgggccatgtaaataatgtttttgtcacccaccgaagcttatctggatgtcctctcaatgcacaagttatcaaaaagggcaaggtttctgaagaactcatgaccatcaagctcaaagcaactgggggaatagagagtgatgaagaaattaggcatttggatgaagaaataaaggaactgaatgaatccaaccttaaaattgaagcagatatgatgaaacttcagacccagatcacatctatggagagcaacttaaagacgatagaggaggagaacaaactcatagaacagaacaatgaaagtctgctgaaagagctggcaggtctaagccaagctctcatttcaagccttgctgacatccagcttccacagatgggacctatcagtgagcagaattttgaagcatatgtaaatacactcacagatatgtacagcaatctggaacgggactattccccggaatgcaaagctctactggaaagtatcaaacaggcagtgaagggtatccatgtgtaggatcacagcgctgccgggcaacagaagttaccaacagcagtaaactccagatggatctgttagaggttcatgtactgctaaggcgtggaggttgccgtactgcatttacaatttgcaacattgcactaattttattttccccagctgatataaaaaggaaagaaaaactatgatagacttcttggattaaaagcaatgcagtcaattattagatcttatttattttcatatgtttttcttttatttcttcattgtactctttttttttttgtaaagtatatgtaaaataaatgtgacatttttataatttatttattactaatcaaagagttttttatcttttaactgcattttgaagtctgccgtatttttacaagtgtgtttattaatttattttccaataggatttaaatagaaatgctattctcaagtcatctttcttgctgggttttaatgaggaaacaggaaagggtgaaggaaatccttgtctaaggactgcactatagttgagtttgatttttattgcacacttcttcccccacctttcactgatttttgtatttataaatgaatttgcggtaaggtgagctgcacggaaggaataagaagacaaatggcgcccactagtggggaatccgcactcacaaaagcacaggatgctggaaaacagcctgctcagaatttgttagcaataattaaatatagcaatcagcaaagtattcgacttggctggacggttttcgttaatatgaattatttatttgaaatgttttaaagaaacataagcctttttagtgatgcagatttgtctgtttgtttttcaagtcatatcagatcgttggcaactcgtatcccaagatgaaaaataagacttggtgtgaccagccaggctttcctgccatatgttggtacaatatacaagtgacaatattggtgtagatttgtacttagcaaatacaaacacatccaaatgaaaaattttgtagataccatatcccctgaaatagcatttatcttactgggttgactggaaaggaatggaaaatatagtaacacatgaaaaaatgctactccaatctgaatgattacttcaaacactggcaccttgggtctcacccaccataggaaacaagacaacattcaatttgatagaaatcttgccacaaaacttcaaatgctacaaaatatacacacacactcacacacacaggcatactcacacacagacacacacacacacacacacacagactcatccacacttcaaattgagcccacaatcttgaatttctgaacggatcagagtttcatagtttctatagtaaaggcaatgtctatttcagggattgtaaagtagttaagcattgtttcaaaagtttttttatatttattttttttaaggaaaaggtatagacaaccagctaaactgcctttttggtgtgcacacacatttcatgtgcagacgtgcctctgtgtaaatgtacacatgaacttcatgtgggcttaattttctgtgctataaacaaaagtgtttattttttattaacctcatggatatttagatggaaagtgatggcattcacaggcttgatgtattccactgttattactgttacctgcacaaatgaaaaacaatactcaacagtaattccactcccatgaaactttggtcattgttatgcattaagtggggcttatctttggtttggagttcatttgaactcttgaaccttagtttagtgaagatgaactgtctgttcttaggtagaaacggtgtttatttaaaaatcagttttaaaaaatgagctaccatatgtgctgtctattataaatgggacaccaaacaaaattttctattacagttgtgtacttgcaaacattttgctatacagtacttcatagatgcatacaaatgagctcacttattacaaagacaaacgtttaatttgctaaatattttaacaagtttgttatatattttatttaatttaaaagaaatctcttaccaacctacatatttattactataatttgctatgacttcaggttaatttatttgtgtttgcatagtttgagcaggatgttttgtgaagtatgtttgtatttatttgcctactttgtacttgatgtgttttgtaatgtgcactgaatttgttttcttttcaactatgttaatgatcaatactgtaaattgggtcttttgtaaacaaaaaggcaatgatgtatgcattttttttaatttgaggtagtttgtttgtatactgtttctccaaacacttaatatttcttacatcaaagcaacaaaattgtgttcagtgctgtacatttggtgtatggtaggaaataaaaattgataacg

SEQ ID NO: 20468 - DNA, 3870 bp, Homo sapiens
  ENST00000521824
gcccctgatgtaagctccagtaagaaaagacgtcaagtacaagtactaggaaatcactttatacatctgtttatagatggatgcagaggctgaagataaaacgctgcgtactcgctctaaaggaaccgaggtgccaatggattcactaatccaggagctcagtgttgcctatgattgctccatggcaaagaagagaacagctgaagatcaggctttgggggttccagtcaacaaaaggaaatccctgctaatgaagccccgacactacagcccaaaagcagactgccaagaagaccgcagtgacaggacagaggacgatggccccttggaaacacatggtcactctaccaggaaatcatgataaaacctatggatgaaagtcttctttcaactgcacaagaaaactccagtaggaaggaagacagatactcttgttatcaagagctcatggtcaagtctttaatgcacttggggaaatttgaaaaaaatgtatctgttcagactgtaagtgaaaatttaaatgacagtggcatccagtctttaaaagcagagagcgatgaagcagacgagtgctttctgattcattctgatgatggaagagacaagattgatgattctcagccacccttctgctcctctgatgacaatgaaagtaactctgaaagtgcagaaaatggctgggacagtggctccaacttctcagaagaaaccaaaccacctagagtcccaaagtatgttttaacagatcataaaaaagacctattggaagttcctgaaataaaaactgaaggtgacaaatttatcccttgtgagaacaggtgtgattctgaaacagaaaggaaagacccgcagaatgctctcgcagaacccctggatggcaatgcccagccctcattccctgacgttgaggaggaagatagcgagagcctggcagtaatgacggaagagggtagtgacctggaaaaggccaaggggaatttaagtttgctggagcaggcaattgctctgcaggctgagcgaggttgtgttttccataacacctacaaagagctggataggttcctgctggagcacctagcaggggaaaggaggcaaaccaaagttatcgacatgggtggaagacaaatctttaacaataaacattcaccaaggcctgaaaagagggagaccaagtgcccgatccctggatgtgatggcacgggacacgtgacagggctctacccgcaccaccgcagcctttcggggtgcccccacaaagtgcgggttcccctggaaattcttgccatgcatgaaaatgtgctcaagtgtcccacgccgggatgcacaggaaggggtcatgtgaacagcaaccgcaacacccacaggagtctttctggttgtccaattgctgcagctgaaaaattggcaatgtcccaggataaaaatcagcttgattctccccaaactgggcagtgtcctgaccaggcccacaggacaagtttggtgaagcaaattgaattcaatttcccgtcacaagccatcacctctcccagagccacagtgtcaaaagaacaagagaagtttggaaaagtaccatttgattatgccagttttgatgcccaagttttcggtaaacgccctctcatacaaacagtgcaaggacgaaaaacaccaccatttcctgaatcaaagcattttccaaatccagtgaaatttcctaatcgactgcctagtgcaggcgcccacacccagagccctggccgtgccagctcttatagctacggtcaatgtagtgaagacacccacatagcagcagctgctgccatcctgaacctttccacccgctgcagggaagccacagacatcctctccaacaagccacagagtctgcatgccaagggagccgaaatagaagtggatgaaaatggcacattggacttaagcatgaaaaaaaatcgaatcctggacaagtctgcacccctaacttcctctaacacttctattccaactccttcctcttccccattcaaaacaagcagcattctggtcaatgcagcattctatcaggctctttgtgaccaagagggctgggacactcctatcaactatagcaaaactcacgggaagacagaggaggagaaagagaaagacccagtgagctctctagaaaatttagaggaaaaaaagtttcctggagaggcctctataccaagccctaaacccaagcttcatgcaagagatctcaaaaaggaactaatcacctgtccaacaccaggatgtgatggaagtggccacgtgacaggaaactatgcatctcatcgcagtgtttctggatgtcctttagcagataagactctaaaatccctcatggctgccaactctcaggagcttaagtgtccaaccccaggctgcgatggctcggggcacgtgactggaaactatgcttcccacagaagcttgtccggatgccctcgtgcaaggaaaggtggtgtcaaaatgacccctaccaaggaagaaaaagaagaccctgaactgaaatgtcctgtgatagggtgtgatggccaaggtcacatatcaggtaaatacacatcacaccgcacagcttctggctgtcctctggctgccaagagacagaaggagaatcctctcaatggagcctccctctcctggaaactgaacaaacaagagctaccacattgtcccttgccaggctgcaatgggctgggccatgtaaataatgtttttgtcacccaccgaagcttatctggatgtcctctcaatgcacaagttatcaaaaagggcaaggtttctgaagaactcatgaccatcaagctcaaagcaactgggggaatagagagtgatgaagaaattaggcatttggatgaagaaataaaggaactgaatgaatccaaccttaaaattgaagcagatatgatgaaacttcagacccagatcacatctatggagagcaacttaaagacgatagaggaggagaacaaactcatagaacagaacaatgaaagtctgctgaaagagctggcaggtctaagccaagctctcatttcaagccttgctgacatccagcttccacagatgggacctatcagtgagcagaattttgaagcatatgtaaatacactcacagatatgtacagcaatctggaacgggactattccccggaatgcaaagctctactggaaagtatcaaacaggcagtgaagggtatccatgtgtaggatcacagcgctgccgggcaacagaagttaccaacagcagtaaactccagatggatctgttagaggttcatgtactgctaaggcgtggaggttgccgtactgcatttacaatttgcaacattgcactaattttattttccccagctgatataaaaaggaaagaaaaactatgatagacttcttggattaaaagcaatgcagtcaattattagatcttatttattttcatatgtttttcttttatttcttcattgtactctttttttttttgtaaagtatatgtaaaataaatgtgacatttttataatttatttattactaatcaaagagttttttatcttttaactgcattttgaagtctgccgtatttttacaagtgtgtttattaatttattttccaataggatttaaatagaaatgctattctcaagtcatctttcttgctgggttttaatgaggaaacaggaaagggtgaaggaaatccttgtctaaggactgcactatagttgagtttgatttttattgcacacttcttcccccacctttcactgatttttgtatttataaatgaatttgcggtaaggtgagctgcacggaaggaataagaagacaaatggcgcccactagtggggaatccgcactcacaaaagcaca

SEQ ID NO: 20469 - DNA, 3963 bp, Homo sapiens
  ENST00000522251
tgcccctgatgtaagctccagtaagaaaagacgtcaagtacaagtactaggaaatcactttatacatctgtttatagatggatgcagaggctgaagataaaacgctgcgtactcgctctaaaggaaccgaggtgccaatggattcactaatccaggagctcagaatcagtgtgcccgtggacatgaggccacttacctggtgagggacaccagagtcctttaaaggaaccaagtcattcagagaaaaaaagtgttgcctatgattgctccatggcaaagaagagaacagctgaagatcaggctttgggggttccagtcaacaaaaggaaatccctgctaatgaagccccgacactacagcccaaaagcagactgccaagaagaccgcagtgacaggacagaggacgatggccccttggaaacacatggtcactctaccgcagaggaaatcatgataaaacctatggatgaaagtcttctttcaactgcacaagaaaactccagtaggaaggaagacagatactcttgttatcaagagctcatggtcaagtctttaatgcacttggggaaatttgaaaaaaatgtatctgttcagactgtaagtgaaaatttaaatgacagtggcatccagtctttaaaagcagagagcgatgaagcagacgagtgctttctgattcattctgatgatggaagagacaagattgatgattctcagccacccttctgctcctctgatgacaatgaaagtaactctgaaagtgcagaaaatggctgggacagtggctccaacttctcagaagaaaccaaaccacctagagtcccaaagtatgttttaacagatcataaaaaagacctattggaagttcctgaaataaaaactgaaggtgacaaatttatcccttgtgagaacaggtgtgattctgaaacagaaaggaaagacccgcagaatgctctcgcagaacccctggatggcaatgcccagccctcattccctgacgttgaggaggaagatagcgagagcctggcagtaatgacggaagagggtagtgacctggaaaaggccaaggggaatttaagtttgctggagcaggcaattgctctgcaggctgagcgaggttgtgttttccataacacctacaaagagctggataggttcctgctggagcacctagcaggggaaaggaggcaaaccaaagttatcgacatgggtggaagacaaatctttaacaataaacattcaccaaggcctgaaaagagggagaccaagtgcccgatccctggatgtgatggcacgggacacgtgacagggctctacccgcaccaccgcagcctttcggggtgcccccacaaagtgcgggttcccctggaaattcttgccatgcatgaaaatgtgctcaagtgtcccacgccgggatgcacaggaaggggtcatgtgaacagcaaccgcaacacccacaggagtctttctggttgtccaattgctgcagctgaaaaattggcaatgtcccaggataaaaatcagcttgattctccccaaactgggcagtgtcctgaccaggcccacaggacaagtttggtgaagcaaattgaattcaatttcccgtcacaagccatcacctctcccagagccacagtgtcaaaagaacaagagaagtttggaaaagtaccatttgattatgccagttttgatgcccaagttttcggtaaacgccctctcatacaaacagtgcaaggacgaaaaacaccaccatttcctgaatcaaagcattttccaaatccagtgaaatttcctaatcgactgcctagtgcaggcgcccacacccagagccctggccgtgccagctcttatagctacggtcaatgtagtgaagacacccacatagcagcagctgctgccatcctgaacctttccacccgctgcagggaagccacagacatcctctccaacaagccacagagtctgcatgccaagggagccgaaatagaagtggatgaaaatggcacattggacttaagcatgaaaaaaaatcgaatcctggacaagtctgcacccctaacttcctctaacacttctattccaactccttcctcttccccattcaaaacaagcagcattctggtcaatgcagcattctatcaggctctttgtgaccaagagggctgggacactcctatcaactatagcaaaactcacgggaagacagaggaggagaaagagaaagacccagtgagctctctagaaaatttagaggaaaaaaagtttcctggagaggcctctataccaagccctaaacccaagcttcatgcaagagatctcaaaaaggaactaatcacctgtccaacaccaggatgtgatggaagtggccacgtgacaggaaactatgcatctcatcgcagtgtttctggatgtcctttagcagataagactctaaaatccctcatggctgccaactctcaggagcttaagtgtccaaccccaggctgcgatggctcggggcacgtgactggaaactatgcttcccacagaagcttgtccggatgccctcgtgcaaggaaaggtggtgtcaaaatgacccctaccaaggaagaaaaagaagaccctgaactgaaatgtcctgtgatagggtgtgatggccaaggtcacatatcaggtaaatacacatcacaccgcacagcttctggctgtcctctggctgccaagagacagaaggagaatcctctcaatggagcctccctctcctggaaactgaacaaacaagagctaccacattgtcccttgccaggctgcaatgggctgggccatgtaaataatgtttttgtcacccaccgaagcttatctggatgtcctctcaatgcacaagttatcaaaaagggcaaggtttctgaagaactcatgaccatcaagctcaaagcaactgggggaatagagagtgatgaagaaattaggcatttggatgaagaaataaaggaactgaatgaatccaaccttaaaattgaagcagatatgatgaaacttcagacccagatcacatctatggagagcaacttaaagacgatagaggaggagaacaaactcatagaacagaacaatgaaagtctgctgaaagagctggcaggtctaagccaagctctcatttcaagccttgctgacatccagcttccacagatgggacctatcagtgagcagaattttgaagcatatgtaaatacactcacagatatgtacagcaatctggaacgggactattccccggaatgcaaagctctactggaaagtatcaaacaggcagtgaagggtatccatgtgtaggatcacagcgctgccgggcaacagaagttaccaacagcagtaaactccagatggatctgttagaggttcatgtactgctaaggcgtggaggttgccgtactgcatttacaatttgcaacattgcactaattttattttccccagctgatataaaaaggaaagaaaaactatgatagacttcttggattaaaagcaatgcagtcaattattagatcttatttattttcatatgtttttcttttatttcttcattgtactctttttttttttgtaaagtatatgtaaaataaatgtgacatttttataatttatttattactaatcaaagagttttttatcttttaactgcattttgaagtctgccgtatttttacaagtgtgtttattaatttattttccaataggatttaaatagaaatgctattctcaagtcatctttcttgctgggttttaatgaggaaacaggaaagggtgaaggaaatccttgtctaaggactgcactatagttgagtttgatttttattgcacacttcttcccccacctttcactgatttttgtatttataaatgaatttgcggtaaggtgagctgcacggaaggaataagaagacaaatggcgcccactagtggggaatccgcactcacaaaagcaca

SEQ ID NO: 20470 - DNA, 3928 bp, Homo sapiens
  ENST00000521582
tgcccctgatgtaagctccagtaagaaaagacgtcaagtacaagtactaggaaatcactttatacatctgtttatagatggatgcagaggctgaagataaaacgctgcgtactcgctctaaaggaaccgaggtgccaatggattcactaatccaggagctcagtgttgcctatgattgctccatggcaaagaagagaacagctgaagatcaggctttgggggttccagtcaacaaaaggaaatccctgctaatgaagccccgacactacagcccaaaagcagactgccaagaagaccgcagtgacaggacagaggacgatggccccttggaaacacatggtcactctaccgcagaggaaatcatgataaaacctatggatgaaagtcttctttcaactgcacaagaaaactccagtaggaaggaagacagatactcttgttatcaagagctcatggtcaagtctttaatgcacttggggaaatttgaaaaaaatgtatctgttcagactgtaagtgaaaatttaaatgacagtggcatccagtctttaaaagcagagagcgatgaagcagacgagtgctttctgattcattctgatgatggaagagacaagattgatgattctcagccacccttctgctcctctgatgacaatgaaagtaactctgaaagtgcagaaaatggctgggacagtggctccaacttctcagaagaaaccaaaccacctagagtcccaaagtatgttttaacagatcataaaaaagacctattggaagttcctgaaataaaaactgaaggtgacaaatttatcccttgtgagaacaggtgtgattctgaaacagaaaggaaagacccgcagaatgctctcgcagaacccctggatggcaatgcccagccctcattccctgacgttgaggaggaagatagcgagagcctggcagtaatgacggaagagggtagtgacctggaaaaggccaaggggaatttaagtttgctggagcaggcaattgctctgcaggctgagcgaggttgtgttttccataacacctacaaagagctggataggttcctgctggagcacctagcaggggaaaggaggcaaaccaaagttatcgacatgggtggaagacaaatctttaacaataaacattatcctccaatcaagctgtgttaattttggactattttcacacatgaaaaaagattcaccaaggcctgaaaagagggagaccaagtgcccgatccctggatgtgatggcacgggacacgtgacagggctctacccgcaccaccgcagcctttcggggtgcccccacaaagtgcgggttcccctggaaattcttgccatgcatgaaaatgtgctcaagtgtcccacgccgggatgcacaggaaggggtcatgtgaacagcaaccgcaacacccacaggagtctttctggttgtccaattgctgcagctgaaaaattggcaatgtcccaggataaaaatcagcttgattctccccaaactgggcagtgtcctgaccaggcccacaggacaagtttggtgaagcaaattgaattcaatttcccgtcacaagccatcacctctcccagagccacagtgtcaaaagaacaagagaagtttggaaaagtaccatttgattatgccagttttgatgcccaagttttcggtaaacgccctctcatacaaacagtgcaaggacgaaaaacaccaccatttcctgaatcaaagcattttccaaatccagtgaaatttcctaatcgactgcctagtgcaggcgcccacacccagagccctggccgtgccagctcttatagctacggtcaatgtagtgaagacacccacatagcagcagctgctgccatcctgaacctttccacccgctgcagggaagccacagacatcctctccaacaagccacagagtctgcatgccaagggagccgaaatagaagtggatgaaaatggcacattggacttaagcatgaaaaaaaatcgaatcctggacaagtctgcacccctaacttcctctaacacttctattccaactccttcctcttccccattcaaaacaagcagcattctggtcaatgcagcattctatcaggctctttgtgaccaagagggctgggacactcctatcaactatagcaaaactcacgggaagacagaggaggagaaagagaaagacccagtgagctctctagaaaatttagaggaaaaaaagtttcctggagaggcctctataccaagccctaaacccaagcttcatgcaagagatctcaaaaaggaactaatcacctgtccaacaccaggatgtgatggaagtggccacgtgacaggaaactatgcatctcatcgcagtgtttctggatgtcctttagcagataagactctaaaatccctcatggctgccaactctcaggagcttaagtgtccaaccccaggctgcgatggctcggggcacgtgactggaaactatgcttcccacagaagcttgtccggatgccctcgtgcaaggaaaggtggtgtcaaaatgacccctaccaaggaagaaaaagaagaccctgaactgaaatgtcctgtgatagggtgtgatggccaaggtcacatatcaggtaaatacacatcacaccgcacagcttctggctgtcctctggctgccaagagacagaaggagaatcctctcaatggagcctccctctcctggaaactgaacaaacaagagctaccacattgtcccttgccaggctgcaatgggctgggccatgtaaataatgtttttgtcacccaccgaagcttatctggatgtcctctcaatgcacaagttatcaaaaagggcaaggtttctgaagaactcatgaccatcaagctcaaagcaactgggggaatagagagtgatgaagaaattaggcatttggatgaagaaataaaggaactgaatgaatccaaccttaaaattgaagcagatatgatgaaacttcagacccagatcacatctatggagagcaacttaaagacgatagaggaggagaacaaactcatagaacagaacaatgaaagtctgctgaaagagctggcaggtctaagccaagctctcatttcaagccttgctgacatccagcttccacagatgggacctatcagtgagcagaattttgaagcatatgtaaatacactcacagatatgtacagcaatctggaacgggactattccccggaatgcaaagctctactggaaagtatcaaacaggcagtgaagggtatccatgtgtaggatcacagcgctgccgggcaacagaagttaccaacagcagtaaactccagatggatctgttagaggttcatgtactgctaaggcgtggaggttgccgtactgcatttacaatttgcaacattgcactaattttattttccccagctgatataaaaaggaaagaaaaactatgatagacttcttggattaaaagcaatgcagtcaattattagatcttatttattttcatatgtttttcttttatttcttcattgtactctttttttttttgtaaagtatatgtaaaataaatgtgacatttttataatttatttattactaatcaaagagttttttatcttttaactgcattttgaagtctgccgtatttttacaagtgtgtttattaatttattttccaataggatttaaatagaaatgctattctcaagtcatctttcttgctgggttttaatgaggaaacaggaaagggtgaaggaaatccttgtctaaggactgcactatagttgagtttgatttttattgcacacttcttcccccacctttcactgatttttgtatttataaatgaatttgcggtaaggtgagctgcacggaaggaataagaagacaaatggcgcccactagtggggaatccgcactcacaaaagca

SEQ ID NO: 20471 - DNA, 725 bp, Homo sapiens
  ENST00000518053
gagatgtggaaatgagcttgtcggcagcagtcagagagatcacataattttgctttgttctttgtcgggtccctatttcagcttgtccggatgccctcgtgcaaggaaaggtggtgtcaaaatgacccctaccaaggaagaaaaagaagaccctgaactgaaatgtcctgtgatagggtgtgatggccaaggtcacatatcaggtaaatacacatcacaccgcacagcttctggctgtcctctggctgccaagagacagaaggagaatcctctcaatggagcctccctctcctggaaactgaacaaacaagagctaccacattgtcccttgccaggctgcaatgggctgggccatgtaaataatgtttttgtcacccaccgaagcttatctggatgtcctctcaatgcacaagttatcaaaaagggcaaggtttctgaagaactcatgaccatcaagctcaaagcaactgggggaatagagagtgatgaagaaattaggcatttggatgaagaaataaaggaactgaatgaatccaaccttaaaattgaagcagatatgatgaaacttcagacccagatcacatctatggagagcaacttaaagacgatagaggaggagaacaaactcatagaacagaacaatgaaagtctgctgaaagagctggcaggtctaagccaagctctcatttcaagccttgctgacatccagcttccacagatggtaa

SEQ ID NO: 20472 - DNA, 567 bp, Homo sapiens
  ENST00000522861
atttcagcttgtccggatgccctcgtgcaaggaaaggtggtgtcaaaatgacccctaccaaggaagaaaaagaagaccctgaactgaaatgtcctgtgatagggtgtgatggccaaggtcacatatcaggtaaatacacatcacaccgcacagcttctggctgtcctctggctgccaagagacagaaggagaatcctctcaatggagcctccctctcctggaaactgaacaaacaagagctaccacattgtcccttgccaggctgcaatgggctgggccatgtaaataatgtttttgtcacccaccgaagcttatctggatgtcctctcaatgcacaagttatcaaaaagggcaaggtttctgaagaactcatgaccatcaagctcaaagcaactgggggtaagagcacagggctggctgtcaccacctcctgcagggtgtagaccctggctccccaaagcgttccgtgtgtcaaagtattctctaggtgggaagcataattttaatgtacaagaagaaaggtttcctcagatttgaactaaaattataactttgtttaaaaaccaa

SEQ ID NO: 20473 - DNA, 558 bp, Homo sapiens
  ENST00000518501
atttttcaaatgaattaaaacatctttgattgctaactgacaacatcacaaggacatcactttcccacatcaatggaatcaaataatcgaatgtgatgttgaaacaggtacctaaggaagtaactcatcatgctatgatttttagttttctttcaggtagtccactggttcttatataatataaatccttggtacactagcttctgcatgtcctatactgtgttaacttatctcgcacagagaagctacctcctccgtaatctactgggcagaggaaatgaacctgggaaatgcgcttgactctaatgatgtattttctattgactcagctgtccaacaccaggatgtgatggaagtggccacgtgacaggaaactatgcatctcatcgcagtgtttctggatgtcctttagcagataagactctaaaatccctcatggctgccaactctcaggagcttaagtgtccaaccccaggctgcgatggctcggggcacgtgactggaaactatgcttcccacagaagcttgtccggatgccctcgtgcaaggaaaggtggt

SEQ ID NO: 20474 - DNA, 2579 bp, Homo sapiens
  ENST00000517580
ggtaaataacacagagcaaagttagcaagttgcagcgcctctgcgttctgattctatggaacctttttgtagggagaagggcaggatgtttttaactgaatgtgacctcaggggaatactagagaaaataataaaatttctgaatggggcagcgtggagaaatcctaagagaaatagcataagagcattttggaacacatccaggaaaagataactttcgacacacctgtagacgttcgccaggtaaaggagtgatggaaactctccagttcagatccagtagcttttagggaaggaactacagttgctgacttaagttgaagaagcatctatttaatgtctggtcaaatcctacaagaaacacagaaatctatgattaaaaagctgagcactttgatatactgcaaagggtagagaaggcaggacggtagaaattttctgcaagaaagaatgaatttcaggatttatcactaaataagacaaagtcatttatttagtccccctgacacagcagggcaaactgagttgacatacaagttacctggagaaaaagagagcaattccaggacttcctcttcagcctaaaagaaggtaccagatctgtgcactggggcgatgtggaagagacctgcttattgcccctgatgtaagctccagtaagaaaagacgtcaagtacaagtactaggaaatcactttatacatctgtttataggtttatggatgcagaggctgaagataaaacgctgcgtactcgctctaaaggaaccgaggtgccaatggattcactaatccaggagctcagtgttgcctatgattgctccatggcaaagaagagaacagctgaagatcaggctttgggggttccagtcaacaaaaggaaatccctgctaatgaagccccgacactacagcccaaaagcagactgccaagaagaccgcagtgacaggacagaggacgatggccccttggaaacacatggtcactctaccgcagaggaaatcatgataaaacctatggatgaaagtcttctttcaactgcacaagaaaactccagtaggaaggaagacagatactcttgttatcaagagctcatggtcaagtctttaatgcacttggggaaatttgaaaaaaatgtatctgttcagactgtaagtgaaaatttaaatgacagtggcatccagtctttaaaagcagagagcgatgaagcagacgagtgctttctgattcattctgatgatggaagagacaagattgatgattctcagccacccttctgctcctctgatgacaatgaaagtaactctgaaagtgcagaaaatggctgggacagtggctccaacttctcagaagaaaccaaaccacctagagtcccaaagtatgttttaacagatcataaaaaagacctattggaagttcctgaaataaaaactgaaggtgacaaatttatcccttgtgagaacaggtgtgattctgaaacagaaaggaaagacccgcagaatgctctcgcagaacccctggatggcaatgcccagccctcattccctgacgttgaggaggaagatagcgagagcctggcagtaatgacggaagagggtagtgacctggaaaaggccaaggggaatttaagtttgctggagcaggcaattgctctgcaggctgagcgaggttgtgttttccataacacctacaaagagctggataggttcctgctggagcacctagcaggggaaaggaggcaaaccaaagttatcgacatgggtggaagacaaatctttaacaataaacattcaccaaggcctgaaaagagggagaccaagtgcccgatccctggatgtgatggcacgggacacgtgacagggctctacccgcaccaccgcagcctttcggggtgcccccacaaagtgcgggttcccctggaaattcttgccatgcatgaaaatgtgctcaagtgtcccacgccgggatgcacaggaaggggtcatgtgaacagcaaccgcaacacccacaggagtctttctggttgtccaattgctgcagctgaaaaattggcaatgtcccaggataaaaatcagcttgattctccccaaactgggcagtgtcctgaccaggcccacaggacaagtttggtgaagcaaattgaattcaatttcccgtcacaagccatcacctctcccagagccacagtgtcaaaagaacaagagaagtttggaaaagtaccatttgattatgccagttttgatgcccaagttttcggtaaacgccctctcatacaaacagtgcaaggacgaaaaacaccaccatttcctgaatcaaagcattttccaaatccagtgaaatttcctaatcgactgcctagtgcaggcgcccacacccagagccctggccgtgccagctcttatagctacggtcaatgtagtgaagacacccacatagcagcagctgctgccatcctgaacctttccacccgctgcagggaagccacagacatcctctccaacaagccacagagtctgcatgccaagggagccgaaatagaagtggatgaaaatggcacattggacttaagcatgaaaaaaaa

SEQ ID NO: 20475 - DNA, 697 bp, Homo sapiens
  ENST00000520257
gtactaggaaatcactttatacatctgtttatagatggatgcagaggctgaagataaaacgctgcgtactcgctctaaaggaaccgaggtgccaatggattcactaatccaggagctcagattgcccctgtgagaatagagagaagtagactcctagactcacaaagtgctcaaggtaattctctcgagcccctaaggaccatcctcctggtctttggaagctgacccagagcctacagtctgtcctggaagatcagcaagctctgcgttcttgaaggaaaagctggaaggctcacacaaccctggccattgtcaaagaaacttggcttcccaacattgcaacctccctggtttcctctacctctcagactgcatcttctcaggtctccttgctggtttctcaacaccccagtctctgacactggattccccaagtgttgcctatgattgctccatggcaaagaagagaacagctgaagatcaggctttgggggttccagtcaacaaaaggaaatccctgctaatgaagccccgacactacagcccaaaagcagactgccaagaagaccgcagtgacaggacagaggacgatggccccttggaaacacatggtcactctaccgcagaggaaatcatgataaaacctatggatgaaagtcttctttcaactgcacaagaaaactccagtaggaaggaa

SEQ ID NO: 20476 - DNA, 955 bp, Homo sapiens
  ENST00000521549
tggaacctttttgtagggagaagggcaggatgtttttaactgaatgtgacctcaggggaatactagaggtaaggagagaaaaataattgaggtaactgtgggtgttttacatctcggaaaccatggcttttaataaggccacatgaagagagaagctggcatcatcccacgcaaaaaccagtgcctggcagagttgtggaagaaaataataaaatttctgaatggggcagcgtggagaaatcctaagagaaatagcataagagcattttggaacacatccaggaaaagataactttcgacacacctgtagacgttcgccaggtaaaggagtgatggaaactctccagttcagatccagtagcttttagggaaggaactacagttgctgacttaagttgaagaagcatctatttaatgtctggtcaaatcctacaagaaacacagaaatctatgattaaaaagctgagcactttgatatactgcaaagggtagagaaggcaggacggtagaaattttctgcaagaaagaatgaatttcaggatttatcactaaataagacaaagtcatttatttagtccccctgacacagcagggcaaactgagttgacatacaagttacctggagaaaaagagagcaattccaggacttcctcttcagcctaaaagaaggtaccagatctgtgcactggggcgatgtggaagagacctgcttattgcccctgatgtaagctccagtaagaaaagacgtcaagtacaagtactaggaaatcactttatacatctgtttataggtttatggatgcagaggctgaagataaaacgctgcgtactcgctctaaaggaaccgaggtgccaatggattcactaatccaggagctcagattgcccctgtgagaatagagagaagtagactcctagactcacaaagtgctcaagtgttgcctatgattgctcc

SEQ ID NO: 20477 - DNA, 808 bp, Homo sapiens
  ENST00000518037
agcccccaattttgtgagtgtccctgaagcattgtgacaattccattttatgtgtctgcgtgctcatatcaagactaaggagtgatggaaactctccagttcagatccagtagcttttagggaaggaactacagttgctgacttaagttgaagaagcatctatttaatgtctggtcaaatcctacaagaaacacagaaatctatgattaaaaagctgagcactttgatatactgcaaagggtagagaaggcaggacggtagaaattttctgcaagaaagaatgaatttcaggatttatcactaaataagacaaagtcatttatttagtccccctgacacagcagggcaaactgagttgacatacaagttacctggagaaaaagagagatggatgcagaggctgaagataaaacgctgcgtactcgctctaaaggaaccgaggtgccaatggattcactaatccaggagctcaggccagacctgaacattagaatccaagaaactgacaccttcaagaaaaccctttttacctataagccactttgagagggactcaagactgatcacccaagaagctgatgataaaaattaatttagaagagaagtgtccctccagggtgtggcagaggcatctgtagggttcagccaccccggcatcggccttgtccatgcctctgtgtgatggaggggctccgtgtggaacatgaggctggaggcctcacaccaacagaagcattccagagattattttatgtttactgtactgttcttactagggcagaaaagtgtcttaaaatatattggggaa

SEQ ID NO: 20478 - DNA, 818 bp, Homo sapiens
  ENST00000517456
agcccccaattttgtgagtgtccctgaagcattgtgacaattccattttatgtgtctgcgtgctcatatcaagactaaggagtgatggaaactctccagttcagatccagtagcttttagggaaggaactacagttgctgacttaagttgaagaagcatctatttaatgtctggtcaaatcctacaagaaacacagaaatctatgattaaaaagctgagcactttgatatactgcaaagggtagagaaggcaggacggtagaaattttctgcaagaaagaatgaatttcaggatttatcactaaataagacaaagtcatttatttagtccccctgacacagcagggcaaactgagttgacatacaagttacctggagaaaaagagagcaattccaggacttcctcttcagcctaaaagaaggtaccagatctgtgcactggggcgatgtggaagagacctgcttattgcccctgatatggatgcagaggctgaagataaaacgctgcgtactcgctctaaaggaaccgaggtgccaatggattcactaatccaggagctcagaatcagtgtgcccgtggacatgaggccacttacctggtgagggacaccagagtcctttaaaggaaccaagtcattcagagaaaaaaaggccagacctgaacattagaatccaagaaactgacaccttcaagaaaaccctttttacctataagccactttgagagggactcaagactgatcacccaagaagctgatgataaaaattaatttagaagagaagtgtccctccagggtgtggcagaggcatctgtagggt

SEQ ID NO: 20479 - DNA, 629 bp, Homo sapiens
  ENST00000519118
agaggatgtttagttcaagagaggatgatattgttacaagacattcagagcccccaattttgtgagtgtccctgaagcattgtgacaattccattttatgtgtctgcgtgctcatatcaagactaaggagtgatggaaactctccagttcagatccagtagcttttagggaaggaactacagttgctgacttaagttgaagaagcatctatttaatgtctggtcaaatcctacaagaaacacagaaatctatgattaaaaagctgagcactttgatatactgcaaagggtagagaaggcaggacggtagaaattttctgcaagaaagaatgaatttcaggatttatcactaaataagacaaagtcatttatttagtccccctgacacagcagggcaaactgagttgacatacaagttacctggagaaaaagagagcaattccaggacttcctcttcagcctaaaagaaggtaccagatctgtgcactggggcgatgtggaagagacctgcttattgcccctgatgtaagctccagtaagaaaagacgtcaagtacaagtactaggaaatcactttatacatctgtttatagatggatgcagaggctgaagataaaacgctgcgtactcg

SEQ ID NO: 20480 - DNA, 572 bp, Homo sapiens
  ENST00000518545
atcactgcttccctgatgtcagcgtgagaggcagaacaaaggctaggaggcaccgagcccccaattttgtgagtgtccctgaagcattgtgacaattccattttatgtgtctgcgtgctcatatcaagactaaggagtgatggaaactctccagttcagatccagtagcttttagggaaggaactacagttgctgacttaagttgaagaagcatctatttaatgtctggtcaaatcctacaagaaacacagaaatctatgattaaaaagctgagcactttgatatactgcaaagggtagagaaggcaggacggtagaaattttctgcaagaaagaatgaatttcaggatttatcactaaataagacaaagtcatttatttagtccccctgacacagcagggcaaactgagttgacatacaagttacctggagaaaaagagagcaattccaggacttcctcttcagcctaaaagaaggtaccagatctgtgcactggggcgatgtggaagagacctgcttattgcccctgatgtaagctccagtaagaaaagacgtcaagtacaagtactagg

SEQ ID NO: 20481 - DNA, 584 bp, Homo sapiens
  ENST00000521119
gtcatatcatgggaactacctttcaaagaaacagctttagtgtttccgttcagcccaccagggaggagagaaatataagttttggaaacaaacaaaaaagagtgatggaaactctccagttcagatccagtagcttttagggaaggaactacagttgctgacttaagttgaagaagcatctatttaatgtctggtcaaatcctacaagaaacacagaaatctatgattaaaaagctgagcactttgatatactgcaaagggtagagaaggcaggacggtagaaattttctgcaagaaagaatgaatttcaggatttatcactaaataagacaaagtcatttatttagtccccctgacacagcagggcaaactgagttgacatacaagttacctggagaaaaagagaggtaaggcgacatttttatttattaaaaagtagaacatgttgaaagaaaatgaattcaatcaaagaatttatacgaaagctctcctctacaacagctctttctctgtggattcgcttacaaatttattgttagtgttgaatttagaattgcaatttttgtcagaaatacagccattta

SEQ ID NO: 20482 - DNA, 573 bp, Homo sapiens
  ENST00000518453
ttactttcaggatttagaaagagctttgtttgccagtgtgactgttttccaggatcttttgttttaggttagtgtatggcaaacaaaggggaataggcaggtggaaagcttcagaactctttctgaactgagggcgcaatagaataggccaaaaacatttggagagaaagccgtttttttttttttagttgcaatcaaacgcaaactaagaattcccaagctcctgtgctacttttcaattcttacatcatgtgcagtaatctgctctatcacttgagagttttatctccatttttccccaggaactacagttgctgacttaagttgaagaagcatctatttaatgtctggtcaaatcctacaagaaacacagaaatctatgattaaaaagctgagcactttgatatactgcaaagggtagagaaggcaggacggtagaaattttctgcaagaaagaatgaatttcaggatttatcactaaataagacaaagtcatttatttagtccccctgacacagcagggcaaactgagttgacatacaagttacctggagaaaaagagaggtaaggcga

SEQ ID NO: 20483 - DNA, 664 bp, Homo sapiens
  ENST00000520279
gattctatggaacctttttgtagggagaagggcaggatgtttttaactgaatgtgacctcaggggaatactagagaaaataataaaatttctgaatggggcagcgtggagaaatcctaagagaaatagcataagagcattttggaacacatccaggaaaagataactttcgacacacctgtagacgttcgccaggtaaagagcccccaattttgtgagtgtccctgaagcattgtgacaattccattttatgtgtctgcgtgctcatatcaagactaaggagtgatggaaactctccagttcagatccagtagcttttagggaaggtaagtaaaagctatttaaaaataaacttttcccccaaagaaaaagaatctccaacttttcaacatccatcaaaaacctgagaagttaaggaacttcattttagaggaccagaaaagatgcttgctttggttattgttggcatcctcatggtaatttgggttatgttcatatagatttttgaggagtgtttacacctgttcatcctgattcatgacttcatatgtttgatattaggggcattaatatgtaagacattcagaattaacatgtatgattttaaaatgtggtagacaggataaagtacccctccccaaaatatccatgaaatctctgaaatc

SEQ ID NO: 20484 - DNA, 540 bp, Homo sapiens
  ENST00000519201
gagcaaagttagcaagttgcagcgcctctgcgttctgattctatggaacctttttgtagggagaagggcaggatgtttttaactgaatgtgacctcaggggaatactagagaaaataataaaatttctgaatggggcagcgtggagaaatcctaagagaaatagcataagagcattttggaacacatccaggaaaagataactttcgacacacctgtagacgttcgccaggtaaagatggagttccgctcttgtcgcccaggcggagtacaatggcacagtctcagctcactgcaacctctgcctcctgggttcaagcaattctcgtgcctcagcctcccaagtggctgggattacaagtgtctgccaccacgaccggctaatttttgtatttttggtagagatggggtttcaccatgttggccaggctggtctcagaatcctgacctcaggtgattcacctgcctcagcctctcaaagtgctgggattacaaggcttgaaccactgtgtccagcctcctgcgtttttttttcatttccc

SEQ ID NO: 20485 - DNA, 576 bp, Homo sapiens
  ENST00000524183
agcgcctctgcgttctgattctatggaacctttttgtagggagaagggcaggatgtttttaactgaatgtgacctcaggggaatactagagaaaataataaaatttctgaatggggcagcgtggagaaatcctaagagaaatagcataagagcattttggaacacatccaggaaaagataactttcgacacacctgtagacgttcgccaggtaaagtggctgaagaagagtgcgggagtacagcaggagtggcagaaatccagtggagcacaaacactaagtatgggctcatacagaagaggaggaatcatgccacacccttgccaccccacctgtgccaccccattctcttattcagctcagaaccaggaaggactccttcctggggggaaaaggtaagcaggaggtacccagcagcccctattaccattgtggacaccagcagtcttcaccactggagaattctacagtcctcaaggtccctgagctcagcttggggagctgcctggagttcacatagctgcactgctccaaagaaggagcccacattgtgcctcaactcttgtaggccaagct

SEQ ID NO: 20486 - DNA, 4739 bp, Homo sapiens
  ENST00000522102
actcggcgccagccccacggccatcaccggaccgctggagatgtgactgggctcgggacatgagcccgcttgttcgctcactctcagtgaaaagagttttgaaatgagttctgaatagacagcattttctttgtgcggttggtaaataacacagagcaaagttagcaagttgcagcgcctctgcgttctgattctatggaacctttttgtagggagaagggcaggatgtttttaactgaatgtgacctcaggggaatactagaggtaaggagagaaaaataattgaggtaactgtgggtgttttacatctcggaaaccatggcttttaataaggccacatgaagagagaagctggcatcatcccacgcaaaaaccagtgcctggcagagttgtggaagaaaataataaaatttctgaatggggcagcgtggagaaatcctaagagaaatagcataagagcattttggaacacatccaggaaaagataactttcgacacacctgtagacgttcgccaggtaaaggaaatccaggcccttgagcaatgtattgatgaattggggtggaaatggaggaggatggaaacgatggcggcactggactgttttccagaaaccatttacacaggctcaccagaagagggcagcgcagagcaatgaactctccgaggagtttccaaacagatgtcttgaaacttaaagtgaaaatctctgcatgaaagtagccgtttttggacagcgtcctccaccaaaaccatatatctctaaaataataataaaactccccaaacatgctaatctcgaaatgggtccctcaacatggaaggattgagttgcaagggacaaaattttacttccctgtcagagatgttttcacttcgattatccttttgatttattttattataaaagactatgtgaagtctagtattagtcatgtgcacaaatattcattatgcagctttttggggtgatttttttgataaaaatattgaaaaaatcacaaattcagattcgtggaagattccctacgcaacacagcgtttgaagcaaaatgcagcttaaggaagtttcccattaaatccatatttccttgatgcaaaatgatatcacattgttttacttgttaatttttttcttctcagaattaccacagaaaatattttttgttttataataaaacacgtgatactctacattggacatacattttacacttgaaatctggaaagaaaaacctactagactggaacagaattccaaagaacgtgaggggacaaatctatggagacatttatattttgttttagggttattataaaactctagtttcatcgtctatgcataaatgtttaggggatctaaatatcttcactaaattttattctgtaatcggaaagttggcatttaagatgatcattcttataggctaattaggatgataaaatcctttcctcttttcaaaagttcacgaacgcataacaaattggaactacttttacaagccgagtgtccctcttatgccattagctttcttggatttaccttctagatgactttggctcctgttaacttcagatctttgacatatcaagtatggttgttttcaaaggtttcccaggcaactgcaacaattcatctggttctagtcaaaagtgcccttgaactctcagctcacttcccttccctgtatgagtaatgtgtgtagcaaaaggaaaaacaccaaagacttcatgtaatggctaatgtgaatgatttggtgaagagaggaatggatttcacaaaaggatccacttggatgttaagacctcagctggctgcctgcgggttccctttgtcaagctctcatttgcatttagggggaaggccacaacccacatcatgtgttcggggttctgtttaactcttcctcacagttcctagggccccaaactcttaccctaggtggccccaaggactccttcaaggccagatcgctggcccgccagggagtgactgcccccaaatctctgagagatgcctcaggactccagctgactcacacacacgctgacctgtgagaatcattctgtgcttcttgtttctcacataacccactgggaagcaatggttggagtcttgttgcattttacttacaggaagagttttataattacctcccaagaagttcctgaagaacagaggagggagtaattggaatctctgatcctgttgtttgtgaaaggttcctctgctttacattaattacattctgtgttgcgtttaaaagaaaagatttcacctcatctaggcagacagtgcagttagaccatcaccttttttcccctttattttgactcttgtcttcacagctaatttactagtgactaaaatgatggcaaataaggcaatataatatggacagcctgcaaatcccactcatggagctctgtaagtgggagcagattgctgtctgagtacagggcttctgcagaagtctccctatcaactccacgtcgaactcaaagtctagagagcttcaacaattaatgatatgtcatctggatccagtcataaaagcatgatgaccaccccttcccccacccctcaccattcctttctccttggatttgttatatttcattctgttcaatataattactgagatgtaaacattccattgaaatgtgtctaagtaggcagatttttaagaatctacttttatgggtctataacaaattttaggaaggctatttcattgatatgtgaaagtgtataatagttgctttagctactagcccttccaacagctacatttaccactgtgattgtcactttgaataatccttgtgttattaaaattaatacagataaatataattttatagtaggaaatgtagttgtcaggatgtgaaacaatagtaatcaatttgaataaatatttgctatttgttttcataaaagttttaatcctcaaaagagaactctgaccaaaataggaatatagcaggatcaatgaaacaggtggcatgagtcatctcactggcttttaattaaaaaggatgctgtggttgttggcgtggactggactgcgcataggcagttttagaatttcttaagctgaaatccagctggagagttcttaatcagaatggacttattttgataatttataatctgtgtattcagagcattgatgttatagttttgatacctaaatcaccgttttaaaaattcaaagagatatatgaatcctgagtctcggacagttattcctgagccaaaggatttctgtgcaatgctaatatgtataatagagaatcagtctttcactgtacagttttgtcatcatgtttcaataactgaatgaatattctgaattaataagcataacgtttgtataagctaaagactaatctaagctctgcattcattgatgggaaccttaagcaaatgtttcttttcatcagcttgttcaaaaggcataaacataattacagttctgaggcgataacatatcgactggttaaatagtaagtgggtctggacaaggtaacttaaagttatgggctgcacgttgttttgagtacttggaagcatctggaaaaaataatttttttaaaaagatatttttactgtttatcttatagaaaaacagtatgagcattaaacccccactagaattttggaggttttctttttctaaagcgttggttaaaattcagataagttgatacttacagcttgagagaaaagatggggaagtggtagaaatatcaaatcatgagttagttttaaatttctcagaatgctcagggggcagtgagggaaagagggacttgctggccatgtccccacacctccgctttgcaccttttgctgaagttagttcccgaaaacagtgctgggtgtttgggttacatctggttcagccttcttttcctccttccttctttatccgtcacatggcctgccctctatctcttaaatcttaggtctgttgtgagactggggaaggagtgatgtgaacatgtgctcctgggcctggaaatgcccctctgccccgactccttctgtctcagcagtgcttgtcattaattctcccaacaaatacctgagcccttctctgtgcaggatgggtctcagtgctttgaatgtgctgtctcgtttaattctctcaaaagccctttattgacaatgctcttataatattttatacagaaagaatggaaagctaatccaatctttttctaatgtggttaatcaaatttatttatttttaattaatggtggcttagaaagctttctttcagcattactatcctttatgagattgtcataaatgtttactatttttcattgttcatggcaaggcggcaatagatcttattcagaattgataatcagtgtgatttatctggtagccaaaccaaaaatcaaactattatgctgtttagatataatggtagccactagaagatttacatcaaatgttagaccagaagccctttccatcagtgaccaggtttggtatctgctaggagggaaaagcctggtaactgatcaccagtgtttctgttctttttactttatagtttgtaatttaccaaggcatgattaattttgctgatgtttaagttacttacaatcatattaagagttagagaggagtgatatcagcaagatggctgactaaaagtgcccaacacccatttcctggactacccccacaaaaaatgaataaacaatgaataaacaacta

SEQ ID NO: 20487 - DNA, 501 bp, Homo sapiens
  ENST00000520811
agcgcctctgcgttctgattctatggaacctttttgtagggagaagggcaggatgtttttaactgaatgtgacctcaggggaatactagagaaaataataaaatttctgaatggggcagcgtggagaaatcctaagagaaatagcataagagcattttggaacacatccaggaaaagataactttcgacacacctgtagacgttcgccaggtaaagctaatttactagtgactaaaatgatggcaaataaggcaatataatatggacagcctgcaaatcccactcatggagctctgtaagtgggagcagattgctgtctgagtacagggcttctgcagaagtctccctatcaactccacgtcgaactcaaagtctagagagcttcaacaattaatgatatgtcatctggatccagtcataaaagcatgatgaccaccccttcccccacccctcaccattcctttctccttggatttgttatatttcattctgttcaatata

SEQ ID NO: 20488 - DNA, 836 bp, Homo sapiens
  ENST00000524078
gcccgcttgttcgctcactctcagtgaaaagagttttgaaatgagttctgaatagacagcattttctttgtgcggttggtaaataacacagagcaaagttagcaagttgcagcgcctctgcgttctgattctatggaacctttttgtagggagaagggcaggatgtttttaactgaatgtgacctcaggggaatactagaggtaaggagagaaaaataattgaggtaactgtgggtgttttacatctcggaaaccatggcttttaataaggccacatgaagagagaagctggcatcatcccacgcaaaaaccagtgcctggcagagttgtggaaggtgctatcacattggcttggcatttgtgtagctttgattgaaaatcaatggttttcttatgataattttcacatcatattttttttcttctttagaaaataataaaatttctgaatggggcagcgtggagaaatcctaagagaaatagcataagagcattttggaacacatccaggaaaagataactttcgacacacctgtagacgttcgccaggtaaaggaaatccaggcccttgagcaatgtattgatgaattggggtggaaatggaggaggatggaaacgatggcggcactggactgttttccagaaaccatttacacaggctcaccagaagagggcagcgcagagcaatgaactctccgaggagtttccaaacagatgtcttgaaacttaaagtgaaaatctctgcatgaaagtagccgtttttggacagcgtcctccaccaaaaccatatatctctaaaataataataaaactccccaaacatgctaatctcgaaa

SEQ ID NO: 20489 - DNA, 575 bp, Homo sapiens
  ENST00000520716
cgcttgttcgctcactctcagtgaaaagagttttgaaatgagttctgaatagacagcattttctttgtgcggttggtaaataacacagagcaaagttagcaagttgcagcgcctctgcgttctgattctatggaacctttttgtagggagaagggcaggatgtttttaactgaatgtgacctcaggggaatactagagaaaataataaaatttctgaatggggcagcgtggagaaatcctaagagaaatagcataagagcattttggaacacatccaggaaaagataactttcgacacacctgtagacgttcgccaggtaaaggaaatccaggcccttgagcaatgtattgatgaattggggtggaaatggaggaggatggaaacgatggcggcactggactgttttccagaaaccatttacacaggctcaccagaagagggcagcgcagagcaatgaactctccgaggagtttccaaacagatgtcttgaaacttaaagtgaaaatctctgcatgaaagtagccgtttttggacagcgtcctccaccaaaaccatatatctctaaaataataat

SEQ ID NO: 20490 - DNA, 545 bp, Homo sapiens
  ENST00000523652
atgtgagttcttcaaaattgtcagacgacgtttcccttcagctggtttggagctcattttccaactgctttgcaaaaaataataaaatttctgaatggggcagcgtggagaaatcctaagagaaatagcataagagcattttggaacacatccaggaaaagataactttcgacacacctgtagacgttcgccaggtaaaggtaagaaaaaatattgtaaaatgcatttaagttattttattacatcgcactgggttgaactttgagagaaaacataccactggcgcaagatgcgcaaggaggagttaggagggctcaccttttgcccctccctctcgtgggcatgggcatggcagccctgtgtccaccatgaccatcagcggccacctgagttgtttctaatgccggctgtggagcagtcgaagacatgttcaccaggtcgaggggatctgactgagtatgatactcggcagacagttctgcgaaaaagtcaatgtatttaatactgcaaatgttacttgtacagtaaggaatttcttttagatt

SEQ ID NO: 20491 - DNA, 8872 bp, Homo sapiens
  ENST00000393640
aatatgctcgttccattccctgctggctttgtggccacaaatggaggggcagctacgtttcttgaacacagagcctgagaggccttgtatgcagctgctggaagcagccaggagaccccaaaagtgggctggagacttcaacaaggacagggaacagggctgcactgagaggcccaggggctaggtcagcagcaccgctaggcagatttggaggggagctggggagaggcgaggcagccagctttgcaagattcccacggcacacagccagtgctcaggggttcccttctcagcgttcctctcacctggtgtggctccctcacgcttggcatggatctgagctcctttccttatggctgagacccaaactgcctacaagtggccttttctccctgttcttgcctgcaagggcagcatggggcctcaggctgtcagtgctaccagggacgctggcattcactttgtccataatgtacagatggatgtagacaactgccctcagggctgtccgggggcaggaccaagcccagcaaccacacctcctgacacagccaggttctcccccaacggcggagctgacaggactgttcatggttcattgagtggacccagcaatacctcatcgataatccacagtcgagagaagaggggcggtcagagaccggccagccctcccttctgattgggagaggcctctgcaggcactgacaggctccagagagtgctgtggggggcagtcagtgtccatagtcccctggaatcttctctgggctgttttctctgacttttcacctgaaattaactgtacatagctgggctaggaactctctaaatctgaaagcatgtggcttagggaaaatcacttgactcgtttaccttctggctaagaagtgaagactctgggctaatctagtcctccaggccctggagtcccacacagtgatgctatctgtgcagctagagggcagagcccttggtcatgtccaccctctgattaagtgggcatctcctctcctgctagctttggggcttggggtggggctgggacaaagcctggtgcccgtgtgattcatccgcacattatttctcctctctgccattctagggtcgtgctgcggcagcctggcgcccgacatgtgaaggggaacctgccaggggattactgtgagctcacagcaggataggctggccccgggggagtggggatgggcagaacctgggccaggagtattaggaaggagacctggaccctggtagggagctcagcacaagctcgcctgacccagatggtattggacacagtgccccgctgaacagcagctgttcccagcgccagaggaccccacagccacagtaggagctttgcgacccctacgcaactgcagctggggctggggccaccaggagaagggaccagcacctcagatgggaagcagaagggcaagacctactgcggaaaggatctcgatctctgcagcggagttttcccacactcacagagcttcctgtttttgtcctctcagggttggggtctggctcccctcctctggcagaggttttgggccaggaggtgggacaacacttgcatggaacccaagtcccctgaagcccctgtgctctctgttgtgattggagttctagggcttccccgctgccgggaacgaggggccgcctcattgtctgctcatgaaccacaaggaccccgactgctccagactggattatttcaagccgccaaagagggggacccctagagctggcagccagcaatcccaagggactagagggctgcaatggactgacctccccctcaccagggtggcaggagaggcagagcctctgtggcctagctagtgacggagagacccgatgaagccctaagcaggggccccgcctgactcagggacaggacagccactcctgccaacgtgtgttctccctacatgagggagggcgtggcaagggacccctgccactgtcccctgctgcagcacgtgcccctatgccctttgcatgtggtgccagaataggcaggctacgccgtggctggcccctcagcgggctgggaaaagagtggccacggtgaccgtcacccgcctgccggcaccatgaagtgctccctgcgggtgtggttcctctccgtggccttcctgctggtgttcatcatgtccctgctcttcacctactcgcaccacagcatggccacgctcccctacctggactcaggggccctggatgggacgcaccgggtgaagctggtgcccggctatgccggcctgcagcgcctcagcaaggagaggctctcgggcaagagctgtgcctgtcgccgctgcatgggcgatgccggtgcctccgactggtttgacagccactttgacggtaacatttcccccgtctggacccgagagaacatggatcttccaccggacgtccagaggtggtggatgatgctgcagccccagttcaagtcacacaacaccaatgaggtgctggagaagctgttccagatagtgcctggcgagaacccctaccgcttccgggacccccaccagtgccggcgctgtgccgtggtggggaactcgggcaacctgcggggctctggctatgggcaggacgtggacgggcacaacttcatcatgaggatgaatcaggcgccaaccgtgggctttgagcaggatgttggcagccgaaccacccaccatttcatgtaccctgagagtgccaagaacctgcccgccaacgtcagcttcgtgctggtgcccttcaaggtcctggaccttctgtggatcgccagcgccttgtccacggggcagatccgattcacctacgccccagtgaagtccttccttcgagtggataaagaaaaggtccagatctacaacccagccttcttcaagtatatccacgacaggtggacagagcatcacgggcggtacccttccacggggatgctggtgcttttctttgccctgcatgtgtgtgatgaggtgaacgtgtacgggttcggggccgacagccggggcaactggcaccactactgggagaacaaccggtacgcgggcgagttccggaagactggcgtgcacgacgcggacttcgaggcccacatcatcgacatgctggccaaggccagcaagatcgaagtctaccggggcaactgagccgggcctcgccgcgacccttccggcccatctatcgggcaccggggctccggcccgggacccaggaccagcaacccgcgaccaatcatgctgcagcccaggggcgtctgctgtgccccgccaatcacgagactgggggaccggccgggcctggcaccaatctgcgctgcggtcgggcggagcttctgtttctcccagccaatcatgtgactcaaggaaaacttccggcgctgtgtccagtctcctccaatcaatggccttcgggggcgggccagcggccgctcaatccccactccctcatgctttgggttagggttttctttcacgctttctgaggaggagagcatggcgcgggcctcggcgaagcacttccgtcagcctcgggcggaggatcgtcttagtagctggccagacctggaggagagcgggcggtctttgcgggcctcaggagataggtggccgcccggcccctttccccgcctgcccggataggtgcgtgcagacccaccaaagaaaagcggtcgctgcgggacccccagtcccacctcggccgcgctgtgggatggctgcgcccccagggcttcctgcgtctccaggaagccgggagtggcgccctctgcggggtggggtgctcccgggccgaactccggacaggtggaggggacagggcagagctcgaggaagccctgtccccttcagtgcaaggtgctgtcactcacgtgtgccctcgaccctcccgttcacccgcagccttctcagcgcctctccctgggccggaggcctcctcaccagcctacctgttgctctggaaaaaaatcccgtcccccgactccgtccctacccccagtcttcggccggctctggcccctggggagggggctgcacggcggaaggaggctggctatgggcccggctgcccgctgcatgtacctcctcctccacccatcgcctcttgcctgggggtaactttgcctggggctcattctttggttaagctgaagctgccgtgggtggccaaaccgcagattctttgcaaattctgagctggcagagctcgcagccgggagccggccggggaagaggagacttgcgcgccgcaagccgcctgcctccaccctgctctccatctcccgctctagaagggctgggaagctcgcggccggggttccacctggaagctgcttgcatggctgaacccagcttaggtccctgacggggctgctggtggaattctcccccttcgaagctggggaggtttaggagggggaaggcttctgtgaagctctcaaaccactaatagagccccctccccaacagtgacggcgcagatgctcccccttttcttagttgacaccaccaggcagcttcctggccgttggtaggttcctgcagctggctgagggaacagggaccggcaggggactttgttaggggagggttgggatgggcagtgggcccctgaaagttaatatattggaacctagctcgagtgtcgttctttccaattccgaaagtagaaagagtaaaaataggggtgattggggtggggttagtagaatgcctctctcagggcgctcccccctcccccaccgttttagagagctaggcctcagccagtcttgccactcccatctcagtgcttcctgaagaggctgttttgagtgttgatgaaaagcaatgcaattatgccaaacagtattgagcagaataatttatttcttttttttcttttgctttaaatcatgaatcccgccaggtacggtggctcacacctgtcatcccagcactttgggaggccaaggcgggcggattacttaatacttaaggtcaggagttcgagaccagcctggccaatatggtgaaacctcgtctctaccaaaaaaaaaaaaaaatacaaaaattagccaggcgcagtggtgcgcacctgtaatcccagctacttggaaggctgaggcaggagaatcccttgaaccgaggaggcgaaggttgcagtgagccgagattgtgccactgcactccagcctgggcgacagagcaagaccctgtctcaaaaaaattaaatcatgaatccccatcctggaagaggtaggtcccagcatccagccagattttctgcaatagtaatttaaacacacttttttatttccttccctttctgaattaaaaggaacaaaaaactgtctagtccttcattgttctgaaatgggcatgatggaagaaggcgggtctggtaggatagctgtgactgataatggctgagaacgttgggggatatgggaggggcgagatgactcccagataccctcccccacctatacaggaggcacctcattcctggactctgcgctccaagacactgaaatctgagcgggtacaagcattttggttaaaaatcagctcgttgtcgcctcttgagtttcctccaggagaggagttcattggagaggattcctggtagcagctcctcgcagtggctgtcctgtaaccactttggcctctgtcaacatgatgtctccaggtatccatcaggctccgatacatttgggtggccacaggctgggctgtccccacctctcagggaagtgcatctaagtcaggttttcccctctggcacagccctgcctccacagcccaatttccaccatgccacaggcaacccgcatttttatttatttaatttatttatttattgagacagagtcttgttctgttacccaggctggagtgcaatggcccgatgtcggctcatcccaacctccacctcctgggttcaagcgattcttctgcctcaggagagtagggagtagctgggattacaggcatgcaccaccactcccggataattttatatttttagtagagacgggttttctccatgttggtcaggctagtcttgaactccagacctcaggtgatctgcccgcctcggcctcccaaagtgctgggattacaggcgtgagccagtgtgcctggccgattttttttttttgagactgattctcactctcgcccaggctggagtgcagtggtgggatctcggctcattgcaagctccgcctcccgggttcacgccattctcctgcctcagtctcccgagtagctgagactacaggtgaccgccacgatgcccggcagtttttttgtatttttagtagagacggggtttcactgttagccaggatggtctccatctcctgacctcgtgatctccccgcctcagcctcccaaagtgctgggattacaggcgtgagccaccgcgcctggcttttttttttttttttttttgagatggagtcttgctctgtcacccaggctggagtgcagtggcgcgatcttggctcactgcaacctccgcctcccaagttcacccacctcaacctcccgagtagctggaattacaggggtgtgccaccacacccagctaatttttgtatttttagtagagacggggtttcaccatgttggccaggctggtctcgaactcctgaccacaggtcatccaccccctttggcctcccaatgtttgaccacacccagcccataatagatttttaaaactcctataaatatcattctacttccctttattgctaaaatgggagctttttcatccagttttttgggtgtgttccaaatattttgttaaatttcccgtctattgctgttattgtttccatttatttgcccatgtgagttgatacctttttcattcctttcccatagctttagtgacgttgtgggaagggaagttaggtaagtgatgtttcatcttgtacttactagacacctttttcttccttgatttcctgagttccctgcctccacaggtgtgtttcactcctggttgcttatatttttttatttttgagatggagttttgctctgttgaccaggctggagtgcagtggcatgatctcggctcactgcaacctgtgcctcctgggttcaagcgattctcctgcctcagccacccaaatagctgggattacagatgcgcaccaccatgcccagctaatttttgtatttttagtagagacggggtttcaccatgttggccaggctggtcttgaactcctgacctcgtgatctgcccaccttggcctcccaaggtgctggcattacaggtgtgagccaccgtgcccggcctctggttgcttatttaacccctttgtcacgatggaggcttttctcttttttttttttttttttcagatggagtctctctccattgcccaggctggaatgcagtggtgctatgtccgctcactgcaagctccgcctcccgggttcacaccattctcctgtctcagcctcctgagtagctgggattacaggcatgcactaccacgcccggctaattttgtatttttagtagagacggggtttctccatgttggtcaggctggtcttgaactcctgacgtcaggtgatccgcctgccttggcctcccaaatggtaggattacaggcgtgagccaccagaccctttttttttttttttttttttttttaagagacagggtctcctgtcgcccagactggtgcagagctcactgcagcctcaaaaactcctggattcaagtgatcctcccacctcagcctccagagcagctagagcctagctaaaaaattttttaaaaacattttatggccaggcacggtggctcatgcctataatcccagcattttgggaggctgaggcaggtgaatcacgaggtcaggagttcaagaccagcctggccaagatggtgaaaccccgtctctactaaaaatacaaaaaattggccaggcttagtggcagacggctgtgatcccagctactcgggagaccgaggcagagaattgcttgaacctgggaggtggaagttgtggtgagccgagattgagccactgcactccagcctgagcgacagagtaagactccgtctcaaaaaaaaaaaagtattttacccatccacaggcagcagacaaggaagtaccttctgtgactgtctggcaaggtcagaggcatcagggaaggtaaaatactgaaactatatttttaaaaataaaagtattcccttttgagtgtgaattaggaatcaatgccccttctcactacttttgtgaaaaaaatcacagctcctgcagcaagtctatgcctgggtaacaaccaacccacaaaatccaagaggaggtccccctctcccgcctctgtgaggcttgaggagcagtatgtatctgggccagcctggtcctcagagtgtggaattaacacctttcctctagcaactgtttgtgctgctgagaacagcacagactctctggcagcctggttctctccagagggaagcctgtgaagcagaagaaacatatggcatctgcactcagggcgcccagttccatccggccttgctataaaatgactttgcctttccttttttaaaattacaaaaataattcaaccaatacataaacatatgaagtgaatcacggagggccttcctgcgatatctttttttgcctaccatttgtcatggaatgggtaaaggggaccacagagggaagagacgctgccccttcgcagggccatggcagtcccctgggctgcgtctccacggtgcttcctgtgaaacgctgttaccacgggcaccgcactggagaccatgaaagggaagagtttgacatctcagctgtctttgctataaatagaaataaataaaccttaactaa

SEQ ID NO: 20492 - DNA, 689 bp, Homo sapiens
  ENST00000567822
ggagggtgagcaggttggagtggaccctgtccaggaccccggagccacctgagggatgaatcaggcgccaaccgtgggctttgagcaggatgttggcagccgaaccacccaccatttcatgtaccctgagagtgccaagaacctgcccgccaacgtcagcttcgtgctggtgcccttcaaggtcctggaccttctgtggatcgccagcgccttgtccacggggcagatccgattcacctacgccccagtgaagtccttccttcgagtggataaagaaaaggtccagatctacaacccagccttcttcaagtatatccacgacaggtggacagagcatcacgggcggtacccttccacggggatgctggtgcttttctttgccctgcatgtgtgtgatgaggtgaacgtgtacgggttcggggccgacagccggggcaactggcaccactactgggagaacaaccggtacgcgggcgagttccggaagactggcgtgcacgacgcggacttcgaggcccacatcatcgacatgctggccaaggccagcaagatcgaagtctaccggggcaactgagccgggcctcgccgcgacccttccggcccatctatcgggcaccggggctccggcccgggacccaggaccagcaacccgcgaccaatcatgctgcagcccaggggcgtctgctgtg

SEQ ID NO: 20493 - DNA, 904 bp, Homo sapiens
  ENST00000566097
gaggatgtgaatggggtgggggcagtcgcccctgtcccccacccttcccttcaagccgggcaggggtggggggaggggccgggctgaggcggcggcggcggcggcgctcggggagggttgggccaggcaagggcgggactagcccacggcgggcggacgagagagctgcgagctaacgggtccggacgacggcggcggcggcggcggcggcggcgacggctttctgcgcgggcggcggcggcggccggagcggcgagcatggcccgcgcggcgccgggcgctgactgagggtcgtgctgcggcagcctggcgcccgacatgtgaaggggaacctgccaggggattactgtgagctcacagcaggataggctggccccgggggagtggggatgggcagaacctgggccaggagtattaggaaggagacctggaccctggtagggagctcagcacaagctcgcctgacccagatggtattggacacagtgccccgctgaacagcagctgttcccagcgccagaggaccccacagccacagtaggagctttgcgacccctacgcaactgcagctggggctggggccaccaggagaagggaccagcacctcagatgggaagcagaagggcaagacctactgcggaaaggatctcgatctctgcagcggagttttcccacactcacagagcttcctgtttttgtcctctcagggttggggtctggctcccctcctctggcagaggttttgggccaggaggtgggacaacacttgcatggaacccaagtcccctgaagcccctgtgctctctgttgtgattggagttctagggcttccccgctgccgggaacgaggggccgcctcattgtctgctcatgaaccacaaggaccccgactgctccagactgg

SEQ ID NO: 20494 - DNA, 581 bp, Homo sapiens
  ENST00000561708
actgggatgaggacatggctctggtgtggctgtgttttctcaattctgttgagggatttggggtgagtcgtgctccccctctgtctcctcctttggaagagaatgcccaggacagtggtgccagtttcagggtcgtgctgcggcagcctggcgcccgacatgtgaaggggaacctgccaggggattactgtgagctcacagcaggataggctggccccgggggagtggggatgggcagaacctgggccaggagtattaggaaggagacctggaccctggtagggagctcagcacaagctcgcctgacccagatggtattggacacagtgccccgctgaacagcagctgttcccagcgccagaggaccccacagccacagtaggagctttgcgacccctacgcaactgcagctggggctggggccaccaggagaagggaccagcacctcagatgggaagcagaagggcaagacctactgcggaaaggatctcgatctctgcagcggagttttcccacactcacagagcttcctgtttttgtcctctcagggttggggtctggctcccctcctctggcagagg

SEQ ID NO: 20495 - DNA, 557 bp, Homo sapiens
  ENST00000567586
acggctttctgcgcgggcggcggcggcggccggagcggcgagcatggcccgcgcggcgccgggcgctgactgaggtcacaggaagctgggagcgggaccctgaaagaactcgagttctgtccttagatgttgggcatgcagcaggcaaagggagaatgagaggagacaaggacctggcttcccatctacagactgttcagccaaggccatgcctagagtgggatctgctaaatgggcacagcagaacattggaagaagcacctttgagccagtgctgctggggtctccgtggattagagccaggagccctgatgaggcctgtgggcggggcttcactttcgaccctgagaagccaactccacatctccttccctctcacccttgagccgtgggtagttcagggaggccacagccttctttctgtgccatggcctatcccaaagtcacctccactcacaacgtcgtgaccttagggtcgtgctgcggcagcctggcgcccgacatgtgaaggggaacctgccaggggattactgtgagctcacagcaggataggctgg

SEQ ID NO: 20496 - DNA, 4450 bp, Homo sapiens
  ENST00000342907
cgggcggacgagagagctgcgagctaacgggtccggacgacggcggcggcggcggcggcggcggcgacggctttctgcgcgggcggcggcggcggccggagcggcgagcatggcccgcgcggcgccgggcgctgactgagggtcgtgctgcggcagcctggcgcccgacatgtgaaggggaacctgccaggggattactgtgagctcacagcaggataggctggccccgggggagtggggatgggcagaacctgggccaggagtattaggaaggagacctggaccctggtagggagctcagcacaagctcgcctgacccagatggtattggacacagtgccccgctgaacagcagctgttcccagcgccagaggaccccacagccacagtaggagctttgcgacccctacgcaactgcagctggggctggggccaccaggagaagggaccagcacctcagatgggaagcagaagggcaagacctactgcggaaaggatctcgatctctgcagcggagttttcccacactcacagagcttcctgtttttgtcctctcagggttggggtctggctcccctcctctggcagaggttttgggccaggaggtgggacaacacttgcatggaacccaagtcccctgaagcccctgtgctctctgttgtgattggagttctagggcttccccgctgccgggaacgaggggccgcctcattgtctgctcatgaaccacaaggaccccgactgctccagactggattatttcaagccgccaaagagggggacccctagagctggcagccagcaatcccaagggactagagggctgcaatggactgacctccccctcaccagggtggcaggagaggcagagcctctgtggcctagctagtgacggagagacccgatgaagccctaagcaggggccccgcctgactcagggacaggacagccactcctgccaacgtgtgttctccctacatgagggagggcgtggcaagggacccctgccactgtcccctgctgcagcacgtgcccctatgccctttgcatgtggtgccagaataggcaggctacgccgtggctggcccctcagcgggctgggaaaagagtggccacggtgaccgtcacccgcctgccggcaccatgaagtgctccctgcgggtgtggttcctctccgtggccttcctgctggtgttcatcatgtccctgctcttcacctactcgcaccacagcatggccacgctcccctacctggactcaggggccctggatgggacgcaccgggtgaagctggtgcccggctatgccggcctgcagcgcctcagcaaggagaggctctcgggcaagagctgtgcctgtcgccgctgcatgggcgatgccggtgcctccgactggtttgacagccactttgacggtaacatttcccccgtctggacccgagagaacatggatcttccaccggacgtccagaggtggtggatgatgctgcagccccagttcaagtcacacaacaccaatgaggtgctggagaagctgttccagatagtgcctggcgagaacccctaccgcttccgggacccccaccagtgccggcgctgtgccgtggtggggaactcgggcaacctgcggggctctggctatgggcaggacgtggacgggcacaacttcatcatgaggatgaatcaggcgccaaccgtgggctttgagcaggatgttggcagccgaaccacccaccatttcatgtaccctgagagtgccaagaacctgcccgccaacgtcagcttcgtgctggtgcccttcaaggtcctggaccttctgtggatcgccagcgccttgtccacggggcagatccgattcacctacgccccagtgaagtccttccttcgagtggataaagaaaaggtccagatctacaacccagccttcttcaagtatatccacgacaggtggacagagcatcacgggcggtacccttccacggggatgctggtgcttttctttgccctgcatgtgtgtgatgaggtgaacgtgtacgggttcggggccgacagccggggcaactggcaccactactgggagaacaaccggtacgcgggcgagttccggaagactggcgtgcacgacgcggacttcgaggcccacatcatcgacatgctggccaaggccagcaagatcgaagtctaccggggcaactgagccgggcctcgccgcgacccttccggcccatctatcgggcaccggggctccggcccgggacccaggaccagcaacccgcgaccaatcatgctgcagcccaggggcgtctgctgtgccccgccaatcacgagactgggggaccggccgggcctggcaccaatctgcgctgcggtcgggcggagcttctgtttctcccagccaatcatgtgactcaaggaaaacttccggcgctgtgtccagtctcctccaatcaatggccttcgggggcgggccagcggccgctcaatccccactccctcatgctttgggttagggttttctttcacgctttctgaggaggagagcatggcgcgggcctcggcgaagcacttccgtcagcctcgggcggaggatcgtcttagtagctggccagacctggaggagagcgggcggtctttgcgggcctcaggagataggtggccgcccggcccctttccccgcctgcccggataggtgcgtgcagacccaccaaagaaaagcggtcgctgcgggacccccagtcccacctcggccgcgctgtgggatggctgcgcccccagggcttcctgcgtctccaggaagccgggagtggcgccctctgcggggtggggtgctcccgggccgaactccggacaggtggaggggacagggcagagctcgaggaagccctgtccccttcagtgcaaggtgctgtcactcacgtgtgccctcgaccctcccgttcacccgcagccttctcagcgcctctccctgggccggaggcctcctcaccagcctacctgttgctctggaaaaaaatcccgtcccccgactccgtccctacccccagtcttcggccggctctggcccctggggagggggctgcacggcggaaggaggctggctatgggcccggctgcccgctgcatgtacctcctcctccacccatcgcctcttgcctgggggtaactttgcctggggctcattctttggttaagctgaagctgccgtgggtggccaaaccgcagattctttgcaaattctgagctggcagagctcgcagccgggagccggccggggaagaggagacttgcgcgccgcaagccgcctgcctccaccctgctctccatctcccgctctagaagggctgggaagctcgcggccggggttccacctggaagctgcttgcatggctgaacccagcttaggtccctgacggggctgctggtggaattctcccccttcgaagctggggaggtttaggagggggaaggcttctgtgaagctctcaaaccactaatagagccccctccccaacagtgacggcgcagatgctcccccttttcttagttgacaccaccaggcagcttcctggccgttggtaggttcctgcagctggctgagggaacagggaccggcaggggactttgttaggggagggttgggatgggcagtgggcccctgaaagttaatatattggaacctagctcgagtgtcgttctttccaattccgaaagtagaaagagtaaaaataggggtgattggggtggggttagtagaatgcctctctcagggcgctcccccctcccccaccgttttagagagctaggcctcagccagtcttgccactcccatctcagtgcttcctgaagaggctgttttgagtgttgatgaaaagcaatgcaattatgccaaacagtattgagcagaataatttatttcttttttttcttttgctttaaatcatgaatcccgccaggtacggtggctcacacctgtcatcccagcactttgggaggccaaggcgggcggattacttaatacttaaggtcaggagttcgagaccagcctggccaatatggtgaaacctcgtctctaccaaaaaaaaaaaaaaatacaaaaattagccaggcgcagtggtgcgcacctgtaatcccagctacttggaaggctgaggcaggagaatcccttgaaccgaggaggcgaaggttgcagtgagccgagattgtgccactgcactccagcctgggcgacagagcaagaccctgtctcaaaaaaattaaatcatgaatccccatcctggaagaggtaggtcccagcatccagccagattttctgcaatagtaatttaaacacacttttttatttccttccctttctgaattaaaaggaacaaaaaactgtctagtccttcattgttctgaaatgggcatgatggaagaaggcgggtctggtaggatagctgtgactgataatg

SEQ ID NO: 20497 - DNA, 4431 bp, Homo sapiens
  ENST00000638572
ctcgtgacgtcagaccccgcccacgcgcccctcctccgcatctgagcgggggagcggcggcccccagctgaatgggcgcgagagcggcgctgggggcgggtgggggcgcggggtaccgggctggcggccggccggcgccccctcattagtatgcggacgaaggcggcgggctgcgcggagcggcgtcccctgcagccgcggaccgaggcagcggcggcacctgccggccgagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaagaataaaaacttttgaggaactctcgtagtctggttaatttgggtgcttatgtctatgaatctacccaaaacctccttcttggatgctgctgctaggcggagacctctctgtggatgccagtagtgagggacagagaattaaggcacctggtcctgcaagctgcttgagtccagacaactgtgaacccttctgaagagatgctgggtgtcggtggcttcctccccaaagacaggctgcccctagcttctgtctcttaatggctctagcctctgatatcagaagatctgctactctgttcccagcctgccccagactcggctgccgccatcgctgttctccactctgtggctgctcttgtcactaatgctacctgcctccactttcccttcctgcaactgcttgtgcagccccagtgcagccttggccccagcccattcgaacgtcttcccatctccctcctcctcaccatatgcagggccaggagtcaggtcatagcattcaaagcagagtcccttctgtctcctggggtctgggatccagctcagagtggccaggagagcaaaagtcatatttctctcgttttgtgtctttacagataattttgtatgaattttatttcctactctataagctactgcttgtttaagagaaaatgttttaagattatcacccatcaaatgagtttagaaaattgagactctggaagatggtccacagctcccttgtggctcaggtggtgctgggcttacaccacacagctccacccctacatccctcagggggttattggagaagccggaacttcctcagacaacgttcttaatgctacgagcgcctccttgctggtatgaggagacttgcctacctgcttctcaaggctgctgggatgtgtggtgctcaaagcttccacttggtcagcttgcagccattctcaggcctgctcccatccccatccctcctccctgtaaggcccttcttgcatccttaggttgctttgctcatgtctctcaacttttacttactcaggtggtaagcagataccctaaaaaggtatatttttgtagaccttttatagagtccaccagccaataggagttggctggagatcattctcaagaacttttcacactttggcattcatttgttggaagttgcatcttcacttcagagctgtgcccccattactcccccaccccacacacactcttctgaaaacagacctttgctaggtgcctctgggtgttctaaagttgatctccagtaactgagaattcactgccacactaacagctttgtattgcattctagacccgcacacacaccctccgacataaatgaaatcactggttctgaggcaacttaggaagacttacacatgttctgtattttaacatgcttctagaactttgagctgcagaaaatttcagttttagggttttttaattttaatttttgattgatacatagtgatgtgcatattttgagggtccatgtgataatgtaatacatttgtgtaattataaggagcaaatctgtgtaactgggatatctgtcacattaaatatttgtctttatggtagaaacatttgaattattctagtgattttgaaatacacagtaaattattgtaaactataggcattctactgacctatcaaacactaggtcttgtttcttttatcaaactgtatgtttgtacccattaatcaacctctcttcatttccccctacccttcttggcctctggtaactaccaatctactctctatcttcatgagatccacttttttagctcctacataggaatgagaacatgtgatatttgtctttctgtgtttggcttatttcacttaacatcacctccagttccatccatcttgctgcagataacatgatttcaacctttttatggcagaataatattccattgtgtatatataccacattttctttattcattcacccattgatggacacttaggttgatttcatgttttggctatgtgaatagcgctgcaataaatatgggagtatagatatatcttcaa

SEQ ID NO: 20498 - DNA, 6180 bp, Homo sapiens
  ENST00000639867
aaaaaaaagaaaaaaaaagaagaaaattaagtttgaaacctgaaattaacctcttggtgagaatggaaatggaatgaaatttcactcctttccagatgcagcttctgaagaggagacctggcagcctggcgagcatccagctcgctcacgcacctctttctagtcccgtggccatcagtgagcttctccgggtccctcttgccacttctcagatgttcctttctgtcctaggagatttgtaaaaccagatacttaggatatgattctctagtggagggttaggcctttaggtctctaaaaattgccattcatgaccttcgggcctagggttttgagatgaatgtgcagtgtgtgtggccgctctgtgtgtcccgcttccaccagcttggcattaagcacccggagcatcacctgctgggcaggcctggccaggggtgagcccctccattcgggggctcagggtcaaggcagattccttgcttggctttcctgctgatttcctcatgaagatgccaattcgtatttaaacatttgttatcaatggtggtgtttgtgtgctgatttctataggtagaggctgttgttttaggagccaggtttgctgggccagctcagacctcttacaaagtgaagatactaatgatcgtcttgcaaggtgccatagtgtcgtgagggtgaactgaggcagtggctatgcatggtgtctgcagcagcgtttctgaggctccaagaatatcagttcctttttcagaaatggggccagattcttcggatgtagacagtgttctcttcacggatgctaacaacttatcaaagctataatatattaagtatctctgttataataggatagatgcattcctaaaaaaatgtgttaagcaaaaatcagaaaatgaaaataaaaataacaaggccttgaggaaaagcatagttgggatgaacatttaaacctataccccagtaataatcctcataatgatactgacaaagttgaaaagatatgttgaattcctaataaatatcccagtaaatataggattacacacacacacacacacacacacacacacacacttctgcctgtgagaaggtagtgaataggaggagtaatgcagggccaattccaaggctgctaaatatggagacaaggataaaaaagcacaaagataggaagaactacctgacaggggttctgagtcagcatttgtccagctgagccaagaggaagactggggtgaatggacacgcataccatattcctccaaggttgcgtttttgttttttggggggttttttgtttgtttttttgttttttgagacagagtctcgctctgttgcccaggctggagtatagtggcacgatctcggctcactgcaagctctgcctcccgggttcacaccattctcctgcctcagcctcccgagtagctgggactacaggtgcccaccaccacgtgcccggctaatttttgtatttttagtagagacgagtttcaccgtattagccaggatggtcatgtttttgttcttgtttttgttttagagacagggtctccctctgtcacccaggctggagtgcagtggcacaatcacagctcactacagtgtcaaccttccaggttgaggatcactcgatactcatgcctcagcctcccatgtagctggggccacaggggcacaccaccactcctgacccattttttaaaaaattttttgtataggtggggtctcaccatgttgcccaggctagcctcgaactcctgggctcaagcaaccctctcaccttggcctcccaaagtgctgagattataggtgtgacccgccatgcccgcctttcctctgagttttgttgcattcacgcagctcctggctgaggcaaaacattaaaatgcatatggaaatgcaggctgggaaaatgctttgaaaccaatgcaatttctgtgttaaggggacattccctgattctttcaggtaatttgcattctagactgtgacattctgtatctcaactgataaataagcctgtttgtcatcctgctagatgagaacctgatatatgaaaccttttttttaatcgtggttaaaaaaaacataaaatttaccatcataattatttttaaatgtaccatttggcagcattaagtatatttaaactcttgtgaaacaaatttctagaatgttttcatcttgcaaaaccgaaacgctgtacctattaaacaactccccttttctccctctcttcaaccctggtaaccatgtttttatgaatttgactactttagatacctcatataagtcaggtcatacagtatttgtctctttgtgactggcttcacttagcataatgtcctcaaagtttaactatgttgtagcatgtatcagaattttatgaaacatgaagtcttagacaccccgaagtacattttcaccccaaatgtatttgaacagtgttaggctgggggtgggaggcgggagtccttcttgctttgcctgtgcaatgaaatgaataccctgctgtgtttatctccttgtcatgtgattctcccaggttgtttcttcaagtttctgagccaaacttaactctaaaaagcaaatattctgtgttaaaagacagtaatcaacacgggagctacatcagacatcataggacaaattgtcatctagaagagtatatttttaatgcaggagagtttttaaaacccagattggtgtgatttcattccagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaagaataaaaacttttgaggaactctcgtagtctggttaatttgggtgcttatgtctatgaatctacccaaaacctccttcttggatgctgctgctaggcggagacctctctgtggatgccagtagtgagggacagagaattaaggcacctggtcctgcaagctgcttgagtccagacaactgtgaacccttctgaagagatgctgggtgtcggtggcttcctccccaaagacaggctgcccctagcttctgtctcttaatggctctagcctctgatatcagaagatctgctactctgttcccagcctgccccagactcggctgccgccatcgctgttctccactctgtggctgctcttgtcactaatgctacctgcctccactttcccttcctgcaactgcttgtgcagccccagtgcagccttggccccagcccattcgaacgtcttcccatctccctcctcctcaccatatgcagggccaggagtcaggtcatagcattcaaagcagagtcccttctgtctcctggggtctgggatccagctcagagtggccaggagagcaaaagtcatatttctctcgttttgtgtctttacagataattttgtatgaattttatttcctactctataagctactgcttgtttaagagaaaatgttttaagattatcacccatcaaatgagtttagaaaattgagactctggaagatggtccacagctcccttgtggctcaggtggtgctgggcttacaccacacagctccacccctacatccctcagggggttattggagaagccggaacttcctcagacaacgttcttaatgctacgagcgcctccttgctggtatgaggagacttgcctacctgcttctcaaggctgctgggatgtgtggtgctcaaagcttccacttggtcagcttgcagccattctcaggcctgctcccatccccatccctcctccctgtaaggcccttcttgcatccttaggttgctttgctcatgtctctcaacttttacttactcaggtggtaagcagataccctaaaaaggtatatttttgtagaccttttatagagtccaccagccaataggagttggctggagatcattctcaagaacttttcacactttggcattcatttgttggaagttgcatcttcacttcagagctgtgcccccattactcccccaccccacacacactcttctgaaaacagacctttgctaggtgcctctgggtgttctaaagttgatctccagtaactgagaattcactgccacactaacagctttgtattgcattctagacccgcacacacaccctccgacataaatgaaatcactggttctgaggcaacttaggaagacttacacatgttctgtattttaacatgcttctagaactttgagctgcagaaaatttcagttttagggttttttaattttaatttttgattgatacatagtgatgtgcatattttgagggtccatgtgataatgtaatacatttgtgtaattataaggagcaaatctgtgtaa

SEQ ID NO: 20499 - DNA, 3487 bp, Homo sapiens
  ENST00000461206
gtggcacgatctcggctcactgcaagctctgcctcccgggttcacaccattctcctgcctcagcctcccgagtagctgggactacaggtgcccaccaccacgtgcccggctaatttttgtatttttagtagagacgagtttcaccgtattagccaggatggtcatgtttttgttcttgtttttgttttagagacagggtctccctctgtcacccaggctggagtgcagtggcacaatcacagctcactacagtgtcaaccttccaggttgaggatcactcgatactcatgcctcagcctcccatgtagctggggccacaggggcacaccaccactcctgacccattttttaaaaaattttttgtataggtggggtctcaccatgttgcccaggctagcctcgaactcctgggctcaagcaaccctctcaccttggcctcccaaagtgctgagattataggtgtgacccgccatgcccgcctttcctctgagttttgttgcattcacgcagctcctggctgaggcaaaacattaaaatgcatatggaaatgcaggctgggaaaatgctttgaaaccaatgcaatttctgtgttaaggggacattccctgattctttcaggtaatttgcattctagactgtgacattctgtatctcaactgataaataagcctgtttgtcatcctgctagatgagaacctgatatatgaaaccttttttttaatcgtggttaaaaaaaacataaaatttaccatcataattatttttaaatgtaccatttggcagcattaagtatatttaaactcttgtgaaacaaatttctagaatgttttcatcttgcaaaaccgaaacgctgtacctattaaacaactccccttttctccctctcttcaaccctggtaaccatgtttttatgaatttgactactttagatacctcatataagtcaggtcatacagtatttgtctctttgtgactggcttcacttagcataatgtcctcaaagtttaactatgttgtagcatgtatcagaattttatgaaacatgaagtcttagacaccccgaagtacattttcaccccaaatgtatttgaacagtgttaggctgggggtgggaggcgggagtccttcttgctttgcctgtgcaatgaaatgaataccctgctgtgtttatctccttgtcatgtgattctcccaggttgtttcttcaagtttctgagccaaacttaactctaaaaagcaaatattctgtgttaaaagacagtaatcaacacgggagctacatcagacatcataggacaaattgtcatctagaagagtatatttttaatgcaggagagtttttaaaacccagattggtgtgatttcattccagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataagaactcagtgcactgctcttggtcagtgtggctccaggaacagtgagggacacaggaagctcttcacagtccctgcccacaagggacttaacgtttgagaagttgaaacaaaaacacaaaatggttggatgctccaaactgtcatactgaccctaagttggaggagcatgctgctggctacagttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaagaataaaaacttttgaggaa

SEQ ID NO: 20500 - DNA, 2407 bp, Homo sapiens
  ENST00000640378
gaagaatgtgacatgaaaaaaatgcattatgtggaccctgaccatgtaaagacctacaccgtgcctttaaaggaagcagggccctccctgctgaagcattcagtgagcccaggcaccagcatcttcaaaccgagtcttttctctccttagtgctgctccccgctttccaggccttcctgggatatcttagagctcctgaaggtgcggcactcgccttgaggcactttcttctgagctgtgagctatgggcaagcagtggagggggaagagagcagctgaagcagatgccggttcaacttacttaaagatgtgggacaagctctgaggaagcccccaagacaatgatgtctggttgtgcaccattgaagcaagaacagaaaccatcccagagtggaggacatggcccatgtggtcctcctgttctgagtggctatgagatggagttctgtgtgagctctctacagaaaaagccctgtctccaggcaatcagtggagatctgttaaacgagttgaaacaaaagaggacaaggaattgctgtggctttagacgttgccaggacatgtagaaactcactcaggatttactactgcatccactgtcacttaggcgcaggaggggtcacagtcagaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaagaataaaaacttttgaggaa

SEQ ID NO: 20501 - DNA, 2236 bp, Homo sapiens
  ENST00000393808
ctggggagtaatagcatgggcaaccattatcctgtctcgccgccacccaggacatggcttctgttccaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaagaataaaaacttttgaggaa

SEQ ID NO: 20502 - DNA, 2344 bp, Homo sapiens
  ENST00000393805
gtcacttggagaaggagagattcatacgaactgcgagagcatataaccagcatgtcttgagtcttttacccatgtgcctgttatatggatgctgctgtttttgtaagatgaaatgacccttggatattctgggttatgatcagcatttcttcgtctaggcgagaaaagaaacagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaagaataaaaacttttgaggaa

SEQ ID NO: 20503 - DNA, 2368 bp, Homo sapiens
  ENST00000640322
tttgagaggaagagatgtagggggctttgcacctttgccagacaggactcctgatcaaaggacagcggtgaaacacagggcagcagacagagcctgtgttctgttggctacagctgtgctccagcccccgagggcctgcggaagagacaacgtctcagggggaccagacagaagtccaacataaaaagacaatgcttcacaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaagaataaaaacttttgagga

SEQ ID NO: 20504 - DNA, 4598 bp, Homo sapiens
  ENST00000640712
gttttcttctagtatgtttataacatactacctcttacatttaggtctttgattcgttttgcattaatttttgtatatggtatattagtccattttcactactgataaagacatacctaagactgggcaatttacagaagaggtttaattgtagttacaactccacatggcaggggaagcctcacaatcatggcagaaggcaaggaggagcaagtcacgtcttacatgaatggcagcaggcaaaagagagaaactgtgcagggaaactcccatttttaaaaccatcagatctcatgagacccattcactaccacaagaacggcacaggaaagacctgcccccatgattcagtcatctaccactgggtccttcccacaacacatgggaattatgggagctaccagatgagatttgggtggggacaaagagtcaaaccatatcagtgtgaggtcagggtccaaggtcatccttttgcatgttgttctccagttgtcccaggaccatttgttgaaaagaactttcctctatttgctgcattctttctttctttgctgcctagagcctttccctgcccttcgcccttctgttactcgtattttaagtcaagtctcagctcagcggttaccccttctaagaggctatccctgatcgtccctctgtgtgtgtgagagagccccctcatgccttaatcctgatgtttatcattgtaggatttcagctgttcatcttccccacttgttttccaggccaggtcttgggagacaggggctgtgtgcttaacatcttacattacttaatatgcacttacatatattcaacttcagggggaaggggagatagtacttgaatcacagtgtaatcttccattacctgtgaactctagattgtacagaaaatccggttataacttgtaattctttgagtacatcagtaatgcaccttaggtttaatgtgaggaacaggactgatagttctcttcaacctaaacatccactggtagacagggaaaagcccagcacccgctccctgccccttctccctgaaccatggaatgtaagtcctttcattaggctactgggccaatttttagacctaagctcatggctggaccaatagtagccttcatagatgccaatgcccttccttgatgggcttcagtgaggactcctgaccaatcactgacgaggggggttgggaggacttctgatgggggagttggcctccctggtcctacacctacctgcctggagaaggagccaaagccacttaagcaaaactgagcagcagcccacagtgtccatctaccatgtcaccccagtgctgagcgatttctaaaaggttacttttttcaattatttaaaaaaaacaccaaaaattcaagtaatacggaaataagtaaaggagaaagtcccctgtaatttttcatagagaaagaggaaggaatggggggcagctgtgtaagtcaaacatgtttgtaaaactccgtgagtttgaaactagtaaaatagaaagtgaaagcctgctataattatggtggaattgagggtgtcttattgtgttactagagaatttttttaagtaggtttttaacattttgaccttgttaaaatgctccacttttcaaaacggtcctgacaggatatcctgcttccttccacgcagaagaggtggtttgtgcagaagtgcaggcctcagaatgctttgcacatgagaggaatggcaagagttgcctatcactgaggatttggggaggagggatcacaggatatgggactgaaaatgagacagggccagatagcaaaaggccttgaatgctacactaagcacgaagcagctccttaatttgtgcatcactgaagcaagaatagagtggaggacatggcccgtgtggtcctcgtgttctgagtggctatgacatggagttctgtgtgagctctccatgaagaaaatcccgtctccaggcagtcagtggagatttgatccttaccacaagagcacgtggacaaatttgaattatcgtggatgtatatgggcagaagaaggtctcagagccataagggtggggccctgttagctctgttggttccactcagcagcccacagtgtgagtgggaccctgccagccctgctagacttgagcattgtctggtgacgctggtccccgccttcattactgcagcagaggaagtgtggctgtggcagttgtgggttttgtattttctatttaaatatgtcccttaatgtgccagttgttaaaaagactaccagtgggctctgaagggatgcctggacactttgaaagtgtggttcagatgtgaaattgcactcaaaagatgttttaagagagacgagggcacgttgatgtcagtttcggtttgggctgtgtagtagcagcattttgaacttggccctctctcctttctgagagctaaagaccttatctccctgcggatggcattgcgtgcagttaattatggccagatggactcagccgcttcttcatcgtcttctctcggactctgcagacctacaccgtgcctttaaaggaagcagggccctccctgctgaagcattcagtgagcccaggcaccagcatcttcaaaccgagtcttttctctccttagtgctgctccccgctttccaggccttcctgggatatcttagagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaagaataaaaacttttgagg

SEQ ID NO: 20505 - DNA, 2298 bp, Homo sapiens
  ENST00000638659
tgcggacgaaggcggcgggctgcgcggagcggcgtcccctgcagccgcggaccgaggcagcggcggcacctgccggccgaggcactgtgaagacagtggtgtgcaaagcagagacccctgcttgcatggaatctgcattctagtgggggagacaagacaaacgtgtaattcaaaagtaaaaaacttatgaagaatcacatgtctcatgattagtgttataaagaaaaaagaaagcatgcatacaggaatatccacataagcaattttgcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaa

SEQ ID NO: 20506 - DNA, 2347 bp, Homo sapiens
  ENST00000639311
tatgcggacgaaggcggcgggctgcgcggagcggcgtcccctgcagccgcggaccgaggcagcggcggcacctgccggccgagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaaggtctgagattctgtggttctcagcaatttgccagtgcctgactggaagatggaggctggtttcgtaacctggggctttcaaagttctgaattctgggtggagttgtctcaaacgagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaa

SEQ ID NO: 20507 - DNA, 2165 bp, Homo sapiens
  ENST00000377332
gggtgggggcgcggggtaccgggctggcggccggccggcgccccctcattagtatgcggacgaaggcggcgggctgcgcggagcggcgtcccctgcagccgcggaccgaggcagcggcggcacctgccggccgagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaa

SEQ ID NO: 20508 - DNA, 2131 bp, Homo sapiens
  ENST00000639119
ggggcgggtgggggcgcggggtaccgggctggcggccggccggcgccccctcattagtatgcggacgaaggcggcgggctgcgcggagcggcgtcccctgcagccgcggaccgaggcagcggcggcacctgccggccgagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaa

SEQ ID NO: 20509 - DNA, 4594 bp, Homo sapiens
  ENST00000640763
gaaaaaaatgcattatgtggaccctgaccatgtaaagatgcagcttctgaagaggagacctggcagcctggcgagcatccagctcgctcacgcacctctttctagtcccgtggccatcagtgagcttctccgggtccctcttgccacttctcagatgttcctttctgtcctaggagatttgtaaaaccagatacttaggatatgattctctagtggagggttaggcctttaggtctctaaaaattgccattcatgaccttcgggcctagggttttgagatgaatgtgcagtgtgtgtggccgctctgtgtgtcccgcttccaccagcttggcattaagcacccggagcatcacctgctgggcaggcctggccaggggtgagcccctccattcgggggctcagggtcaaggcagattccttgcttggctttcctgctgatttcctcatgaagatgccaattcgtatttaaacatttgttatcaatggtggtgtttgtgtgctgatttctataggtagaggctgttgttttaggagccaggtttgctgggccagctcagacctcttacaaagtgaagatactaatgatcgtcttgcaaggtgccatagtgtcgtgagggtgaactgaggcagtggctatgcatggtgtctgcagcagcgtttctgaggctccaagaatatcagttcctttttcagaaatggggccagattcttcggatgtagacagtgttctcttcacggatgctaacaacttatcaaagctataatatattaagtatctctgttataataggatagatgcattcctaaaaaaatgtgttaagcaaaaatcagaaaatgaaaataaaaataacaaggccttgaggaaaagcatagttgggatgaacatttaaacctataccccagtaataatcctcataatgatactgacaaagttgaaaagatatgttgaattcctaataaatatcccagtaaatataggattacacacacacacacacacacacacacacacacacttctgcctgtgagaaggtagtgaataggaggagtaatgcagggccaattccaaggctgctaaatatggagacaaggataaaaaagcacaaagataggaagaactacctgacaggggttctgagtcagcatttgtccagctgagccaagaggaagactggggtgaatggacacgcataccatattcctccaaggttgcgtttttgttttttggggggttttttgtttgtttttttgttttttgagacagagtctcgctctgttgcccaggctggagtatagtggcacgatctcggctcactgcaagctctgcctcccgggttcacaccattctcctgcctcagcctcccgagtagctgggactacaggtgcccaccaccacgtgcccggctaatttttgtatttttagtagagacgagtttcaccgtattagccaggatggtcatgtttttgttcttgtttttgttttagagacagggtctccctctgtcacccaggctggagtgcagtggcacaatcacagctcactacagtgtcaaccttccaggttgaggatcactcgatactcatgcctcagcctcccatgtagctggggccacaggggcacaccaccactcctgacccattttttaaaaaattttttgtataggtggggtctcaccatgttgcccaggctagcctcgaactcctgggctcaagcaaccctctcaccttggcctcccaaagtgctgagattataggtgtgacccgccatgcccgcctttcctctgagttttgttgcattcacgcagctcctggctgaggcaaaacattaaaatgcatatggaaatgcaggctgggaaaatgctttgaaaccaatgcaatttctgtgttaaggggacattccctgattctttcaggtaatttgcattctagactgtgacattctgtatctcaactgataaataagcctgtttgtcatcctgctagatgagaacctgatatatgaaaccttttttttaatcgtggttaaaaaaaacataaaatttaccatcataattatttttaaatgtaccatttggcagcattaagtatatttaaactcttgtgaaacaaatttctagaatgttttcatcttgcaaaaccgaaacgctgtacctattaaacaactccccttttctccctctcttcaaccctggtaaccatgtttttatgaatttgactactttagatacctcatataagtcaggtcatacagtatttgtctctttgtgactggcttcacttagcataatgtcctcaaagtttaactatgttgtagcatgtatcagaattttatgaaacatgaagtcttagacaccccgaagtacattttcaccccaaatgtatttgaacagtgttaggctgggggtgggaggcgggagtccttcttgctttgcctgtgcaatgaaatgaataccctgctgtgtttatctccttgtcatgtgattctcccaggttgtttcttcaagtttctgagccaaacttaactctaaaaagcaaatattctgtgttaaaagacagtaatcaacacgggagctacatcagacatcataggacaaattgtcatctagaagagtatatttttaatgcaggagagtttttaaaacccagattggtgtgatttcattccagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataagaactcagtgcactgctcttggtcagtgtggctccaggaacagtgagggacacaggaagctcttcacagtccctgcccacaagggacttaacgtttgagaagttgaaacaaaaacacaaaatggttggatgctccaaactgtcatactgaccctaagttggaggagcatgctgctggctacagttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaa

SEQ ID NO: 20510 - DNA, 2467 bp, Homo sapiens
  ENST00000640418
gttgctcctcctccccagcctgcctgtaaacttgaaattttttcttttttgctttttcttttttctttttgagacaggggctcgctctgtcacccaggtcggagtgtaatggtgtgatcacagctcactgcagcctcaaccttctgggctcaagtgatccttatgcctcagcctcctgagcaactgggactacaggcatgtgccaccatgcccagggcagcagacagagcctgtgttctgttggctacagctgtgctccagcccccgagggcctgcggaagagacaacgtctcagggggaccagacagaagtccaacataaaaagacaatgcttcacaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgcc

SEQ ID NO: 20511 - DNA, 3062 bp, Homo sapiens
  ENST00000639472
aaatgatgatcactctctttgtagaaacccctcagcaattcttttttttggggatggagtctcattctgttgtccaggctagagggctggagtgcagtggtgcagtcttggctctctgcagcctccgcatcccaggttcaagcaattctcctgcctcagcctcccgagtagctaggattacaggcgcctgccaccacgcccagttaatttttgtatttttaatagagatggggtttcaccatgttggccaggctggtctcaaactcctgacctcaggagatccacccgcctcagcctccaaaagtgctgggattacaaacatgagccactgcacctggccctcttccagtggttcttgcacatgggcaggttggagaattcctggtagagacagtggtgagggtgtttataatttaaactgaacaaatactaggagctagtgggagatttgttgggtgcggtctcagcaccggcacttcctcagtgcttttgatttcatgggtgaaatttcacactcctgagagacaaatgagaccctgccccccagttgaaatcggaaagtaccatacagtgggagtatttttccttttggtggcgggaatggagtgagatggttataaagaggccctgctgcagttgtgtcaatccaggagtgggtgctttcctcctatgtctgtgtacagctgtacactctgcatggatgggccagacctaattaagagtcgcatgaaaatggtgatcattgcttaatgggaatatccagattgtgaccaaaattgctgttactgaggttgttcacccaccttgttctccagacatgaacttgcatagcttttggctagttccagaaattagacttacttagatggatataagcctttttgagggtattcaaaagcatataaaaatcaaggaatactctaaagagctccaaaaatgctttggtcagtggttcccttgttggaataaattcatggcattccagaagggcagctatggaggagatggccctcacttggtcatattccttttgtctttattggtcacattactttatagtctcacccattatattcaaatacatttcagaggtcagctgtcgaggagtgtatgcacatgtatagacatatgcacaaactagctgtctgtgaaactaatgggacgtattcaacttttcacgtaaactccatgtgatgacaaatttgtatttccaaagctgattctatatcagtcatcatggtcttctggattttctattgggcagaagttctagttggaagatgaagcatatatgaaacgacttcatgggactaggaaatagagtaagtgagagaggatgcgaggtgagggcagtttcagcacttaatagccttaaattggacctattcacttgggcttccctagacaaaatgatggtgttagcaccattgaggaatgtctacctcaaacaaatacaagctggttctgcaattcatctctttgtccagtgccgcctgtgtgaagtggctatttcagagttacttttttgagttggagtgccggatttgcgtagcttttgcaatctataggagtagattgcttcagaaggcagtgcacagggccacatggggtcacacccacagccttggtctgatgagtgggaatgctttctcccctcccctagaaggatgactaacaactgcttgcttgctttccttagccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgc

SEQ ID NO: 20512 - DNA, 1890 bp, Homo sapiens
  ENST00000640315
gcggagcggcgtcccctgcagccgcggaccgaggcagcggcggcacctgccggccgagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataagagtgttgatttcaactggcttcaagcaatggtaaaaaaggaaaccctgaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgc

SEQ ID NO: 20513 - DNA, 5918 bp, Homo sapiens
  ENST00000639743
atagtcactccctatttccccctccccacaaatcctaggcaaccagtaatctactttctgtctgtatagatttgcctattatggacatttcatgttattcatttcatggtctcctgtgactggattctttcacttaggataatgttttgaaggtacacccatgttgtagcatgtatcggtacttcattattatttctggataatacctcattgtatggatatacctcattttgtttatccattcatcagttagtggacatttgggttgtgtccacttttggctattatgaataatgctgctgtgaacatgtgtatgtaagtatttgtgtacctgttttcagttcttttatgtatatactaggaatatagttgctgggtcatatggtaactatgttttgctttttgaggaactgccaagctgttttccaaaatggttgcattattttacattcttgtaagcaaggtaccagagtttcagtttctccgcatctttatcaacatttgttattatctttccttttttactactgtcatcctgatagatgttaagtgatatctcattgtggttttgatttgctgatagctaatgatgctgagcatctttcccatgtgctctcattgaccgtatgtgtgttttctttggaggaatgcccattcagatcctttgcccatttttaattgggctatttgactttttattcttaaattgtaagagttctttctgtgttctggataccagtaccctatatctggtatgtgatttccaagtattttctccactctctaagttgtcttttcactttctttagggtatcatttttagcacaaaagtctttaattctgatgaaacccaatttacctatttttcctttggtcatttatgcttttggtgtcatatctaagaaactattgtttagtcccaagttttcttctagtatgtttataacatactacctcttacatttaggtctttgattcgttttgcattaatttttgtatatggtatattagtccattttcactactgataaagacatacctaagactgggcaatttacagaagaggtttaattgtagttacaactccacatggcaggggaagcctcacaatcatggcagaaggcaaggaggagcaagtcacgtcttacatgaatggcagcaggcaaaagagagaaactgtgcagggaaactcccatttttaaaaccatcagatctcatgagacccattcactaccacaagaacggcacaggaaagacctgcccccatgattcagtcatctaccactgggtccttcccacaacacatgggaattatgggagctaccagatgagatttgggtggggacaaagagtcaaaccatatcagtgtgaggtcagggtccaaggtcatccttttgcatgttgttctccagttgtcccaggaccatttgttgaaaagaactttcctctatttgctgcattctttctttctttgctgcctagagcctttccctgcccttcgcccttctgttactcgtattttaagtcaagtctcagctcagcggttaccccttctaagaggctatccctgatcgtccctctgtgtgtgtgagagagccccctcatgccttaatcctgatgtttatcattgtaggatttcagctgttcatcttccccacttgttttccaggccaggtcttgggagacaggggctgtgtgcttaacatcttacattacttaatatgcacttacatatattcaacttcagggggaaggggagatagtacttgaatcacagtgtaatcttccattacctgtgaactctagattgtacagaaaatccggttataacttgtaattctttgagtacatcagtaatgcaccttaggtttaatgtgaggaacaggactgatagttctcttcaacctaaacatccactggtagacagggaaaagcccagcacccgctccctgccccttctccctgaaccatggaatgtaagtcctttcattaggctactgggccaatttttagacctaagctcatggctggaccaatagtagccttcatagatgccaatgcccttccttgatgggcttcagtgaggactcctgaccaatcactgacgaggggggttgggaggacttctgatgggggagttggcctccctggtcctacacctacctgcctggagaaggagccaaagccacttaagcaaaactgagcagcagcccacagtgtccatctaccatgtcaccccagtgctgagcgatttctaaaaggttacttttttcaattatttaaaaaaaacaccaaaaattcaagtaatacggaaataagtaaaggagaaagtcccctgtaatttttcatagagaaagaggaaggaatggggggcagctgtgtaagtcaaacatgtttgtaaaactccgtgagtttgaaactagtaaaatagaaagtgaaagcctgctataattatggtggaattgagggtgtcttattgtgttactagagaatttttttaagtaggtttttaacattttgaccttgttaaaatgctccacttttcaaaacggtcctgacaggatatcctgcttccttccacgcagaagaggtggtttgtgcagaagtgcaggcctcagaatgctttgcacatgagaggaatggcaagagttgcctatcactgaggatttggggaggagggatcacaggatatgggactgaaaatgagacagggccagatagcaaaaggccttgaatgctacactaagcacgaagcagctccttaatttgtgcatcactgaagcaagaatagagtggaggacatggcccgtgtggtcctcgtgttctgagtggctatgacatggagttctgtgtgagctctccatgaagaaaatcccgtctccaggcagtcagtggagatttgatccttaccacaagagcacgtggacaaatttgaattatcgtggatgtatatgggcagaagaaggtctcagagccataagggtggggccctgttagctctgttggttccactcagcagcccacagtgtgagtgggaccctgccagccctgctagacttgagcattgtctggtgacgctggtccccgccttcattactgcagcagaggaagtgtggctgtggcagttgtgggttttgtattttctatttaaatatgtcccttaatgtgccagttgttaaaaagactaccagtgggctctgaagggatgcctggacactttgaaagtgtggttcagatgtgaaattgcactcaaaagatgttttaagagagacgagggcacgttgatgtcagtttcggtttgggctgtgtagtagcagcattttgaacttggccctctctcctttctgagagctaaagaccttatctccctgcggatggcattgcgtgcagttaattatggccagatggactcagccgcttcttcatcgtcttctctcggactctgcagacctacaccgtgcctttaaaggaagcagggccctccctgctgaagcattcagtgagcccaggcaccagcatcttcaaaccgagtcttttctctccttagtgctgctccccgctttccaggccttcctgggatatcttagagctcctgaaggtgcggcactcgccttgaggcactttcttctgagctgtgagctatgggcaagcagtggagggggaagagagcagctgaagcagatgccggttcaacttacttaaagatgtgggacaagctctgaggaagcccccaagacaatgatgtctggttgtgcaccattgaagcaagaacagaaaccatcccagagtggaggacatggcccatgtggtcctcctgttctgagtggctatgagatggagttctgtgtgagctctctacagaaaaagccctgtctccaggcaatcagtggagatctgttaaacgagttgaaacaaaagaggacaaggaattgctgtggctttagacgttgccaggacatgtagaaactcactcaggatttactactgcatccactgtcacttaggcgcaggaggggtcacagtcagaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcag

SEQ ID NO: 20514 - DNA, 2489 bp, Homo sapiens
  ENST00000638227
ggcggcccccagctgaatgggcgcgagagcggcgctgggggcgggtgggggcgcggggtaccgggctggcggccggccggcgccccctcattagtatgcggacgaaggcggcgggctgcgcggagcggcgtcccctgcagccgcggaccgaggcagcggcggcacctgccggccgaggcactgtgaagacagtggtgtgcaaagcagagacccctgcttgcatggaatctgcattctagtgggggagacaagacaaacgtgtaattcaaaagtaaaaaacttatgaagaatcacatgtctcatgattagtgttataaagaaaaaagaaagcatgcatacaggaatatccacataagcaattttgcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcag

SEQ ID NO: 20515 - DNA, 3722 bp, Homo sapiens
  ENST00000640453
aatatcagttcctttttcagaaatggggccagattcttcggatgtagacagtgttctcttcacggatgctaacaacttatcaaagctataatatattaagtatctctgttataataggatagatgcattcctaaaaaaatgtgttaagcaaaaatcagaaaatgaaaataaaaataacaaggccttgaggaaaagcatagttgggatgaacatttaaacctataccccagtaataatcctcataatgatactgacaaagttgaaaagatatgttgaattcctaataaatatcccagtaaatataggattacacacacacacacacacacacacacacacacacttctgcctgtgagaaggtagtgaataggaggagtaatgcagggccaattccaaggctgctaaatatggagacaaggataaaaaagcacaaagataggaagaactacctgacaggggttctgagtcagcatttgtccagctgagccaagaggaagactggggtgaatggacacgcataccatattcctccaaggttgcgtttttgttttttggggggttttttgtttgtttttttgttttttgagacagagtctcgctctgttgcccaggctggagtatagtggcacgatctcggctcactgcaagctctgcctcccgggttcacaccattctcctgcctcagcctcccgagtagctgggactacaggtgcccaccaccacgtgcccggctaatttttgtatttttagtagagacgagtttcaccgtattagccaggatggtcatgtttttgttcttgtttttgttttagagacagggtctccctctgtcacccaggctggagtgcagtggcacaatcacagctcactacagtgtcaaccttccaggttgaggatcactcgatactcatgcctcagcctcccatgtagctggggccacaggggcacaccaccactcctgacccattttttaaaaaattttttgtataggtggggtctcaccatgttgcccaggctagcctcgaactcctgggctcaagcaaccctctcaccttggcctcccaaagtgctgagattataggtgtgacccgccatgcccgcctttcctctgagttttgttgcattcacgcagctcctggctgaggcaaaacattaaaatgcatatggaaatgcaggctgggaaaatgctttgaaaccaatgcaatttctgtgttaaggggacattccctgattctttcaggtaatttgcattctagactgtgacattctgtatctcaactgataaataagcctgtttgtcatcctgctagatgagaacctgatatatgaaaccttttttttaatcgtggttaaaaaaaacataaaatttaccatcataattatttttaaatgtaccatttggcagcattaagtatatttaaactcttgtgaaacaaatttctagaatgttttcatcttgcaaaaccgaaacgctgtacctattaaacaactccccttttctccctctcttcaaccctggtaaccatgtttttatgaatttgactactttagatacctcatataagtcaggtcatacagtatttgtctctttgtgactggcttcacttagcataatgtcctcaaagtttaactatgttgtagcatgtatcagaattttatgaaacatgaagtcttagacaccccgaagtacattttcaccccaaatgtatttgaacagtgttaggctgggggtgggaggcgggagtccttcttgctttgcctgtgcaatgaaatgaataccctgctgtgtttatctccttgtcatgtgattctcccaggttgtttcttcaagtttctgagccaaacttaactctaaaaagcaaatattctgtgttaaaagacagtaatcaacacgggagctacatcagacatcataggacaaattgtcatctagaagagtatatttttaatgcaggagagtttttaaaacccagattggtgtgatttcattccagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggc

SEQ ID NO: 20516 - DNA, 4478 bp, Homo sapiens
  ENST00000639074
aaaaaaaaaaaaagaaaaaaaaagaagaaaattaagtttgaaacctgaaattaacctcttggtgagaatggaaatggaatgaaatttcactcctttccagatgcagcttctgaagaggagacctggcagcctggcgagcatccagctcgctcacgcacctctttctagtcccgtggccatcagtgagcttctccgggtccctcttgccacttctcagatgttcctttctgtcctaggagatttgtaaaaccagatacttaggatatgattctctagtggagggttaggcctttaggtctctaaaaattgccattcatgaccttcgggcctagggttttgagatgaatgtgcagtgtgtgtggccgctctgtgtgtcccgcttccaccagcttggcattaagcacccggagcatcacctgctgggcaggcctggccaggggtgagcccctccattcgggggctcagggtcaaggcagattccttgcttggctttcctgctgatttcctcatgaagatgccaattcgtatttaaacatttgttatcaatggtggtgtttgtgtgctgatttctataggtagaggctgttgttttaggagccaggtttgctgggccagctcagacctcttacaaagtgaagatactaatgatcgtcttgcaaggtgccatagtgtcgtgagggtgaactgaggcagtggctatgcatggtgtctgcagcagcgtttctgaggctccaagaatatcagttcctttttcagaaatggggccagattcttcggatgtagacagtgttctcttcacggatgctaacaacttatcaaagctataatatattaagtatctctgttataataggatagatgcattcctaaaaaaatgtgttaagcaaaaatcagaaaatgaaaataaaaataacaaggccttgaggaaaagcatagttgggatgaacatttaaacctataccccagtaataatcctcataatgatactgacaaagttgaaaagatatgttgaattcctaataaatatcccagtaaatataggattacacacacacacacacacacacacacacacacacttctgcctgtgagaaggtagtgaataggaggagtaatgcagggccaattccaaggctgctaaatatggagacaaggataaaaaagcacaaagataggaagaactacctgacaggggttctgagtcagcatttgtccagctgagccaagaggaagactggggtgaatggacacgcataccatattcctccaaggttgcgtttttgttttttggggggttttttgtttgtttttttgttttttgagacagagtctcgctctgttgcccaggctggagtatagtggcacgatctcggctcactgcaagctctgcctcccgggttcacaccattctcctgcctcagcctcccgagtagctgggactacaggtgcccaccaccacgtgcccggctaatttttgtatttttagtagagacgagtttcaccgtattagccaggatggtcatgtttttgttcttgtttttgttttagagacagggtctccctctgtcacccaggctggagtgcagtggcacaatcacagctcactacagtgtcaaccttccaggttgaggatcactcgatactcatgcctcagcctcccatgtagctggggccacaggggcacaccaccactcctgacccattttttaaaaaattttttgtataggtggggtctcaccatgttgcccaggctagcctcgaactcctgggctcaagcaaccctctcaccttggcctcccaaagtgctgagattataggtgtgacccgccatgcccgcctttcctctgagttttgttgcattcacgcagctcctggctgaggcaaaacattaaaatgcatatggaaatgcaggctgggaaaatgctttgaaaccaatgcaatttctgtgttaaggggacattccctgattctttcaggtaatttgcattctagactgtgacattctgtatctcaactgataaataagcctgtttgtcatcctgctagatgagaacctgatatatgaaaccttttttttaatcgtggttaaaaaaaacataaaatttaccatcataattatttttaaatgtaccatttggcagcattaagtatatttaaactcttgtgaaacaaatttctagaatgttttcatcttgcaaaaccgaaacgctgtacctattaaacaactccccttttctccctctcttcaaccctggtaaccatgtttttatgaatttgactactttagatacctcatataagtcaggtcatacagtatttgtctctttgtgactggcttcacttagcataatgtcctcaaagtttaactatgttgtagcatgtatcagaattttatgaaacatgaagtcttagacaccccgaagtacattttcaccccaaatgtatttgaacagtgttaggctgggggtgggaggcgggagtccttcttgctttgcctgtgcaatgaaatgaataccctgctgtgtttatctccttgtcatgtgattctcccaggttgtttcttcaagtttctgagccaaacttaactctaaaaagcaaatattctgtgttaaaagacagtaatcaacacgggagctacatcagacatcataggacaaattgtcatctagaagagtatatttttaatgcaggagagtttttaaaacccagattggtgtgatttcattccagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggc

SEQ ID NO: 20517 - DNA, 4001 bp, Homo sapiens
  ENST00000640798
aattatttaaaaaaaacaccaaaaattcaagtaatacggaaataagtaaaggagaaagtcccctgtaatttttcatagagaaagaggaaggaatggggggcagctgtgtaagtcaaacatgtttgtaaaactccgtgagtttgaaactagtaaaatagaaagtgaaagcctgctataattatggtggaattgagggtgtcttattgtgttactagagaatttttttaagtaggtttttaacattttgaccttgttaaaatgctccacttttcaaaacggtcctgacaggatatcctgcttccttccacgcagaagaggtggtttgtgcagaagtgcaggcctcagaatgctttgcacatgagaggaatggcaagagttgcctatcactgaggatttggggaggagggatcacaggatatgggactgaaaatgagacagggccagatagcaaaaggccttgaatgctacactaagcacgaagcagctccttaatttgtgcatcactgaagcaagaatagagtggaggacatggcccgtgtggtcctcgtgttctgagtggctatgacatggagttctgtgtgagctctccatgaagaaaatcccgtctccaggcagtcagtggagatttgatccttaccacaagagcacgtggacaaatttgaattatcgtggatgtatatgggcagaagaaggtctcagagccataagggtggggccctgttagctctgttggttccactcagcagcccacagtgtgagtgggaccctgccagccctgctagacttgagcattgtctggtgacgctggtccccgccttcattactgcagcagaggaagtgtggctgtggcagttgtgggttttgtattttctatttaaatatgtcccttaatgtgccagttgttaaaaagactaccagtgggctctgaagggatgcctggacactttgaaagtgtggttcagatgtgaaattgcactcaaaagatgttttaagagagacgagggcacgttgatgtcagtttcggtttgggctgtgtagtagcagcattttgaacttggccctctctcctttctgagagctaaagaccttatctccctgcggatggcattgcgtgcagttaattatggccagatggactcagccgcttcttcatcgtcttctctcggactctgcagacctacaccgtgcctttaaaggaagcagggccctccctgctgaagcattcagtgagcccaggcaccagcatcttcaaaccgagtcttttctctccttagtgctgctccccgctttccaggccttcctgggatatcttagagctcctgaaggtgcggcactcgccttgaggcactttcttctgagctgtgagctatgggcaagcagtggagggggaagagagcagctgaagcagatgccggttcaacttacttaaagatgtgggacaagctctgaggaagcccccaagacaatgatgtctggttgtgcaccattgaagcaagaacagaaaccatcccagagtggaggacatggcccatgtggtcctcctgttctgagtggctatgagatggagttctgtgtgagctctctacagaaaaagccctgtctccaggcaatcagtggagatctgttaaacgagttgaaacaaaagaggacaaggaattgctgtggctttagacgttgccaggacatgtagaaactcactcaggatttactactgcatccactgtcacttaggcgcaggaggggtcacagtcagaaggttgtttcttcaagtttctgagccaaacttaactctaaaaagcaaatattctgtgttaaaagacagtaatcaacacgggagctacatcagacatcataggacaaattgtcatctagaagagtatatttttaatgcaggagagtttttaaaacccagattggtgtgatttcattccagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataagaactcagtgcactgctcttggtcagtgtggctccaggaacagtgagggacacaggaagctcttcacagtccctgcccacaagggacttaacgtttgagaagttgaaacaaaaacacaaaatggttggatgctccaaactgtcatactgaccctaagttggaggagcatgctgctggctacagttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggc

SEQ ID NO: 20518 - DNA, 2140 bp, Homo sapiens
  ENST00000638321
atgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaaggttgtttcttcaagtttctgagccaaacttaactctaaaaagcaaatattctgtgttaaaagacagtaatcaacacgggagctacatcagacatcataggacaaattgtcatctagaagagtatatttttaatgcaggagagtttttaaaacccagattggtgtgatttcattccagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggc

SEQ ID NO: 20519 - DNA, 2297 bp, Homo sapiens
  ENST00000639432
atccatcggggaggcgtgatgtggggccgctggtagaaatttgccggtgaccttccctgcaccctctctgcagccagccttgcggagaagacaggttttggcgaccttttgatttcttctgaattgtaagccgtggcttgacgcgggtgtgcattcattgtacgccttgcgtgtcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggc

SEQ ID NO: 20520 - DNA, 2844 bp, Homo sapiens
  ENST00000639184
gggccggctgggcgcggcgtttccgcctcgaaccccgcgggcagcgcccagggcacgacaccctcaggcgagcccggctggggcgcgggcggagggtcgtggtcccgggccgtgtggaccgggcggggggtcccacgcagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagacctacaccgtgcctttaaaggaagcagggccctccctgctgaagcattcagtgagcccaggcaccagcatcttcaaaccgagtcttttctctccttagtgctgctccccgctttccaggccttcctgggatatcttagagctcctgaaggtgcggcactcgccttgaggcactttcttctgagctgtgagctatgggcaagcagtggagggggaagagagcagctgaagcagatgccggttcaacttacttaaagatgtgggacaagctctgaggaagcccccaagacaatgatgtctggttgtgcaccattgaagcaagaacagaaaccatcccagagtggaggacatggcccatgtggtcctcctgttctgagtggctatgagatggagttctgtgtgagctctctacagaaaaagccctgtctccaggcaatcagtggagatctgttaaacgagttgaaacaaaagaggacaaggaattgctgtggctttagacgttgccaggacatgtagaaactcactcaggatttactactgcatccactgtcacttaggcgcaggaggggtcacagtcagaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggc

SEQ ID NO: 20521 - DNA, 2465 bp, Homo sapiens
  ENST00000640982
gacttgtctcttcccgggccggctgggcgcggcgtttccgcctcgaaccccgcgggcagcgcccagggcacgacaccctcaggcgagcccggctggggcgcgggcggagggtcgtggtcccgggccgtgtggaccgggcggggggtcccacgcaggcactgtgaagacagtggtgtgcaaagcagagacccctgcttgcatggaatctgcattctagtgggggagacaagacaaacgtgtaattcaaaagtaaaaaacttatgaagaatcacatgtctcatgattagtgttataaagaaaaaagaaagcatgcatacaggaatatccacataagcaattttgcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggc

SEQ ID NO: 20522 - DNA, 2292 bp, Homo sapiens
  ENST00000640992
ggggctgcggcggcgacttgtctcttcccgggccggctgggcgcggcgtttccgcctcgaaccccgcgggcagcgcccagggcacgacaccctcaggcgagcccggctggggcgcgggcggagggtcgtggtcccgggccgtgtggaccgggcggggggtcccacgcagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggc

SEQ ID NO: 20523 - DNA, 2369 bp, Homo sapiens
  ENST00000640425
gggctgcgcggagcggcgtcccctgcagccgcggaccgaggcagcggcggcacctgccggccgagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataagaactcagtgcactgctcttggtcagtgtggctccaggaacagtgagggacacaggaagctcttcacagtccctgcccacaagggacttaacgtttgagaagttgaaacaaaaacacaaaatggttggatgctccaaactgtcatactgaccctaagttggaggagcatgctgctggctacagttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggc

SEQ ID NO: 20524 - DNA, 2064 bp, Homo sapiens
  ENST00000638678
gcggacgaaggcggcgggctgcgcggagcggcgtcccctgcagccgcggaccgaggcagcggcggcacctgccggccgagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggc

SEQ ID NO: 20525 - DNA, 2410 bp, Homo sapiens
  ENST00000640295
atgcggacgaaggcggcgggctgcgcggagcggcgtcccctgcagccgcggaccgaggcagcggcggcacctgccggccgaggcactgtgaagacagtggtgtgcaaagcagagacccctgcttgcatggaatctgcattctagtgggggagacaagacaaacgtgtaattcaaaagtaaaaaacttatgaagaatcacatgtctcatgattagtgttataaagaaaaaagaaagcatgcatacaggaatatccacataagcaattttgcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaaggttgtttcttcaagtttctgagccaaacttaactctaaaaagcaaatattctgtgttaaaagacagtaatcaacacgggagctacatcagacatcataggacaaattgtcatctagaagagtatatttttaatgcaggagagtttttaaaacccagattggtgtgatttcattccagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggc

SEQ ID NO: 20526 - DNA, 2597 bp, Homo sapiens
  ENST00000638885
cgggctggcggccggccggcgccccctcattagtatgcggacgaaggcggcgggctgcgcggagcggcgtcccctgcagccgcggaccgaggcagcggcggcacctgccggccgagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaaggttgtttcttcaagtttctgagccaaacttaactctaaaaagcaaatattctgtgttaaaagacagtaatcaacacgggagctacatcagacatcataggacaaattgtcatctagaagagtatatttttaatgcaggagagtttttaaaacccagattggtgtgatttcattccagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataagaactcagtgcactgctcttggtcagtgtggctccaggaacagtgagggacacaggaagctcttcacagtccctgcccacaagggacttaacgtttgagaagttgaaacaaaaacacaaaatggttggatgctccaaactgtcatactgaccctaagttggaggagcatgctgctggctacagttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggc

SEQ ID NO: 20527 - DNA, 2095 bp, Homo sapiens
  ENST00000640594
gggggcgcggggtaccgggctggcggccggccggcgccccctcattagtatgcggacgaaggcggcgggctgcgcggagcggcgtcccctgcagccgcggaccgaggcagcggcggcacctgccggccgaggcactgtgaagacagtggtgtgcaaagcagagacccctgcttgcatggaatctgcattctagtgggggagacaagacaaacgtgtaattcaaaagtaaaaaacttatgaagaatcacatgtctcatgattagtgttataaagaaaaaagaaagcatgcatacaggaatatccacataagcaattttgcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggc

SEQ ID NO: 20528 - DNA, 2622 bp, Homo sapiens
  ENST00000638484
gggtgggggcgcggggtaccgggctggcggccggccggcgccccctcattagtatgcggacgaaggcggcgggctgcgcggagcggcgtcccctgcagccgcggaccgaggcagcggcggcacctgccggccgaggcactgtgaagacagtggtgtgcaaagcagagacccctgcttgcatggaatctgcattctagtgggggagacaagacaaacgtgtaattcaaaagtaaaaaacttatgaagaatcacatgtctcatgattagtgttataaagaaaaaagaaagcatgcatacaggaatatccacataagcaattttgcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaaggttgtttcttcaagtttctgagccaaacttaactctaaaaagcaaatattctgtgttaaaagacagtaatcaacacgggagctacatcagacatcataggacaaattgtcatctagaagagtatatttttaatgcaggagagtttttaaaacccagattggtgtgatttcattccagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggc

SEQ ID NO: 20529 - DNA, 2168 bp, Homo sapiens
  ENST00000638542
gggtgggggcgcggggtaccgggctggcggccggccggcgccccctcattagtatgcggacgaaggcggcgggctgcgcggagcggcgtcccctgcagccgcggaccgaggcagcggcggcacctgccggccgagcaatgccaagtgagtacacctatgtgaaactgagaagtgattgctcgaggccttccctgcaatggtacacccgagctcaaagcaagatgagaaggcccagcttgttattaaaagacatcctcaaagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataagaactcagtgcactgctcttggtcagtgtggctccaggaacagtgagggacacaggaagctcttcacagtccctgcccacaagggacttaacgtttgagaagttgaaacaaaaacacaaaatggttggatgctccaaactgtcatactgaccctaagttggaggagcatgctgctggctacagttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggc

SEQ ID NO: 20530 - DNA, 2837 bp, Homo sapiens
  ENST00000639820
cgggtgggggcgcggggtaccgggctggcggccggccggcgccccctcattagtatgcggacgaaggcggcgggctgcgcggagcggcgtcccctgcagccgcggaccgaggcagcggcggcacctgccggccgaggcactgtgaagacagtggtgtgcaaagcagagacccctgcttgcatggaatctgcattctagtgggggagacaagacaaacgtgtaattcaaaagtaaaaaacttatgaagaatcacatgtctcatgattagtgttataaagaaaaaagaaagcatgcatacaggaatatccacataagcaattttgcttggcccttctcttgtgatgttgagggacgtggaatccacatggtcccttgcaaatcagaagaagtaatgcctgctgagctgaagtagagggatttgatgaaacttcttgggaagtcaaactcttatactgtggaggctaaagcaatgccatcttggatgctaatctgccatgttgacttctgactaaccccagtcccaggaaggcttctaagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaaggttgtttcttcaagtttctgagccaaacttaactctaaaaagcaaatattctgtgttaaaagacagtaatcaacacgggagctacatcagacatcataggacaaattgtcatctagaagagtatatttttaatgcaggagagtttttaaaacccagattggtgtgatttcattccagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggc

SEQ ID NO: 20531 - DNA, 2848 bp, Homo sapiens
  ENST00000640024
gctgggggcgggtgggggcgcggggtaccgggctggcggccggccggcgccccctcattagtatgcggacgaaggcggcgggctgcgcggagcggcgtcccctgcagccgcggaccgaggcagcggcggcacctgccggccgagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagacctacaccgtgcctttaaaggaagcagggccctccctgctgaagcattcagtgagcccaggcaccagcatcttcaaaccgagtcttttctctccttagtgctgctccccgctttccaggccttcctgggatatcttagagctcctgaaggtgcggcactcgccttgaggcactttcttctgagctgtgagctatgggcaagcagtggagggggaagagagcagctgaagcagatgccggttcaacttacttaaagatgtgggacaagctctgaggaagcccccaagacaatgatgtctggttgtgcaccattgaagcaagaacagaaaccatcccagagtggaggacatggcccatgtggtcctcctgttctgagtggctatgagatggagttctgtgtgagctctctacagaaaaagccctgtctccaggcaatcagtggagatctgttaaacgagttgaaacaaaagaggacaaggaattgctgtggctttagacgttgccaggacatgtagaaactcactcaggatttactactgcatccactgtcacttaggcgcaggaggggtcacagtcagaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggc

SEQ ID NO: 20532 - DNA, 2356 bp, Homo sapiens
  ENST00000640222
gagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagaccttatctccctgcggatggcattgcgtgcagttaattatggccagatggactcagccgcttcttcatcgtcttctctcggactctgcagacctacaccgtgcctttaaaggaagcagggccctccctgctgaagcattcagtgagcccaggcaccagcatcttcaaaccgagtcttttctctccttagtgctgctccccgctttccaggccttcctgggatatcttagagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccag

SEQ ID NO: 20533 - DNA, 2034 bp, Homo sapiens
  ENST00000638178
ctcaggcgagcccggctggggcgcgggcggagggtcgtggtcccgggccgtgtggaccgggcggggggtcccacgcagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgta

SEQ ID NO: 20534 - DNA, 2180 bp, Homo sapiens
  ENST00000638855
ggcggcccccagctgaatgggcgcgagagcggcgctgggggcgggtgggggcgcggggtaccgggctggcggccggccggcgccccctcattagtatgcggacgaaggcggcgggctgcgcggagcggcgtcccctgcagccgcggaccgaggcagcggcggcacctgccggccgagcaatgccaagtgagtacacctatgtgaaactgagaagtgattgctcgaggccttccctgcaatggtacacccgagctcaaagcaagatgagaaggcccagcttgttattaaaagacatcctcaaagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgta

SEQ ID NO: 20535 - DNA, 2995 bp, Homo sapiens
  ENST00000638288
ctcgaaccccgcgggcagcgcccagggcacgacaccctcaggcgagcccggctggggcgcgggcggagggtcgtggtcccgggccgtgtggaccgggcggggggtcccacgcaggcactgtgaagacagtggtgtgcaaagcagagacccctgcttgcatggaatctgcattctagtgggggagacaagacaaacgtgtaattcaaaagtaaaaaacttatgaagaatcacatgtctcatgattagtgttataaagaaaaaagaaagcatgcatacaggaatatccacataagcaattttgcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagacctacaccgtgcctttaaaggaagcagggccctccctgctgaagcattcagtgagcccaggcaccagcatcttcaaaccgagtcttttctctccttagtgctgctccccgctttccaggccttcctgggatatcttagagctcctgaaggtgcggcactcgccttgaggcactttcttctgagctgtgagctatgggcaagcagtggagggggaagagagcagctgaagcagatgccggttcaacttacttaaagatgtgggacaagctctgaggaagcccccaagacaatgatgtctggttgtgcaccattgaagcaagaacagaaaccatcccagagtggaggacatggcccatgtggtcctcctgttctgagtggctatgagatggagttctgtgtgagctctctacagaaaaagccctgtctccaggcaatcagtggagatctgttaaacgagttgaaacaaaagaggacaaggaattgctgtggctttagacgttgccaggacatgtagaaactcactcaggatttactactgcatccactgtcacttaggcgcaggaggggtcacagtcagaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtg

SEQ ID NO: 20536 - DNA, 2160 bp, Homo sapiens
  ENST00000639305
gcggacgaaggcggcgggctgcgcggagcggcgtcccctgcagccgcggaccgaggcagcggcggcacctgccggccgagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtg

SEQ ID NO: 20537 - DNA, 2331 bp, Homo sapiens
  ENST00000638986
ttagtatgcggacgaaggcggcgggctgcgcggagcggcgtcccctgcagccgcggaccgaggcagcggcggcacctgccggccgagatgagtgagaatcgtaacattttattggaggaaggagccatagaaatgttgtcacccaaccctgctttctacagattaccaaacatcctcaaagagattgagtgatttggctgttatcaaatagccaaacacaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtg

SEQ ID NO: 20538 - DNA, 2457 bp, Homo sapiens
  ENST00000639608
agctgaatgggcgcgagagcggcgctgggggcgggtgggggcgcggggtaccgggctggcggccggccggcgccccctcattagtatgcggacgaaggcggcgggctgcgcggagcggcgtcccctgcagccgcggaccgaggcagcggcggcacctgccggccgagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaaggttgtttcttcaagtttctgagccaaacttaactctaaaaagcaaatattctgtgttaaaagacagtaatcaacacgggagctacatcagacatcataggacaaattgtcatctagaagagtatatttttaatgcaggagagtttttaaaacccagattggtgtgatttcattccagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtg

SEQ ID NO: 20539 - DNA, 2967 bp, Homo sapiens
  ENST00000639541
ggcccccagctgaatgggcgcgagagcggcgctgggggcgggtgggggcgcggggtaccgggctggcggccggccggcgccccctcattagtatgcggacgaaggcggcgggctgcgcggagcggcgtcccctgcagccgcggaccgaggcagcggcggcacctgccggccgagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagctaaagaccttatctccctgcggatggcattgcgtgcagttaattatggccagatggactcagccgcttcttcatcgtcttctctcggactctgcagacctacaccgtgcctttaaaggaagcagggccctccctgctgaagcattcagtgagcccaggcaccagcatcttcaaaccgagtcttttctctccttagtgctgctccccgctttccaggccttcctgggatatcttagagctcctgaaggtgcggcactcgccttgaggcactttcttctgagctgtgagctatgggcaagcagtggagggggaagagagcagctgaagcagatgccggttcaacttacttaaagatgtgggacaagctctgaggaagcccccaagacaatgatgtctggttgtgcaccattgaagcaagaacagaaaccatcccagagtggaggacatggcccatgtggtcctcctgttctgagtggctatgagatggagttctgtgtgagctctctacagaaaaagccctgtctccaggcaatcagtggagatctgttaaacgagttgaaacaaaagaggacaaggaattgctgtggctttagacgttgccaggacatgtagaaactcactcaggatttactactgcatccactgtcacttaggcgcaggaggggtcacagtcagaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtg

SEQ ID NO: 20540 - DNA, 2434 bp, Homo sapiens
  ENST00000639945
agtatgcggacgaaggcggcgggctgcgcggagcggcgtcccctgcagccgcggaccgaggcagcggcggcacctgccggccgagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagctaaagaccttatctccctgcggatggcattgcgtgcagttaattatggccagatggactcagccgcttcttcatcgtcttctctcggactctgcagacctacaccgtgcctttaaaggaagcagggccctccctgctgaagcattcagtgagcccaggcaccagcatcttcaaaccgagtcttttctctccttagtgctgctccccgctttccaggccttcctgggatatcttagagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggc

SEQ ID NO: 20541 - DNA, 2940 bp, Homo sapiens
  ENST00000638956
gcccacgcgcccctcctccgcatctgagcgggggagcggcggcccccagctgaatgggcgcgagagcggcgctgggggcgggtgggggcgcggggtaccgggctggcggccggccggcgccccctcattagtatgcggacgaaggcggcgggctgcgcggagcggcgtcccctgcagccgcggaccgaggcagcggcggcacctgccggccgagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagctcctgaaggtgcggcactcgccttgaggcactttcttctgagctgtgagctatgggcaagcagtggagggggaagagagcagctgaagcagatgccggttcaacttacttaaagatgtgggacaagctctgaggaagcccccaagacaatgatgtctggttgtgcaccattgaagcaagaacagaaaccatcccagagtggaggacatggcccatgtggtcctcctgttctgagtggctatgagatggagttctgtgtgagctctctacagaaaaagccctgtctccaggcaatcagtggagatctgttaaacgagttgaaacaaaagaggacaaggaattgctgtggctttagacgttgccaggacatgtagaaactcactcaggatttactactgcatccactgtcacttaggcgcaggaggggtcacagtcagaaggttgtttcttcaagtttctgagccaaacttaactctaaaaagcaaatattctgtgttaaaagacagtaatcaacacgggagctacatcagacatcataggacaaattgtcatctagaagagtatatttttaatgcaggagagtttttaaaacccagattggtgtgatttcattccagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggc

SEQ ID NO: 20542 - DNA, 2318 bp, Homo sapiens
  ENST00000639981
agtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagacctacaccgtgcctttaaaggaagcagggccctccctgctgaagcattcagtgagcccaggcaccagcatcttcaaaccgagtcttttctctccttagtgctgctccccgctttccaggccttcctgggatatcttagagctcctgaaggtgcggcactcgccttgaggcactttcttctgagctgtgagctatgggcaagcagtggagggggaagagagcagctgaagcagatgccggttcaacttacttaaagatgtgggacaagctctgaggaagcccccaagacaatgatgtctggttgtgcaccattgaagcaagaacagaaaccatcccagagtggaggacatggcccatgtggtcctcctgttctgagtggctatgagatggagttctgtgtgagctctctacagaaaaagccctgtctccaggcaatcagtggagatctgttaaacgagttgaaacaaaagaggacaaggaattgctgtggctttagacgttgccaggacatgtagaaactcactcaggatttactactgcatccactgtcacttaggcgcaggaggggtcacagtcagaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctg

SEQ ID NO: 20543 - DNA, 2405 bp, Homo sapiens
  ENST00000640903
gtgcaaagcagagacccctgcttgcatggaatctgcattctagtgggggagacaagacaaacgtgtaattcaaaagtaaaaaacttatgaagaatcacatgtctcatgattagtgttataaagaaaaaagaaagcatgcatacaggaatatccacataagcaattttgcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataagaactcagtgcactgctcttggtcagtgtggctccaggaacagtgagggacacaggaagctcttcacagtccctgcccacaagggacttaacgtttgagaagttgaaacaaaaacacaaaatggttggatgctccaaactgtcatactgaccctaagttggaggagcatgctgctggctacagttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccag

SEQ ID NO: 20544 - DNA, 2169 bp, Homo sapiens
  ENST00000640572
gggctgcgcggagcggcgtcccctgcagccgcggaccgaggcagcggcggcacctgccggccgagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacagagcacgacctccctgaacacttgaaagccaagacctgtcggcgctgtgtggttattggaagcggaggaatactgcacggattagaactgggccacaccctgaaccagttcgatgttgtgataagaactcagtgcactgctcttggtcagtgtggctccaggaacagtgagggacacaggaagctcttcacagtccctgcccacaagggacttaacgtttgagaagttgaaacaaaaacacaaaatggttggatgctccaaactgtcatactgaccctaagttggaggagcatgctgctggctacagttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttccc

SEQ ID NO: 20545 - DNA, 2129 bp, Homo sapiens
  ENST00000640314
gcggagcggcgtcccctgcagccgcggaccgaggcagcggcggcacctgccggccgaggcactgtgaagacagtggtgtgcaaagcagagacccctgcttgcatggaatctgcattctagtgggggagacaagacaaacgtgtaattcaaaagtaaaaaacttatgaagaatcacatgtctcatgattagtgttataaagaaaaaagaaagcatgcatacaggaatatccacataagcaattttgcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacac

SEQ ID NO: 20546 - DNA, 1643 bp, Homo sapiens
  ENST00000639216
gtaattcaaaagtaaaaaacttatgaagaatcacatgtctcatgattagtgttataaagaaaaaagaaagcatgcatacaggaatatccacataagcaattttgcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtg

SEQ ID NO: 20547 - DNA, 1300 bp, Homo sapiens
  ENST00000640835
gtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaaggttgtttcttcaagtttctgagccaaacttaactctaaaaagcaaatattctgtgttaaaagacagtaatcaacacgggagctacatcagacatcataggacaaattgtcatctagaagagtatatttttaatgcaggagagtttttaaaacccagattggtgtgatttcattccagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacat

SEQ ID NO: 20548 - DNA, 2173 bp, Homo sapiens
  ENST00000638523
atgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagacctacaccgtgcctttaaaggaagcagggccctccctgctgaagcattcagtgagcccaggcaccagcatcttcaaaccgagtcttttctctccttagtgctgctccccgctttccaggccttcctgggatatcttagagctcctgaaggtgcggcactcgccttgaggcactttcttctgagctgtgagctatgggcaagcagtggagggggaagagagcagctgaagcagatgccggttcaacttacttaaagatgtgggacaagctctgaggaagcccccaagacaatgatgtctggttgtgcaccattgaagcaagaacagaaaccatcccagagtggaggacatggcccatgtggtcctcctgttctgagtggctatgagatggagttctgtgtgagctctctacagaaaaagccctgtctccaggcaatcagtggagatctgttaaacgagttgaaacaaaagaggacaaggaattgctgtggctttagacgttgccaggacatgtagaaactcactcaggatttactactgcatccactgtcacttaggcgcaggaggggtcacagtcagaaggttgtttcttcaagtttctgagccaaacttaactctaaaaagcaaatattctgtgttaaaagacagtaatcaacacgggagctacatcagacatcataggacaaattgtcatctagaagagtatatttttaatgcaggagagtttttaaaacccagattggtgtgatttcattccagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgt

SEQ ID NO: 20549 - DNA, 1203 bp, Homo sapiens
  ENST00000638581
acgtgtaattcaaaagtaaaaaacttatgaagaatcacatgtctcatgattagtgttataaagaaaaaagaaagcatgcatacaggaatatccacataagcaattttgcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatc

SEQ ID NO: 20550 - DNA, 582 bp, Homo sapiens
  ENST00000639202
agtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtctt

SEQ ID NO: 20551 - DNA, 563 bp, Homo sapiens
  ENST00000640336
aattgcttgacattcagggattagatacaagtgttcgctcaagtactaaaggctgcattcctcgaaatcctagaaagacagagctgggaggggagatgaggctgcaaaccatgcactcattcttagtcataagaagacgtggaggacatgacatggatactgcctggtgtacagagatggttgatggcctgctttgtcagtgtgtctttgtcctttttatttaaataggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggg

SEQ ID NO: 20552 - DNA, 1032 bp, Homo sapiens
  ENST00000640849
gtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagacctacaccgtgcctttaaaggaagcagggccctccctgctgaagcattcagtgagcccaggcaccagcatcttcaaaccgagtcttttctctccttagtgctgctccccgctttccaggccttcctgggatatcttagagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctgg

SEQ ID NO: 20553 - DNA, 779 bp, Homo sapiens
  ENST00000306262
ctgaatgggcgcgagagcggcgctgggggcgggtgggggcgcggggtaccgggctggcggccggccggcgccccctcattagtatgcggacgaaggcggcgggctgcgcggagcggcgtcccctgcagccgcggaccgaggcagcggcggcacctgccggccgagatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggc

SEQ ID NO: 20554 - DNA, 1546 bp, Homo sapiens
  ENST00000639421
atgcggacgaaggcggcgggctgcgcggagcggcgtcccctgcagccgcggaccgaggcagcggcggcacctgccggccgaggcactgtgaagacagtggtgtgcaaagcagagacccctgcttgcatggaatctgcattctagtgggggagacaagacaaacgtgtaattcaaaagtaaaaaacttatgaagaatcacatgtctcatgattagtgttataaagaaaaaagaaagcatgcatacaggaatatccacataagcaattttgcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagacctacaccgtgcctttaaaggaagcagggccctccctgctgaagcattcagtgagcccaggcaccagcatcttcaaaccgagtcttttctctccttagtgctgctccccgctttccaggccttcctgggatatcttagagctcctgaaggtgcggcactcgccttgaggcactttcttctgagctgtgagctatgggcaagcagtggagggggaagagagcagctgaagcagatgccggttcaacttacttaaagatgtgggacaagctctgaggaagcccccaagacaatgatgtctggttgtgcaccattgaagcaagaacagaaaccatcccagagtggaggacatggcccatgtggtcctcctgttctgagtggctatgagatggagttctgtgtgagctctctacagaaaaagccctgtctccaggcaatcagtggagatctgttaaacgagttgaaacaaaagaggacaaggaattgctgtggctttagacgttgccaggacatgtagaaactcactcaggatttactactgcatccactgtcacttaggcgcaggaggggtcacagtcagaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgact

SEQ ID NO: 20555 - DNA, 888 bp, Homo sapiens
  ENST00000639519
atcctcaaatgtacattgcttgtgtttggagtgtggatcctttatatcctcaagttaaattatactactgaagaatgtgacatgaaaaaaatgcattatgtggaccctgaccatgtaaagagctaaagaccttatctccctgcggatggcattgcgtgcagttaattatggccagatggactcagccgcttcttcatcgtcttctctcggactctgcagacctacaccgtgcctttaaaggaagcagggccctccctgctgaagcattcagtgagcccaggcaccagcatcttcaaaccgagtcttttctctccttagtgctgctccccgctttccaggccttcctgggatatcttagagctcctgaaggtgcggcactcgccttgaggcactttcttctgagctgtgagctatgggcaagcagtggagggggaagagagcagctgaagcagatgccggttcaacttacttaaagatgtgggacaagctctgaggaagcccccaagacaatgatgtctggttgtgcaccattgaagcaagaacagaaaccatcccagagtggaggacatggcccatgtggtcctcctgttctgagtggctatgagatggagttctgtgtgagctctctacagaaaaagccctgtctccaggcaatcagtggagatctgttaaacgagttgaaacaaaagaggacaaggaattgctgtggctttagacgttgccaggacatgtagaaactcactcaggatttactactgcatccactgtcacttaggcgcaggaggggtcacagtcagaagaaggcccccaaagacagtgaagctgagtccaagtacgatcctccttttgggttccggaagttctccagtaaagtccagaccctcttgg

SEQ ID NO: 20556 - DNA, 530 bp, Homo sapiens
  ENST00000455892
gtgatgtggggccgctggtagaaatttgccggtgaccttccctgcaccctctctgcagccagccttgcggagaagacaggttttggcgaccttttgatttcttctgaattcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttct

SEQ ID NO: 20557 - DNA, 1201 bp, Homo sapiens
  ENST00000639690
gtgaagacagtggtgtgcaaagcagagacccctgcttgcatggaatctgcattctagtgggggagacaagacaaacgtgtaattcaaaagtaaaaaacttatgaagaatcacatgtctcatgattagtgttataaagaaaaaagaaagcatgcatacaggaatatccacataagcaattttgcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagctaaagaccttatctccctgcggatggcattgcgtgcagttaattatggccagatggactcagccgcttcttcatcgtcttctctcggactctgcagacctacaccgtgcctttaaaggaagcagggccctccctgctgaagcattcagtgagcccaggcaccagcatcttcaaaccgagtcttttctctccttagtgctgctccccgctttccaggccttcctgggatatcttagagctcctgaaggtgcggcactcgccttgaggcactttcttctgagctgtgagctatgggcaagcagtggagggggaagagagcagctgaagcagatgccggttcaacttacttaaagatgtgggacaagctctgaggaagcccccaagacaatgatgtctggttgtgcaccattgaagcaagaacagaaaccatcccagagtggaggacatggcccatgtggtcctcctgttctgagtggctatgagatggagttctgtgtgagctctctacagaaaaagccctgtctccaggcaatcagtggagatctgttaaacgagttgaaacaaaagaggacaaggaattgctgtggctttagacgttgccaggacatgtagaaactcactcaggatttactactgcatccactgtcacttaggcgcaggaggggtcacagtcagaagagagctcagaaatatgctcagcaagtcttgcagaaggaatgtcgtcccaagtttgccaagacatcaatggcgctgttatttgagcacaggtatagcgtggact

SEQ ID NO: 20558 - DNA, 1085 bp, Homo sapiens
  ENST00000473122
agtatgcggacgaaggcggcgggctgcgcggagcggcgtcccctgcagccgcggaccgaggcagcggcggcacctgccggccgagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagaccttatctccctgcggatggcattgcgtgcagttaattatggccagatggactcagccgcttcttcatcgtcttctctcggactctgcagacctacaccgtgcctttaaaggaagcagggccctccctgctgaagcattcagtgagcccaggcaccagcatcttcaaaccgagtcttttctctccttagtgctgctccccgctttccaggccttcctgggatatcttagagctcctgaaggtgcggcactcgccttgaggcactttcttctgagctgtgagctatgggcaagcagtggagggggaagagagcagctgaagcagatgccggttcaacttacttaaagatgtgggacaagctctgaggaagcccccaagacaatgatgtctggttgtgcaccattgaagcaagaacagaaaccatcccagagtggaggacatggcccatgtggtcctcctgttctgagtggctatgagatggagttctgtgtgagctctctacagaaaaagccctgtctccaggcaatcagtggagatctgttaaacgagttgaaacaaaagaggacaaggaattgctgtggctttagacgttgccaggacatgtagaaactcactcaggatttactactgcatccactgtcacttaggcgcaggaggggtcacagtcagaagagagctcagaaatatgctcagcaagtcttgcagaaggaatgtcgtcccaagtttgccaagacatcaatggcgctgttatttgagcacaggta

SEQ ID NO: 20559 - DNA, 2047 bp, Homo sapiens
  ENST00000487896
ctaaaaggttacttttttcaattatttaaaaaaaacaccaaaaattcaagtaatacggaaataagtaaaggagaaagtcccctgtaatttttcatagagaaagaggaaggaatggggggcagctgtgtaagtcaaacatgtttgtaaaactccgtgagtttgaaactagtaaaatagaaagtgaaagcctgctataattatggtggaattgagggtgtcttattgtgttactagagaatttttttaagtaggtttttaacattttgaccttgttaaaatgctccacttttcaaaacggtcctgacaggatatcctgcttccttccacgcagaagaggtggtttgtgcagaagtgcaggcctcagaatgctttgcacatgagaggaatggcaagagttgcctatcactgaggatttggggaggagggatcacaggatatgggactgaaaatgagacagggccagatagcaaaaggccttgaatgctacactaagcacgaagcagctccttaatttgtgcatcactgaagcaagaatagagtggaggacatggcccgtgtggtcctcgtgttctgagtggctatgacatggagttctgtgtgagctctccatgaagaaaatcccgtctccaggcagtcagtggagatttgatccttaccacaagagcacgtggacaaatttgaattatcgtggatgtatatgggcagaagaaggtctcagagccataagggtggggccctgttagctctgttggttccactcagcagcccacagtgtgagtgggaccctgccagccctgctagacttgagcattgtctggtgacgctggtccccgccttcattactgcagcagaggaagtgtggctgtggcagttgtgggttttgtattttctatttaaatatgtcccttaatgtgccagttgttaaaaagactaccagtgggctctgaagggatgcctggacactttgaaagtgtggttcagatgtgaaattgcactcaaaagatgttttaagagagacgagggcacgttgatgtcagtttcggtttgggctgtgtagtagcagcattttgaacttggccctctctcctttctgagagctaaagaccttatctccctgcggatggcattgcgtgcagttaattatggccagatggactcagccgcttcttcatcgtcttctctcggactctgcagacctacaccgtgcctttaaaggaagcagggccctccctgctgaagcattcagtgagcccaggcaccagcatcttcaaaccgagtcttttctctccttagtgctgctccccgctttccaggccttcctgggatatcttagagctcctgaaggtgcggcactcgccttgaggcactttcttctgagctgtgagctatgggcaagcagtggagggggaagagagcagctgaagcagatgccggttcaacttacttaaagatgtgggacaagctctgaggaagcccccaagacaatgatgtctggttgtgcaccattgaagcaagaacagaaaccatcccagagtggaggacatggcccatgtggtcctcctgttctgagtggctatgagatggagttctgtgtgagctctctacagaaaaagccctgtctccaggcaatcagtggagatctgttaaacgagttgaaacaaaagaggacaaggaattgctgtggctttagacgttgccaggacatgtagaaactcactcaggatttactactgcatccactgtcacttaggcgcaggaggggtcacagtcagaaggtgactactgagaaatgtgccctacccacagtctagaaaattaagtttgggctgggcgtggtggctcacatctataatcccagaactttggaaggtggaggcaggtggatcactaggtcaggagtttgagaccagcctgaccaacatggtgaaaccccgtctgtactgaaaatacaaaaagtagccgggtgtgtcagtgcacgcctgtaatcccagctactcaggaacctgaggcaggagaatggcttgaaactgggaggcagaggttgcag

SEQ ID NO: 20560 - DNA, 871 bp, Homo sapiens
  ENST00000461892
ttagtatgcggacgaaggcggcgggctgcgcggagcggcgtcccctgcagccgcggaccgaggcagcggcggcacctgccggccgagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagctaaagaccttatctccctgcggatggcattgcgtgcagttaattatggccagatggactcagccgcttcttcatcgtcttctctcggactctgcagacctacaccgtgcctttaaaggaagcagggccctccctgctgaagcattcagtgagcccaggcaccagcatcttcaaaccgagtcttttctctccttagtgctgctccccgctttccaggccttcctgggatatcttagagctcctgaaggtgcggcactcgccttgaggcactttcttctgagctgtgagctatgggcaagcagtggagggggaagagagcagctgaagcagatgccggttcaacttacttaaagatgtgggacaagctctgaggaagcccccaagacaatgatgtctggttgtgcaccattgaagcaagaacagaaaccatcccagagtggaggacatggcccatgtggtcctcctgttctgagtggctatgagatggagttctgtgtgagctctctacagaaaaagccctgtctccaggcaatcagtggagatctgtt

SEQ ID NO: 20561 - DNA, 803 bp, Homo sapiens
  ENST00000461199
aggcatcgttcatttgaaggggaaaatggttttatgtgctgcgcttcatctggcaccagtggttgcctgctcctcgtggcagggccgtgctgggtgtcacagagaggaaggagactcatctcctgccctctggtgtttagctgccctcccccgggcttatggctgctaatccttttccacggaaggatacagctgctgaaactgtggaagaggaatccatttctgctgcatgaaggggcacagacttgaatacagtcaggacaggttgtggtttcacttgtgtaatcctgagagcttgacagcttcgaggagtgtctaacattgctagtaacagagcctagaagcacctgaattccagctgtcacttggagaaggagagattcatacgaactgcgagagcatataaccagcatgtcttgagtcttttacccatgtgcctgttatatggatgctgctgtttttgtaagatgaaatgacccttggatattctgggttatgatcagcatttcttcgtctaggcgagaaaagaaacagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagacctacaccgtgcctttaaaggaagcagggccc

SEQ ID NO: 20562 - DNA, 544 bp, Homo sapiens
  ENST00000433665
attagtatgcggacgaaggcggcgggctgcgcggagcggcgtcccctgcagccgcggaccgaggcagcggcggcacctgccggccgaggcactgtgaagacagtggtgtgcaaagcagagacccctgcttgcatggaatctgcattctagtgggggagacaagacaaacgtgtaattcaaaagtaaaaaacttatgaagaatcacatgtctcatgattagtgttataaagaaaaaagaaagcatgcatacaggaatatccacataagcaattttgcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagaccttatctccctgcggatggcattgcgtgcag

SEQ ID NO: 20563 - DNA, 588 bp, Homo sapiens
  ENST00000484728
ccctcattagtatgcggacgaaggcggcgggctgcgcggagcggcgtcccctgcagccgcggaccgaggcagcggcggcacctgccggccgagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaaggttagatatcccattggtgtggtttaaatgaaaacattgccaagcatatgctcaaactataatatcattagtctactgtgtgacaaatatatgttaataaaagtttgaactcagaggggaaagcacttaatctcagcactccaaaaccaaagacaaccttcttctaaaaacccaccactaactactccacagtatccttctcccatttactgcagctggggtgtgggatgaggtgggctcaacccaacaggctctaggg

SEQ ID NO: 20564 - DNA, 478 bp, Homo sapiens
  ENST00000490946
atgttgcttgaggtgaagatagcaaacaagacattaggtatacaggtctgggcttaggtgagaggtccacattagagagatggatttggtcttcagggagccattgtcacccctagtctgaagcttgtacttgtcacaaagttactggaagtgccacagcatctgctgcctaaaaacccaagaatccgaatgcacacgactgctgcaggagtcacatgtagacaccttcccttgcctgctactactgctatccaaagcttcaccaagtcaggggaaaagaaagattgcctcccagtctttcaccagcacatcctaggatcacaactttacgagaagccagctgcaatgccaagtgagtacacctatgtgaaactgagaagtgattgctcgaggccttccctgcaatggtacacccgagctcaaagcaagatgagaaggcccagcttgttattaaaagacatcctcaaatgtacattgc

SEQ ID NO: 20565 - DNA, 455 bp, Homo sapiens
  ENST00000638258
agagttgtgggaggacagggagggaattattatttctggaaagagagggaaagttgggcagcaggttttgagaggaagagatgtagggggctttgcacctttgccagacaggactcctgatcaaaggacagcggtgaaacacaggtgtgttgaagaagaggcaagactctcatagggctgatgcatgacatccgggagtcctggggaaggggaggaaagagggcagcagacagagcctgtgttctgttggctacagctgtgctccagcccccgagggcctgcggaagagacaacgtctcagggggaccagacagaagtccaacataaaaagacaatgcttcacaatgccaagtgagtacacctatgtgaaactgagaagtgattgctcgaggccttccctgcaatggtacacccgagctcaaagcaagatgagaaggcccagcttgttattaaaa

SEQ ID NO: 20566 - DNA, 3019 bp, Homo sapiens
  ENST00000526757
tttcaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaagctggaccgacccaccaagcagatgcgagaggcagaggaaaggctcaaagccattccccagttttgcttccctgatgccaaggactggcttcctgtgtcagagtatagcagtgagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtcgggcaaagggcctttttgagcagcgagtggagcagtacttagaagaactcccagacactgagcagagtggaatgaataagtttctccgaggtttgggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttttgtaacaagcaaagagaatatggcaaatatttgtatattcccaaggggccgggtgctttcctgtcctgccagagcatggatgaagtttcgctgggtgctcgtgactggccagttttgtgcagctgactgtctcagccaaaccactgatcttccctggaggccttcggcctgcctgcctgcctgaggtccccgctgccagtcccgggccctggagagcagatgctgtcttgttatgtacaggaggaccttttaaaaaaatcaagtttctattttttgctggtagtccgcatacccataccctctgtttttgaaaggcaaaggccaatcagtccccatttgtagcatggcaccagggtcttaggcctagtcctctcattcctcccaccctccgagatggtcagtgtgtcatgggaagcccacccccagctctgccagtgctctctgggcctggctcccagtcagtggtggccacgatgcggtacagggcatccctccttcccatctacgggtgttctcaataaacaatgtacagttgtttgggcccagag

SEQ ID NO: 20567 - DNA, 4545 bp, Homo sapiens
  ENST00000534127
gggggtcgggggtcgggggctgggggctgaggactgagtcgagccagcagcccagggcatctgtccacgctgtcagaggagcctctgggcgtggggctggcccttagagggctactgcgctgcttaacttgcctttcacagaaaaccactggaggagatactcacaaaaatgaaggggaagaacaggaaacaggaagacatgagatgaaggaaacaggagattcaacatggatttcacaccctttggagagtttctttcttggataattcaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagcccaggatgtagcaggggtcgctgcctgcctcccccttgcccagagcacgccattcccggggccagcagctggcccccggggcgtcttgctgacccgtaccggtacccgcgcccacagcctgggcatccgggagaagatatcagcatgggaaggtcgccgagaggcgtcgcccaggatgagcatgtgtggagagaagcgggagggctctgggagcgagtgggcggccagtgagggctgccccagcctgggctgtcccagcgtggtgccgtccccctgcagctctgaaaagacctttgatttcaagggcctccggaggatgagcaggaccttctccgagtgttcctacccagagactgaggaggagggagaggcgctccctgtccgggactctttctaccggctggagaaacggctgggccggagtgagcccagcgccttcctcagggggcatggcagcaggaaggagagctcagcagtgctgagccggatccagaaaattgaacaggtcctgaaggagcagccgggccgggggctcccccagctccccagcagctgctacagcgtggaccgggggaaaaggaagactggaaccttgggctccttggaggagccggcagggggcgcgagtgtgagcgctggcagccgggcagtcggagtggctggtgttgcgggggaggcgggcccacccccagagagggaaggcagtggttccactaagcccgggacccctggaaatagccctagctcccagcggctgccatcgaagagttccctcgatcccgctgtgaaccctgtccccaaacccaagcgcacctttgaatacgaggctgacaagaaccccaagagtaagcccagtaatggtctacctccttcacccacacctgctgctccacctcccttgccctccaccccagccccgccagtcacccggagacccaagaaggacatgcgtggtcaccgcaagtcccagagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaagctggaccgacccaccaagcagatgcgagaggcagaggaaaggctcaaagccattccccagttttgcttccctgatgccaaggactggcttcctgtgtcagagtatagcagtgagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtcgggcaaagggcctttttgagcagcgagtggagcagtacttagaagaactcccagacactgagcagagtggaatgaataagtttctccgaggtttgggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttttgtaacaagcaaagagaatatggcaaatatttgtatattcccaaggggccgggtgctttcctgtcctgccagagcatggatgaagtttcgctgggtgctcgtgactggccagttttgtgcagctgactgtctcagccaaaccactgatcttccctggaggccttcggcctgcctgcctgcctgaggtccccgctgccagtcccgggccctggagagcagatgctgtcttgttatgtacaggaggaccttttaaaaaaatcaagtttctattttttgctggtagtccgcatacccataccctctgtttttgaaaggcaaaggccaatcagtccccatttgtagcatggcaccagggtcttaggcctagtcctctcattcctcccaccctccgagatggtcagtgtgtcatgggaagcccacccccagctctgccagtgctctctgggcctggctcccagtcagtggtggccacgatgcggtacagggcatccctccttcccatctacgggtgttctcaataaacaatgtacagttgtttgggcccagag

SEQ ID NO: 20568 - DNA, 4507 bp, Homo sapiens
  ENST00000313726
gagagagagagagagagagagagagagagagagacagtgagaaagaaagaaaaagagagcgcccttgtgcacgcgctaggccaagagcgcgccgctgtgcgcgcgcccgcctagcgaggacagggtctccatgacaaccggcctggccggctagcagtgctctgctcacttggctgcgaggagcgccacgaaaggtcagaggaaggagctgtgggaagctcgcagcaggtatcggagcttaagccagtggatttgggggccctgggctccctagccggctgcggtgtgagaatggagtgggcaggaaagcagcgggactttcagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagcccaggatgtagcaggggtcgctgcctgcctcccccttgcccagagcacgccattcccggggccagcagctggcccccggggcgtcttgctgacccgtaccggtacccgcgcccacagcctgggcatccgggagaagatatcagcatgggaaggtcgccgagaggcgtcgcccaggatgagcatgtgtggagagaagcgggagggctctgggagcgagtgggcggccagtgagggctgccccagcctgggctgtcccagcgtggtgccgtccccctgcagctctgaaaagacctttgatttcaagggcctccggaggatgagcaggaccttctccgagtgttcctacccagagactgaggaggagggagaggcgctccctgtccgggactctttctaccggctggagaaacggctgggccggagtgagcccagcgccttcctcagggggcatggcagcaggaaggagagctcagcagtgctgagccggatccagaaaattgaacaggtcctgaaggagcagccgggccgggggctcccccagctccccagcagctgctacagcgtggaccgggggaaaaggaagactggaaccttgggctccttggaggagccggcagggggcgcgagtgtgagcgctggcagccgggcagtcggagtggctggtgttgcgggggaggcgggcccacccccagagagggaaggcagtggttccactaagcccgggacccctggaaatagccctagctcccagcggctgccatcgaagagttccctcgatcccgctgtgaaccctgtccccaaacccaagcgcacctttgaatacgaggctgacaagaaccccaagagtaagcccagtaatggtctacctccttcacccacacctgctgctccacctcccttgccctccaccccagccccgccagtcacccggagacccaagaaggacatgcgtggtcaccgcaagtcccagagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaagctggaccgacccaccaagcagatgcgagaggcagaggaaaggctcaaagccattccccagttttgcttccctgatgccaaggactggcttcctgtgtcagagtatagcagtgagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtcgggcaaagggcctttttgagcagcgagtggagcagtacttagaagaactcccagacactgagcagagtggaatgaataagtttctccgaggtttgggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttttgtaacaagcaaagagaatatggcaaatatttgtatattcccaaggggccgggtgctttcctgtcctgccagagcatggatgaagtttcgctgggtgctcgtgactggccagttttgtgcagctgactgtctcagccaaaccactgatcttccctggaggccttcggcctgcctgcctgcctgaggtccccgctgccagtcccgggccctggagagcagatgctgtcttgttatgtacaggaggaccttttaaaaaaatcaagtttctattttttgctggtagtccgcatacccataccctctgtttttgaaaggcaaaggccaatcagtccccatttgtagcatggcaccagggtcttaggcctagtcctctcattcctcccaccctccgagatggtcagtgtgtcatgggaagcccacccccagctctgccagtgctctctgggcctggctcccagtcagtggtggccacgatgcggtacagggcatccctccttcccatctacgggtgttctcaataaacaatgtacagttgtttgggcccaga

SEQ ID NO: 20569 - DNA, 3396 bp, Homo sapiens
  ENST00000530991
ttctgcctgcttcctgaggagtggggtctgagttcctctggggcgtaaggcacattcagacatctgtagaacaagtgtgggactcagtggcacccaggctcaatcctgctgctgagcagaggtgctggagtgagtcctgctctgcagcaggaaaatagggaaaggggtgcagagagggctgtgttctgagttccccagggacctgttcaccccacggattctgccaccaggattgagctaggactgacccggcccatggtgttactctattttagaaaatgtgtgtgttggaggggtgggggcaggagatacagcttgtggaaaggagtgccactcaacatcttcaagggcagggattctgttttggacttttctgagattttctggtaatgccaatacaatgcccgctgccagagattttagaactagtcctgagaagcaagaactcccctcacccccaccctttggcccagactccttccaagcctttcacacctcccctgtgtcacagcaggagagtttgttccaaaaggggagtgttgatggttctctttttgctgagatcagcggtagagggaatagacactacagtaggagagtcatcgaacagatcattactgaacacttcctccttgctaatcactgttccgttccgaggttgcctcagtgaacaacacaaaaccctgccctaaaagacttgttgaacggcatcgtaggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaagctggaccgacccaccaagcagatgcgagaggcagaggaaaggctcaaagccattccccagttttgcttccctgatgccaaggactggcttcctgtgtcagagtatagcagtgagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtcgggcaaagggcctttttgagcagcgagtggagcagtacttagaagaactcccagacactgagcagagtggaatgaataagtttctccgaggtttgggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttttgtaacaagcaaagagaatatggcaaatatttgtatattcccaaggggccgggtgctttcctgtcctgccagagcatggatgaagtttcgctgggtgctcgtgactggccagttttgtgcagctgactgtctcagccaaaccactgatcttccctggaggccttcggcctgcctgcctgcctgaggtccccgctgccagtcccgggccctggagagcagatgctgtcttgttatgtacaggaggaccttttaaaaaaatcaagtttctattttttgctggtagtccgcatacccataccctctgtttttgaaaggcaaaggccaatcagtccccatttgtagcatggcaccagggtcttaggcctagtcctctcattcctcccaccctccgagatggtcagtgtgtcatgggaagcccacccccagctctgccagtgctctctgggcctggctcccagtcagtggtggccacgatgcggtacagggcatccctccttcccatctacgggtgttctcaataaacaatgtacagttgtttgggcccag

SEQ ID NO: 20570 - DNA, 2404 bp, Homo sapiens
  ENST00000526099
gtgaacaacacaaaaccctgccctaaaagacttgttgaacggcatcgtaggtgagaagggggcctggcgaagccctgctccctacggttctgtgagttcctccatgcccaccctccaaagagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaagctggaccgacccaccaagcagatgcgagaggcagaggaaaggctcaaagccattccccagttttgcttccctgatgccaaggactggcttcctgtgtcagagtatagcagtgagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtcgggcaaagggcctttttgagcagcgagtggagcagtacttagaagaactcccagacactgagcagagtggaatgaataagtttctccgaggtttgggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttttgtaacaagcaaagagaatatggcaaatatttgtatattcccaaggggccgggtgctttcctgtcctgccagagcatggatgaagtttcgctgggtgctcgtgactggccagttttgtgcagctgactgtctcagccaaaccactgatctt

SEQ ID NO: 20571 - DNA, 367 bp, Homo sapiens
  ENST00000527540
gaatctataaacatggaacccatggacgcagaactcatggatatggaggacaggctgtatttaccatattgcattacaaagaggaatcccaggttcccacatacatcaggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttttgtaacaagcaaagagaatatggcaa

SEQ ID NO: 20572 - DNA, 769 bp, Homo sapiens
  ENST00000532162
cgggactcatgccctgagccactctgctaatgactccttttctcaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtcgggcaaagggcctttttgagcagcgagtggagcagtacttagaagaactcccagacactgagcagagtggaatgaataagtttctccgaggtttgggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttttgtaacaagc

SEQ ID NO: 20573 - DNA, 1352 bp, Homo sapiens
  ENST00000534278
gagcctggtacctggtgctgggagaccctgcagagctgaggcctgtcctgagagtggtggctgttccttcagggctctggttgcagagaggtttagaggaggcttaaagtcttcctccactagaagggcagtccttactcctccgttcccaaggaaaaggagccagaaatggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtcgggcaaagggcctttttgagcagcgagtggagcagtacttagaagaactcccagacactgagcagagtggaatgaataagtttctccgaggtttgggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttt

SEQ ID NO: 20574 - DNA, 602 bp, Homo sapiens
  ENST00000524513
tttttgctatttcatcagctcattcgagggctttttcatctcatcacaatttttctgtctaacctcagggttagtacttcttctgtcctctaatactatccatttagtataacaacctttttggaacaacatggtagagttgtctgaaggaagctagagatgtccacttggggcagctctgaactgagaagcagcctcctcacctagtgcagcttgggaatgtgcatggggaggcagggtggcagcagcaaaccccggcaagatgtcactaatgatcgccttgatgagccagcccgaattctagtaagatgctcctgcaaattatcatcccagatgttttctttctccttttttggcatctgtgctccatggttcccttcatgtaggcctctccttcccttcctccaatgactgttctcttccctgtgcctgtttcttttacccaggcctttttgagcagcgagtggagcagtacttagaagaactcccagacactgagcagagtggaatgaataagtttctccgaggtttgggcaacaaaatgaagtttctccacaagaagaattaagcctccttctcagtagcagagtccagtgccttgc

SEQ ID NO: 20575 - DNA, 2679 bp, Homo sapiens
  ENST00000530438
gaagaaaacaagtccactcactgtcttctcccttctcccctctgagctgttcaagcaagttcccaggagcagttcagagcccctgttggactggaagggaggtaggaggagtggaatgcatgcaaaaaccgagctgatcaaaagacagtgctgtttcatggaagcctcccagaactgagagagagagagagagagagagagagagagagacagtgagaaagaaagaaaaagagagcgcccttgtgcacgcgctaggccaagagcgcgccgctgtgcgcgcgcccgcctagcgaggacagggtctccatgacaaccggcctggccggctagcagtgctctgctcacttggctgcgaggagcgccacgaaaggtcagaggaaggagctgtgggaagctcgcagcaggtatcggagcttaagccagtggatttgggggccctgggctccctagccggctgcggtgtgagaatggagtgggcaggaaagcagcgggactttcagggctctgggtttgcagagagccgaaatgaccatgactgccaacaagaattccagcatcacccacggagctggtggcactaaagcccctcgggggactctgagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaagctggaccgacccaccaagcagatgcgagaggcagaggaaaggctcaaagccattccccagttttgcttccctgatgccaaggactggcttcctgtgtcagagtatagcagtgagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtcgggcaaagggcctttttgagcagcgagtggagcagtacttagaagaactcccagacactgagcagagtggaatgaataagtttctccgaggtttgggcaacaaaatgaagtttctccacaagaagaattaa

SEQ ID NO: 20576 - DNA, 480 bp, Homo sapiens
  ENST00000532738
atgaggttgatgatagttatgagggttactgggagagataaatgagattatctactcacgctcttctaacaggtcttagcacatagtaagtgctcagtgtcagctatgattgtcactgtgctttctttctcctgcagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtc

SEQ ID NO: 20577 - DNA, 776 bp, Homo sapiens
  ENST00000526062
acctgcctcagtgtgcgccagctcatccgaatctttgcctcactgctgctggagcgccgggtcatttttgtggcagataagctcagctgcctctgagcacattccaggaccattctgggagggacgatcccaaggtcttgttcttggcctggccgggtattcaagttctgccaatctggggtcttggaaaagatgtccttcctgttctgcctggggtctgcctctggctggagaggggagggtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctggagaggaagaatgagctgatctcccaggactctgacagcgactccgacgatgaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggctt

SEQ ID NO: 20578 - DNA, 463 bp, Homo sapiens
  ENST00000532871
cctgacacccttcctctttgggctgctggcggtgggcacaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatggacgacgaagacacgttgttacctaggaagttacaggcagctctggagcaggctctgg

SEQ ID NO: 20579 - DNA, 551 bp, Homo sapiens
  ENST00000533081
gtcctagatgaggtggagcgccggcgtgggatctccgctgcattggtctatcctttcatgagaagtctcatggagtcgcccttcccagccccagggaagaccatcaaagtgaagacattcctgccaggtgctggcaatgaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggcgctgatggtgaatctgggatctgaccgattcatccgacagatagagggacctgctaagttgcccaggctggtctcgaactc

SEQ ID NO: 20580 - DNA, 1440 bp, Homo sapiens
  ENST00000526701
aagccattccccagttttgcttccctgatgccaaggactggcttcctgtgtcagagtatagcagtgagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgagttttcaggaggcctgcacatctatgctgcacacacatgctgcgggaccaaggaggaggccaggcagaccccagggacagctgctttggcacggcctgagcgtcagcagttcctcctgccctcaccgctggagtcactcactaccttccacccctgtgactcccccagagaagtggctctctgagctgtggcactcaccttgggagcagcctttggaggaaagagggccaggcctggccctgataagacagtcctgcttcctggcaaggctgcagaatggccagccctttgcttatgttttccttgtgactggcatgggacttagggtgatggagataaaggccaggatagcaggacaaacagcctctggaaggaaactctttctgcaggaaagggagggggacagggcaacaaggaccccagcattgcccttccagaggcaatggctgggattagagtcctgggatgcggagatgcctggagagcagtggggtctagtcagcactgggggcttagacctttgtctggggaggtgggcaggaggaccctagagatgtggctgtgtggttcccttcttctccctatctctaagagcagtcagctctcctctcttcctgaggtcccgatggatggcccctcaactccttccttctggagccttccccgctttcacaggcagccctcttgcccacaggctgggtgttcgagtgctacgagagcagagctgtagtccgagggatggagaagaggggtttactgcatagcagggtagacgagagacctggaaaagagcaggttggaaggggaaagcagctccagttgcttcgtggagggccagagggcagcacccacttggctggccccggcccactttcccatcgctctcctgcaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcagctgcctctgagcacattccaggaccattctgggagggacgatcccaa

SEQ ID NO: 20581 - DNA, 190 bp, Homo sapiens
  ENST00000530922
ctgcatagcagggtagacgagagacctggaaaagagcaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcaggt

SEQ ID NO: 20582 - DNA, 738 bp, Homo sapiens
  ENST00000530559
cccccacgccagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagccaagtgggaaagggccccggttgccagaggtgtactgtgtcatcagccgccttggctgcttcggcttgttttccaaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcag

SEQ ID NO: 20583 - DNA, 1309 bp, Homo sapiens
  ENST00000533020
gtagcctccccactgcagacgggcagctgcatgactcatgagctgaggggccaggcagaagccattctctttggttcacaggaattctgcttgtttatttgtgtgtgtgtgagttcgtgtgtttccttcttcccttctcccccttctctaactcttcctcctctgcaggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaagctggaccgacccaccaagcagatgcgagaggcagaggaaaggctcaaagccattccccagttttgcttccctgatgccaaggactggcttcctgtgtcagagtatagcagtgagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgaggtgttagagctgcggcggcccatggactcaaggctggagcacgtgga

SEQ ID NO: 20584 - DNA, 566 bp, Homo sapiens
  ENST00000526837
aagccattccccagttttgcttccctgatgccaaggactggcttcctgtgtcagagtatagcagtgagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgagttttcaggaggcctgcacatctatgctgcacacacatgctgcgggaccaaggaggaggccaggcagaccccagggacagctgctttggcacggcctgagcgtcagcagttcctcctgccctcaccgctggagtcactcactaccttccacccctgtgactcccccagagaagtggctctctgagctgtggcactcaccttgggagcagccttt

SEQ ID NO: 20585 - DNA, 590 bp, Homo sapiens
  ENST00000530338
tggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaagctggaccgacccaccaagcagatgcgagaggcagaggaaaggctcaaagccattccccagttttgcttccctgatgccaaggactggcttcctgtgtcagagtatagtcctctcacacctccctgatgccagacctctctttgttccagtgagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcgccggcgtgggatctccgctgcattggtctatcctttcatgagaagtctcatggagtcgcccttcccagccccagggaagaccatcaaagtgaagacattcctg

SEQ ID NO: 20586 - DNA, 1412 bp, Homo sapiens
  ENST00000532734
attatgacttcaaggaagaatggaggtggggcgcatagctggcaagaaaccccgtgggaacaaagaagggctctgggtttgcagagagccgaaatgaccatgactgccaacaagaattccagcatcacccacggagctggtggcactaaagcccctcgggggactctgagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaaggaatgtgctttctccagctcttcacgtggctgctggctccttctcatttctcaggctctgctcaagtaggacctctttcaggaggtctgtccagacacctgcatggagcccctcccctgcccagcttgctctgctggaccgacccaccaagcagatgcgagaggcagaggaaaggctcaaagccattccccagttttgcttccctgatgccaaggactggcttcctgtgtcagagtatagcagaccttttctttcatgctgactggggaagatggcagcagacgctttggctactgcaggcgcttactgccaagtgggaaagggccccggttgccagaggtgtactgtgtcatcagccgccttggctgcttcggcttgttttccaaggtcctagatgaggtggagcg

SEQ ID NO: 20587 - DNA, 862 bp, Homo sapiens
  ENST00000530593
agtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaagctggaccgacccaccaagcagatgcgagaggcagaggaaaggctcaaagccattccccagttttgcttccctgatgccaaggactggcttcctgtgtcagagtatagcag

SEQ ID NO: 20588 - DNA, 940 bp, Homo sapiens
  ENST00000528527
acttggctgcgaggagcgccacgaaaggtcagaggaaggagctgtgggaagctcgcagcaggtatcggagcttaagccagtggatttgggggccctgggctccctagccggctgcggtgtgagaatggagtgggcaggaaagcagcgggactttcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagcccacacacagcgcctggtccacatccagtcgatgctgaagcgcgcccccagctatcgcacgctggagctggagctgctggagtggcaggagcgggagctttttgagtactttgtggtggtgtccctcaagaagaa

SEQ ID NO: 20589 - DNA, 452 bp, Homo sapiens
  ENST00000531060
ggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaaggtaccctccccagaggcagcccactggagccgggcaggtgggcgggcaggcagccagcctttctctctctttcctggcttccttccttccctaatctggactgcttcctcgattccctttgaataaattctgggtccgtg

SEQ ID NO: 20590 - DNA, 592 bp, Homo sapiens
  ENST00000533425
agtgctctgctcacttggctgcgaggagcgccacgaaaggtcagaggaaggagctgtgggaagctcgcagcaggtatcggagcttaagccagtggatttgggggccctgggctccctagccggctgcggtgtgagaatggagtgggcaggaaagcagcgggactttcagggctctgggtttgcagagagccgaaatgaccatgactgccaacaagaattccagcatcacccacggagctggtggcactaaagcccctcgggggactctgagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagcctcaatgaagacagcctcagcaccacca

SEQ ID NO: 20591 - DNA, 600 bp, Homo sapiens
  ENST00000526057
agcccggggcgcggatgcctgcccgccgcccgccctctctgcaggagcggctcctcctccgggccgcgcggctcccggcgagaccccatccaggcgccgcgcccggcccggctggggaacgcagaggaagatgagagactgcttaggcgccaccactagtaccatgagtccctgcactggttaaagccatcgccacaacctggacaggcagcaagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccat

SEQ ID NO: 20592 - DNA, 595 bp, Homo sapiens
  ENST00000528196
ataaagacaggtagggctgaagggtggaggtagggtctccagctgcagttgtcaagaacccaacgtgaaggctgactgagcagagaaactgctgctgcccagaaagaaagcacttttagcagtgggctctgggtttgcagagagccgaaatgaccatgactgccaacaagaattccagcatcacccacggagctggtggcactaaagcccctcgggggactctgagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgatt

SEQ ID NO: 20593 - DNA, 571 bp, Homo sapiens
  ENST00000527510
aaggtcagaggaaggagctgtgggaagctcgcagcaggtatcggagcttaagccagtggatttgggggccctgggctccctagccggctgcggtgtgagaatggagtgggcaggaaagcagcgggactttcagggctctgggtttgcagagagccgaaatgaccatgactgccaacaagaattccagcatcacccacggagctggtggcactaaagcccctcgggggactctgagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagccagtccctgcgcagtgggaactggtcagaaaggaagagccacc

SEQ ID NO: 20594 - DNA, 588 bp, Homo sapiens
  ENST00000530580
ttgactttcacttccccaggcctcagtgcctcttcccacagaggctgggttttctccttgttgctgcctgagcaggtgaccttgggatggttcccacagagcagtgtggctccaggcactgccctttgctgtctacttcagcacctgtggcttcagggctctgggtttgcagagagccgaaatgaccatgactgccaacaagaattccagcatcacccacggagctggtggcactaaagcccctcgggggactctgagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgg

SEQ ID NO: 20595 - DNA, 582 bp, Homo sapiens
  ENST00000532651
gtgtatgagaaaatgacataaagtttcagaccccgttgtgctttgctccagacccagacaactcttggtcggatggtgaggagatttcacaccctttggagagtttctttcttggataattcagggtcttgctgtgttgctcgggctgctcttgaactcctgggctcaaacagtcctcttgcctcagcctcccaacgtgctgggattacgggagcaagccaccccactgtgtgcagcccagaagttgagcctgagaggaagatgagagactgcttaggcgccaccactagtaccatgagtccctgcactggttaaagccatcgccacaacctggacaggcagcaagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctt

SEQ ID NO: 20596 - DNA, 308 bp, Homo sapiens
  ENST00000527870
gctgcctttgtaaggagggcctatggtctttgctgttgccatggacattccccagcaaggcagcagagatctgattcagcaggaatgactcttgctcttgttatccacagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacg

SEQ ID NO: 20597 - DNA, 502 bp, Homo sapiens
  ENST00000531093
gggccatgagggctccaccctcatgaatggattaatgctgtcattgctagagtttgtttctgataaaaacaagtccggccccctcctgccctctctctcttttgtgtgtactgttgtgcccttctgcctttctgctatgggatgatgcaggaagaaggcccgcaccagattcagccatcaatcttaagacttccaagcctctggaaccgtaagaaataaatcctcacttcattagcataaattcagggctctgggtttgcagagagccgaaatgaccatgactgccaacaagaattccagcatcacccacggagctggtggcactaaagcccctcgggggactctgagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaag

SEQ ID NO: 20598 - DNA, 583 bp, Homo sapiens
  ENST00000533225
gtcacataatatccagtgcgtcctccctggcactccgattctcagtagtcatgaaccagctggcttctatatctctcaccaatcacaggtaatttaggtctccctcagggtcttgctgtgttgctcgggctgctcttgaactcctgggctcaaacagtcctcttgcctcagcctcccaacgtgctgggattacgggagcaagccaccccactgtgtgcagcccagaagttgagcctgagaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgccc

SEQ ID NO: 20599 - DNA, 559 bp, Homo sapiens
  ENST00000526126
tcccggcgagaccccatccaggcgccgcgcccggcccggctggggaacgcagagatttcacaccctttggagagtttctttcttggataattcagggtcttgctgtgttgctcgggctgctcttgaactcctgggctcaaacagtcctcttgcctcagcctcccaacgtgctgggattacgggagcaagccaccccactgtgtgcagcccagaagttgagcctgagaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcagaaaatcctttgagtttgaggatgcatccagtctccagtccctgtacccctcttctcccactgagaatggtactgagaaccaacccaagtttggatccaaaagcactttagaagaaaatgcctatgaagatattgtgg

SEQ ID NO: 20600 - DNA, 542 bp, Homo sapiens
  ENST00000526221
atagctggcaagaaaccccgtgggaacaaagaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcagggcctccggaggatgagcaggaccttctccgagtgttcctacccagagactgaggaggagggagaggcgctccctgtccgggactctttctaccggctggagaaacggctgggccggagtgagcccagcgccttcctcagggggcatggcagcaggaaggagagctcagcagtgctgagccggatccagaaaattgaacaggtcctgaaggagcagccgggccgggggctcccccagctccccagcagctgctacagcgtggaccgggggaaaaggaagactggaaccttgggctccttggaggagccggcagggg

SEQ ID NO: 20601 - DNA, 535 bp, Homo sapiens
  ENST00000529940
gtagtcatgaaccagctggcttctatatctctcaccaatcacaggaagatgagagactgcttaggcgccaccactagtaccatgagtccctgcactggttaaagccatcgccacaacctggacaggcagcaaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagcccaggatgtagcaggggtcgctgcctgcctcccccttgcccagagcacgccattcccggggccagcagctggcccccggggcgtcttgctgacccgtaccggtacccgcgcccacag

SEQ ID NO: 20602 - DNA, 560 bp, Homo sapiens
  ENST00000528523
agtgctctgctcacttggctgcgaggagcgccacgaaaggtcagaggaaggagctgtgggaagctcgcagcagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagcccaggatgtagcaggggtcgctgcctgcctcccccttgcccagagcacgccattcccggggccagcagctggcccccggggcgtcttgctgacccgt

SEQ ID NO: 20603 - DNA, 560 bp, Homo sapiens
  ENST00000527930
aacagaggattatgacttcaaggaagaatggaggtggggcgcatagctggcaagaaaccccgtgggaacaaagaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagcccaggatgtagcaggggtcgctgcctgcctcccccttgcccagagcacgccattcccggggccagcagctggcccccggggcgtcttgctgacc

SEQ ID NO: 20604 - DNA, 599 bp, Homo sapiens
  ENST00000534783
gctgtgcgcgcgcccgcctagcgaggacagggtctccatgacaaccggcctggccggctagcagtgctctgctcacttggctgcgaggagcgccacgaaaggtcagaggaaggagctgtgggaagctcgcagcaggtatcggagcttaagccagtggatttgggggccctgggctccctagccggctgcggtgtgagaatggagtgggcaggaaagcagcgggactttcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagcccaggatgtagcaggggtcgctgcctgcctcccccttgcccagagcacgccattcccggggccagcagctggcccccggggcg

SEQ ID NO: 20605 - DNA, 638 bp, Homo sapiens
  ENST00000533681
gattactgtgctttgggattaaagtgtcctgccgtttctggaagagactgctagtcataaagacaggtagggctgaagggtggaggtagggtctccagctgcagttgtcaagaacccaacgtgaaggctgactgagcagagaaactgctgctgcccagaaagaaagcacttttagcagtgggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagcccaggatgtagcaggggtcgctgcctgcctcccccttgcccagagcacgccattcccggggccagcag

SEQ ID NO: 20606 - DNA, 523 bp, Homo sapiens
  ENST00000526241
gccgcgcccggcccggctggggaacgcagagatttcacaccctttggagagtttctttcttggataattcagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagcccaggatgtagcaggggtcgctgcctgcctcccccttgcccagagcacgccattcccgggg

SEQ ID NO: 20607 - DNA, 751 bp, Homo sapiens
  ENST00000530959
acataatatccagtgcgtcctccctggcactccgattctcagtagtcatgaaccagctggcttctatatctctcaccaatcacagggtcttgctgtgttgctcgggctgctcttgaactcctgggctcaaacagtcctcttgcctcagcctcccaacgtgctgggattacgggagcaagccaccccactgtgtgcagcccagaagttgagcctgagaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagcccaggatgtagcaggggtcgctgcctgcctcccccttgcccagagcacgccatt

SEQ ID NO: 20608 - DNA, 547 bp, Homo sapiens
  ENST00000533580
agttgtcagaggcagggctggactcaaggcaggtgtttttccactgcccctcggggcctgcgactgtgcctgtttgtctggatgcagtttgtagaaaagttccagagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagcccaggatgtagcaggggtcgctgcctgcctcccccttgcccagagcacgc

SEQ ID NO: 20609 - DNA, 887 bp, Homo sapiens
  ENST00000526155
cttggtcggatggtgaggaggtgagggccgtccagtttgggggccaacttctcctccctgctgcccccggcccccgcctccctcacccctgtcccccaccctccctcgcacactctcggcgcggctttctcgctgcctccggcgcctccgagcgctcccctccgccgggctccagcagcccaccctctctgtcttgggtggaggcgcacatcctccacgccccctccactcaaatctgcgctccctcccctctctctccctgcagcccggccgcagcccggggcgcggatgcctgcccgccgcccgccctctctgcaggagcggctcctcctccgggccgcgcggctcccggcgagaccccatccaggcgccgcgcccggcccggctggggaacgcagaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagcccaggatg

SEQ ID NO: 20610 - DNA, 564 bp, Homo sapiens
  ENST00000534248
taatatccagtgcgtcctccctggcactccgattctcagtagtcatgaaccagctggcttctatatctctcaccaatcacaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagccca

SEQ ID NO: 20611 - DNA, 573 bp, Homo sapiens
  ENST00000527347
gtgcgcgcccggtcccgcccctgccctcccagcccttttccctctgctcccgactcccggccccggcagcggtgtccagctccatttcacaccctttggagagtttctttcttggataattcaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagaga

SEQ ID NO: 20612 - DNA, 822 bp, Homo sapiens
  ENST00000533016
tattctaagccactaggccgtggtggcttctttgaaaggttgaagtcttgaaaggtaagaagaccccatctagctgggtttcatgtgctgccctcaccttacccctacaagtggcacagcaagctgcctgcgatgtctggtggttgactctgctgcctgcatggttcaggtgagcagagcagttcatgttgaagcccctcccaccggtcaggagcctgtaggactgtgttgttttccttcctgtgtcctcagtgactgggctagtgtcttgcacaaggcaggtgcttggtcattgtttgtggattgaatggcttctcagcctgagcttcaggggaccttggcctgggccttggagcatactaggagttggataagcagagaggaagaaggagagcactccaggctgccagtgatttgagcccagaaacatggggcagaaatggacacgtggacatgtttggagcagaaggtgtcctgcctggagagagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggac

SEQ ID NO: 20613 - DNA, 631 bp, Homo sapiens
  ENST00000527516
agaccccgttgtgctttgctccagacccagacaactcttggtcggatggtgaggagcccggccgcagcccggggcgcggatgcctgcccgccgcccgccctctctgcaggagcggctcctcctccgggccgcgcggctcccggcgagaccccatccaggcgccgcgcccggcccggctggggaacgcagagatttcacaccctttggagagtttctttcttggataattcaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaag

SEQ ID NO: 20614 - DNA, 514 bp, Homo sapiens
  ENST00000527473
aaacttagggggtctgccgtgtcccagggactgtgctcattttctgacaggagcaatattattaccgactgtgacagcagctcccactaagcctgcaccttagctgcagatccttagcagggcagagagacaaggctgtatttgtatcaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccct

SEQ ID NO: 20615 - DNA, 534 bp, Homo sapiens
  ENST00000530938
gatgcctgcccgccgcccgccctctctgcaggagcggctcctcctccgggccgcgcggctcccggcgagaccccatccaggcgccgcgcccggcccggctggggaacgcagagatttcacaccctttggagagtttctttcttggataattcagggtcttgctgtgttgctcgggctgctcttgaactcctgggctcaaacagtcctcttgcctcagcctcccaacgtgctgggattacgggagcaagccaccccactgtgtgcagcccagaagttgagcctgagagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagct

SEQ ID NO: 20616 - DNA, 556 bp, Homo sapiens
  ENST00000533471
gtgtgtatgagaaaatgacataaagtttcagaccccgttgtgctttgctccagacccagacaactcttggtcggatggtgaggagcccggccgcagcccggggcgcggatgcctgcccgccgcccgccctctctgcaggagcggctcctcctccgggccgcgcggctcccggcgagaccccatccaggcgccgcgcccggcccggctggggaacgcagaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtaccccagccactccagctcccgggtgctcctcaaggaccggcaccccccagct

SEQ ID NO: 20617 - DNA, 590 bp, Homo sapiens
  ENST00000524757
agacccagacaactcttggtcggatggtgaggagcccggccgcagcccggggcgcggatgcctgcccgccgcccgccctctctgcaggagcggctcctcctccgggccgcgcggctcccggcgagaccccatccaggcgccgcgcccggcccggctggggaacgcagagggatggtgacagaatggatagtatagaaaatggattggaattgaggaggaaactagaagctaagaggagttaggaggcccttgtaacaatccagatttcacaccctttggagagtttctttcttggataattcaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcagcctgcaggtacc

SEQ ID NO: 20618 - DNA, 576 bp, Homo sapiens
  ENST00000527392
agacccagacaactcttggtcggatggtgaggagcccggccgcagcccggggcgcggatgcctgcccgccgcccgccctctctgcaggagcggctcctcctccgggccgcgcggctcccggcgagaccccatccaggcgccgcgcccggcccggctggggaacgcagagggtcttgctgtgttgctcgggctgctcttgaactcctgggctcaaacagtcctcttgcctcagcctcccaacgtgctgggattacgggagcaagccaccccactgtgtgcagcccagaagttgagcctgagaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacctcag

SEQ ID NO: 20619 - DNA, 550 bp, Homo sapiens
  ENST00000526828
gttgacactctgaatggtttgtgaaggcatcctctggcccctgaaggcattaccatccttaccaggtttaaaatctttcagagtgcacccagcatcatcagctcctgcaagcagaaagggcccaagggagcatgaacacacactggggtcttgctgtgttgctcgggctgctcttgaactcctgggctcaaacagtcctcttgcctcagcctcccaacgtgctgggattacgggagcaagccaccccactgtgtgcagcccagaagttgagcctgagaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccaccaaggagtcccatctacccgctcagtgatagtgaaacct

SEQ ID NO: 20620 - DNA, 580 bp, Homo sapiens
  ENST00000525169
tccagacccagacaactcttggtcggatggtgaggagcccggccgcagcccggggcgcggatgcctgcccgccgcccgccctctctgcaggagcggctcctcctccgggccgcgcggctcccggcgagaccccatccaggcgccgcgcccggcccggctggggaacgcagagatttcacaccctttggagagtttctttcttggataattcagggtcttgctgtgttgctcgggctgctcttgaactcctgggctcaaacagtcctcttgcctcagcctcccaacgtgctgggattacgggagcaagccaccccactgtgtgcagcccagaagttgagcctgagaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtcagtctctccacctccagttctctccccacca

SEQ ID NO: 20621 - DNA, 659 bp, Homo sapiens
  ENST00000534665
agacccagacaactcttggtcggatggtgaggaggtgagggccgtccagtttgggggccaacttctcctccctgctgcccccggcccccgcctccctcacccctgtcccccaccctccctcgcacactctcggcgcggctttctcgctgcctccggcgcctccgagcgctcccctccgccgggctccagcagcccaccctctctgtcttgggtggaggcgcacatcctccacgccccctccactcaaatctgcgctccctcccctctctctccctgcagcccggccgcagcccggggcgcggatgcctgcccgccgcccgccctctctgcaggagcggctcctcctccgggccgcgcggctcccggcgagaccccatccaggcgccgcgcccggcccggctggggaacgcagagatttcacaccctttggagagtttctttcttggataattcaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcaggtctcagtca

SEQ ID NO: 20622 - DNA, 299 bp, Homo sapiens
  ENST00000531578
acataatatccagtgcgtcctccctggcactccgattctcagtagtcatgaaccagctggcttctatatctctcaccaatcacaggtaatttaggtctccctcaggaagatgagagactgcttaggcgccaccactagtaccatgagtccctgcactggttaaagccatcgccacaacctggacaggcagcaagggctctgggtttgcagagagccgaaatgaccatgactgccaacaagaattccagcatcacccacggagctggtggcactaaagcccctcgggggactctgagcag

SEQ ID NO: 20623 - DNA, 3674 bp, Homo sapiens
  ENST00000531237
atggggatgggactaaacttagggggtctgccgtgtcccagggactgtgctcattttctgacaggagcaatattattaccgactgtgacagcagctcccactaagcctgcaccttagctgcagatccttagcagggcagagagacaaggctgtatttgtatcaggaagatgagagactgcttaggcgccaccactagtaccatgagtccctgcactggttaaagccatcgccacaacctggacaggcagcaaggtaagcagagaggccagtccaggcgagctcctgggatgtgagtgcatttccgccccaactgctgcccggaaaaatcccaagtgcacaaacaagtcaaggcagcgcatcagggtccctcctacccgagctccaggacccagaggaagctgggtccccttcaagcgcttcagctagctccctcccccctggcagggattcttccaagttataaaaaatgagacactggaggggaagaaaacaagtccactcactgtcttctcccttctcccctctgagctgttcaagcaagttcccaggagcagttcagagcccctgttggactggaagggaggtaggaggagtggaatgcatgcaaaaaccgagctgatcaaaagacagtgctgtttcatggaagcctcccagaactgagagagagagagagagagagagagagagagagacagtgagaaagaaagaaaaagagagcgcccttgtgcacgcgctaggccaagagcgcgccgctgtgcgcgcgcccgcctagcgaggacagggtctccatgacaaccggcctggccggctagcagtgctctgctcacttggctgcgaggagcgccacgaaaggtcagaggaaggagctgtgggaagctcgcagcaggtatcggagcttaagccagtggatttgggggccctgggctccctagccggctgcggtgtgagaatggagtgggcaggaaagcagcgggactttcaggtaagggcagctccgggctgggatcatttggcctcctttcctggcccttctctccggctgttttctgggagtcaggcgagtgtctgtagtctctgctcggggtttggggctcaggaatgatgtcatgctccaacagttggattctattagcttaaggaggagggaaacagccaattttcttgactttgcaaatctagctgatctcactcttgctgaatctgaggtgtttagacttcactctaaaaagcatcattttacttttatttagcacaaaggcacaggatatttttacaggaagaatcttttatatggaaaaatctgagttaacatcactcccgtggtgtttgtagttcttacagggaaactccagtgccttttgagccgcttgttcgtcctagtgaacactgtctgttttgtctcttggtgctgctatgtctgacctgtaatggaaaaaaaaaaaaaaaaaaggctaattaagctcagccaggagcctgtggtgagttccaagtccctctagagcatttattaggacagagggactgtcacagggatgcctgagctggggttttgcactctctctcttccaggcagcttggtaagaatcaagctgtcctcccacatcaaaaggtcgatcacagactttcctaagaggtggaggagggggctggcttggggttggggggcctgcaaacaggtttctcatccagatgtcccagagtgagctctcagcagcagctgctaagagctggggaacatgaggcactgtagttgtgccgggtggattcctttggttacattttgaccaaatctcagggcacgcagtgtccacgctgtgcactcctacactgattgtcctaagttttggtaaaacttgttctgacctagaggagtggtacatggtgagctgtgtggccttggaaaggagaccctcccagaaaggcagttttataggtgatagggtagtggggttgtcagtaatattatgaggaggatgaatgcagcaaacacttcctgcaacggagacccatcaggggttgtgcttccacttgagccatgttatgtcttaaattcacttcttggcctcagggaactttgcaaatgcctttggtttctctgtgggatgagggaacagctgctgtcctggttcttcagtttttcttcttgaactttctgaacagaatgtcttttgtattctggcaaacaatgagggggcattctgattaacttcggatcagcttgccaatgcaagcactggccatgtccccagttccggctccctaaaatgagtacatgtatacatcgtggttgtggcctgagggtccacaagggtgaactccatggccctggacctcagacggtccacttctgaagttattcctcttgctacatacactccagggatcctttgcttagttgaaacctacattttgctggagggatgtggcataacactgagccagtggccccttcagttggcagtgtaaatccagaacctcagccttcttttctacttgtgtgtgtagttggagctcttcaattttaccatccccacatctgtgaagagggctagcagagacccagtttcaggagctgctgctccttctgttggtatagcagaaagaataatggatttgggttgctagacttgagtcgacggctagattctgttcccatagggcggccacgggcaagtatcttaactaataggagcttcagattcttacctgtgagatggaggtaataagaacaacttcacaggactgttgggaggagccagtgggataacttccatgaaagtagtttgaaacaagtcacgtcctatctaacgaaccgtgttgtgaattgaagcttgaggaatgacccaactctctctggaaagtcactttgcctctctgttctggttctctcattttataaagtgccttcttcctttctgcatttataagtaaacatgagaaaaatctgaaaagacttcttcaggatgtttaaggaaacaaatgttgctttccttgggttgggtcgtttcataagagtgatgtttgccataaaactggagcctcatagacgatcctgcagggaggaagctttccttggtcacctgactcatgtgtttatatatagtatagaggagaggtattccaaaagacccgtcgcttttcctgtgtcccacagctgcctgtagagttgtggcaccataaactttagcagctggaaaagaggccaggcctggttccctcatcctgctgggtcctgctgggcacactctgcagtgggcaaaggggtctttctccttcattctgggtttagaaggcagggttctaactgggagaaagtgttattgctccgaaaggcttcttgggggctgggcaggtctttcaggaactcataaggccacagcttatggggaaagaaaaagaaacaaggaagtgggaattccaagggcagagattcttgatatgccatgggactgtgccaaggaatggaagagcaggggaagggagactccaggcaaggagagtcccaggtctgtcctcattgagtcgaaagggcgtatggcatactagagcgcgtcacccacagccccagctttactgtaggatggggaagacctgccagccatatcccggagtggtgtctgggaagaagcccttgagcagacccatagtaggcagattaaaaaaatgaaacaaa

SEQ ID NO: 20624 - DNA, 536 bp, Homo sapiens
  ENST00000531640
gatgcttaggaaggtccactttgagggacacgctcagtgggggtcactttaaggaacacaaataaatcctcctttaagtctcctctgtggttcatgaaaaaggagagaaactccatcctcacctagtctcaacagatggcttgatgagcaattatcaggtaccagcccctggaagccaccaatctgtcttctgtctctattattttgactactcctttcacagaaaaccactggaggagatactcacaaaaatgaaggggaagaacaggaaacaggaagacatgagatgaaggaaacaggagattcaacatggatttcacaccctttggagagtttctttcttggataattcagggtcttgctgtgttgctcgggctgctcttgaactcctgggctcaaacagtcctcttgcctcagcctcccaacgtgctgggattacgggagcaagccaccccactgtgtgcagcccagaagttgagcctgagagatgagagactgcttaggcgccaccactagtaccatgagtccctgcactg

SEQ ID NO: 20625 - DNA, 333 bp, Homo sapiens
  ENST00000528452
agttccactgagaccagccatggaagggtcttgctgtgttgctcgggctgctcttgaactcctgggctcaaacagtcctcttgcctcagcctcccaacgtgctgggattacgggagcaagccaccccactgtgtgcagcccagaagttgagcctgagaggcactgtgagcagctgttgctatcacacgggcggatcagaacatgaagaatggagctaaatagagctgtctgcatgctgttctgatgggctcaggctcagcctcagagaataggtggattggagcctgtgatgggggctctttcccccaccagagtgggtgaaagcagggagga

SEQ ID NO: 20626 - DNA, 1071 bp, Homo sapiens
  ENST00000626808
atgacttcaaggaagaatggaggtggggcgcatagctggcaagaaaccccgtgggaacaaagaagggctctgggtttgcagagagccgaaatgaccatgactgccaacaagaattccagcatcacccacggagctggtggcactaaagcccctcgggggactctgagcagaaaatcctttgagtttgaggatgcatccagtctccagtccctgtacccctcttctcccactgagaatggtactgagaaccaacccaagtttggatccaaaagcactttagaagaaaatgcctatgaagatattgtgggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaagcttgtccaaagaattaactccatctacaatgccaagagaggaaagaagagattaaaaaagttgtctatgtccagcattgaaacagcatcactgagagatgaaaacagtgagagcgagagcgactctgatgacaggttcaaagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaaggaatgtgctttctccagctcttcacgtggctgctggctccttctcatttctcaggctctgctcaagtag

SEQ ID NO: 20627 - DNA, 6857 bp, Homo sapiens
  ENST00000361686
ttccgccggggcaggcgccgggactccctcctggccgcccacagcctgtgcgcattcctgcattcctgccgccgcccgggacccgagtgccccggaggtgtccaggcgcggtgccaggcgggtactgtgcaggttcattctgccacccatctgcattaagacacaaggtgctgaccgcagagacctgccatgaaaccacacttgaagcaatggagacaacgaatgcttttcggaatattcgcttgggggctcctctttttgctgattttcatctacttcaccgacagcaaccccgctgagcctgtacccagctccctctccttcctggagaccaggaggctcctgccggtgcaggggaagcagcgggccatcatgggcgccgcacatgagccctccccgcctgggggcctggacgcacgccaggcgctgccccgcgcccacccagccggttcctttcatgcggggcctggagacctgcagaaatgggcccagtcccaagatgggtttgaacataaagagtttttttcatcccaggtggggagaaaatctcaaagtgctttctacccggaggatgacgactacttttttgctgctggtcagccagggtggcacagccacactcaggggacattgggattcccttcccccggggagccaggcccacgggagggggcttttccggctgcacaggtccagaggaggcgggtgaagaagaggcaccggaggcagagaaggagccacgtgttggaggagggcgacgacggcgacaggctgtactcctccatgtccagggccttcctgtaccggctctggaaggggaacgtctcttccaaaatgctgaacccgcgcctgcagaaggcgatgaaggattacctgaccgccaacaagcacggggtgcgcttccgcgggaagcgggaggccgggctgagcagggcacagctgctgtgccagctgcggagccgcgcgcgcgtgcggacgctggacggcaccgaggcgcccttttctgcgctgggctggcggcgcctggtgcccgccgtgcccctgagccagctgcacccccgcggcctgcgcagctgcgctgtcgtcatgtctgcaggcgcaatcctcaactcttccttgggcgaggaaatagattctcatgatgcggttttgagatttaactctgctcctacacgtggttatgagaaagatgttgggaataaaaccaccatacgcatcattaattcgcagattctgaccaaccccagccatcacttcattgacagttcactgtataaagacgtcattttggtggcctgggaccctgccccatattccgcaaatcttaacctgtggtacaaaaaaccggattacaacctgttcactccatatattcagcatcgtcagagaaacccaaatcagccattttacattcttcatcctaaatttatatggcagctctgggatattatccaggagaacactaaagagaagattcaaccaaacccaccatcttctggtttcattggaatcctcataatgatgtccatgtgcagagaggtgcacgtgtatgaatatatcccatccgtgcggcagacggagctgtgccactaccacgagctgtactacgacgcagcctgcaccctcggggcgtaccacccactactctatgagaagctcctggtgcagcgcctgaacatgggcacgcagggggatttgcatcgcaagggcaaggtggttcttcccggcttccaggcggtgcactgccctgcaccaagtccagtcattccacactcttaaaaagggtttcttgggaatcaatgtgcaataaggtactactgttgtactcaaagtcacaaaagaatacttgaagatagattttagacagtgtagttttgagtctttaaacagtaatttagtggtggtcatgataatccttctctttctaagccattgagtatgtattactgctttgaacatagaaatggtttttttaaaaaaataaggctcaagaaagatgcaaaaccaaggatagctagaaagaaaacacatgtatgaccatgggtatgatacctccagaaatgttaacaacttattcttctgccatgagtacccctcatcagggttggtttcaatgacaggttttggtgatgttcctgaccatatgaagtggtttatgtttagaaacattcaaattgagggacatcatttacagcatcgagtgtgtcagttatacatgcattcatcattaaatatcctaggttttatgacagacattgaaattatcactcagatgtgtttaacagcaaaaaattcccagcacatcctggcaaaggcttttatttccaaccgttgcattcttcatctctgcctcccattgcccactgaatgctttgctttctgtgcatcaagacagagttctaaaaccagaaaacatccatcttgaaaggtccaagaaaaagccaaattccatatagcaccacagaggaggccctttgtttccctgcagtatttcaaccaggaacattagtatcacatccaccaggaggcacatcactggcaagtaacatagaatcacagggctgcaggtgcccctggacactccccggttctggcttttctgccttgtacctcctcacctgcagatctaccctgcagcttttgcatagtcagtgacacacttgacaattggcacagctgtgctggggaagacgggagacaccttgctccttccaaactagaaggaaagattttggagccatcaccctgtgcttctagggatgcacgcctgtctttattatacaggtttcttgcaggtttttatcagccagtgggaactccacagtgatgagcactgaatcttcactaaatcttcctacagacatttaggaatccagtccttgcttttgcagatatgttttatgtcagcagcatgacaaagccatataattaaataatttatgtgaaagcattgcttattaacaaggaaaatatgtagatgcttcagagggaaaggcagctagagggaaattttcatcccaatatgttagctatattcagggttgattttttctttaatctcaactgtcactgatacattgaaaaatttttgctatgaatatagtgaaacagaaacattctgtaataccttaattaaacatgctattatttcaatgtataaccaaaacatatctccatggtacagttaagacttgttgcaatgacaatagcagcttaattaaatgcgttctcccttgcaaaatgtatgaatgtcaggagagtttagtggaaaagttttctttgtttcaggattggtttcttctagactgttctcaggactactttcttgagcaagaatggcttacagagactgaaggcttctgtttggttagtctattcagcagatatggagctggaaaacaagacatctcctatagcttgctataatagtgaaggagaaattggaaagttttaatcacaataatatccaataaaagcccattttgagagttttgttattaagtcaatgagaagggataggtaactttgtcctatatattaacttatgtctaaatagacatggttaagccatgttcctttctaatttcttttcttttcttttttttttttttttttgagacagtctctcgctctgtcgcccaggctagagtgcagtggtgcgatcttggttcactgccagctctgcctcccacgttcacaccattctcctgcctcagcctcctgagtagctggggactacaggcacccgccaccacgcccagctaattttttgtatttttagtagagacagggtttcaccgtgttagccagggtggtctcgatctcctgaccttgtgatctgcctgcctcggcctcccaaagtgatgggattataggcgtgagccaccaccgcgcccggtcattcctttctaatttcttgaaaaaactttgtcttgtccttatgtttacatgtgtgtaataatttcagcaactctggaatgtgggtgaggtggctgtggtggatgaatattactccctaccctccttggatctttctagatcttccagaccattaaatgcccctgaagctccttttatagttttgcaagtggatttacttgtagacatccttactatccagcataatcccccttggctgacatgagaacttggttagaggagaatttattggggtcagtgtaaatattcaagttcaaaagcctcagaacccaacactttaaagatttttaaatggaattttgtcgtagtcattgtacttttaaaatagtactttcagtttcattgaggttacaagaaagactgaagagtacaaaggaaatttagttacaatttttgcatttattatggccttaaagactcttgggaatcaggctctgttcaacagtcaataaatgtaatacacacattaatatagtactgactgggcgttcttctataaaagtttaagttctttggcttctaagaaaatgttgggcagttacagttaacttgatgactacttctagtattagccaaatgggtcctaagtggcagcattttgccagacattgactaaatccttacatgccacatttactgaattccaataaacatatagttcttctgtggagtagttaacagtaagtggcagctcactgaatttctcccaggttctgtctcttccaaaatcctccatcctctcttatgaagggaagctgataaaaaaaaatcctcttggtgcaagctgaagctgttaaggattccttttttcactctcaggaccaacagacgttcttttgtatttcaagataatttcacctgttgttgttgttgttgttgttgttgttgttgttgttgttgttgttacaaagaaacaaattttgagcagcaatgacaattcaaccatatctagattctccctaccttatttctccagccagtcacaccaggcagacgggtaacctttaacagacctggtgttctcatggaataccgatgctcgtcccagggagctgacctttctcactatgtccttatagagctgctcttacagagaactttgtgctcaggaccaagggatggtcaattaaaagttgcatgtaagcatcaggcttggatgggcaagggagggcttttatacatctttgaacgaccaggtctttccttgtctgcctgaaggcagagcttcgagaaacagcacttcccatgtgtctggtcctcttggtctctcagccagacacttaatcaatcctggactctccagtagtcctcagtcattgtagccatagcatctgcaaaaaaagaaatgctaaaataatcattagcgttttcaaaattaggaaatcaaagtagctgggtcactctcttacatgtgtatgagccagttaattctgctggacagatcatacttacgctgctgattgactcttctgagcagtaacacatctcctgaattaattaggtaggtcccgtttgggtgctttaagtgggatcagtcttagatgagtgccagtatgtgattgaatttcatacgcacaaatgccatgattcaagttctctctccagtttttcttatagatcaacacacagtacatgtggtcagttacttggttgaatttctgcttagctgtggtaagagacagagaaagggagtgaggtgggaccaggggaattatcagaaagacatgagtgaacctattggccaggtagcttccaagtatgttctattgtattgtctgttttgattctgatagtttagaactctttctgatagtttagaactcttacccagtggttacatgactgatcaaggcaactccatctggaaattaattgcttgggtaaaatgtccctgagtttcaacttgtcttttatctctggatattctcttatgagattattatgcatgtttctgtcacatgggcattatttacacacttgataaatgaaaggtatttctctgtccgttcaaggaaataaaatgtaagttcttgttttattaaatgaatgaagccttttggttaaaaaaaaagtaatgtaatatgtttctgttcaaacttgagctaatgacatttaaggaattaaagacattgatctagttcttagtatgaaaagtgtacatgtagatatagttatataattgtgtatatacatatctacacacatggttggttttatattgctttttcatcaatatttttgactgaaacctttacaataaattttattttaattatgtaaccactaatattttgagagaaggaagcaaatgttatatgtccttctgttaaaagaaaaaaaattcagtcctccgccaaccgcttcccacacactcatactctgcacatcttggctacattaaaatggactgacagaattatttaaaaggcactatgaaggtagaacactaccttaatattttatcctagtcagaagcctgatttaacactgaactttgaagggaagcttagctgtagctcatggctttcaaagattagaagaaacatttactggttctatggaaaatagtcttcttgctaggtagattggaaacaaagaaattgcattggtggtgttaaaatctaacatttataacaaatcctgttttattctagatgaaatacttagacaattcttccagtggaaaccagtgaacttttttaacagctttgggaattcttttgtatgataatttttaaaatgaaatgtgtactcttcaaactaattaaagcttgaagttttccaggagtcgcattttaaaagtgtttgtacacattttaacacttggatattttctattttggttttgtatatttttatgtatacacaatgtacagacttttttcttgtaaataaaacatgttttcatttgtctagaa

SEQ ID NO: 20628 - DNA, 7275 bp, Homo sapiens
  ENST00000409382
gcagcctcggtgcgtgggccgggaaccgccgcctctccccggggctcggggccgcggttcctctggccgcgggagccgccgccgcgctgcccgaaacaatgaggcgtgcagcgcggggctgagcgtagcctcccgccggctttgaggccgagccacccgctgtgccccgccgcccgcgcttgcagctgccgccggcgcggagcagcgctggccccggagaggtgatcccgcaggccgcctgggacgggagcgcggggcagctccgagaccccacggtggcaggaggaggactcgagcctgcggcaggacgactcccgccgcgcactcgccttctgcagcccccaagttccgcggcgtgagtcggggaccccggccagggtcccagctctagcgggcgccagcgtgagtgtgggagcgcgtagcgcgcgcacccgagcggctgccggggaataaaatgtgacacgcacgccttggactccagtgccgcgctgccagggggagcaccgagcaccacggtgtcgtgcgcttcgaggcgcggcgtgggaagaaggctggttcattctgccacccatctgcattaagacacaaggtgctgaccgcagagacctgccatgaaaccacacttgaagcaatggagacaacgaatgcttttcggaatattcgcttgggggctcctctttttgctgattttcatctacttcaccgacagcaaccccgctgagcctgtacccagctccctctccttcctggagaccaggaggctcctgccggtgcaggggaagcagcgggccatcatgggcgccgcacatgagccctccccgcctgggggcctggacgcacgccaggcgctgccccgcgcccacccagccggttcctttcatgcggggcctggagacctgcagaaatgggcccagtcccaagatgggtttgaacataaagagtttttttcatcccaggtggggagaaaatctcaaagtgctttctacccggaggatgacgactacttttttgctgctggtcagccagggtggcacagccacactcaggggacattgggattcccttcccccggggagccaggcccacgggagggggcttttccggctgcacaggtccagaggaggcgggtgaagaagaggcaccggaggcagagaaggagccacgtgttggaggagggcgacgacggcgacaggctgtactcctccatgtccagggccttcctgtaccggctctggaaggggaacgtctcttccaaaatgctgaacccgcgcctgcagaaggcgatgaaggattacctgaccgccaacaagcacggggtgcgcttccgcgggaagcgggaggccgggctgagcagggcacagctgctgtgccagctgcggagccgcgcgcgcgtgcggacgctggacggcaccgaggcgcccttttctgcgctgggctggcggcgcctggtgcccgccgtgcccctgagccagctgcacccccgcggcctgcgcagctgcgctgtcgtcatgtctgcaggcgcaatcctcaactcttccttgggcgaggaaatagattctcatgatgcggttttgagatttaactctgctcctacacgtggttatgagaaagatgttgggaataaaaccaccatacgcatcattaattcgcagattctgaccaaccccagccatcacttcattgacagttcactgtataaagacgtcattttggtggcctgggaccctgccccatattccgcaaatcttaacctgtggtacaaaaaaccggattacaacctgttcactccatatattcagcatcgtcagagaaacccaaatcagccattttacattcttcatcctaaatttatatggcagctctgggatattatccaggagaacactaaagagaagattcaaccaaacccaccatcttctggtttcattggaatcctcataatgatgtccatgtgcagagaggtgcacgtgtatgaatatatcccatccgtgcggcagacggagctgtgccactaccacgagctgtactacgacgcagcctgcaccctcggggcgtaccacccactactctatgagaagctcctggtgcagcgcctgaacatgggcacgcagggggatttgcatcgcaagggcaaggtggttcttcccggcttccaggcggtgcactgccctgcaccaagtccagtcattccacactcttaaaaagggtttcttgggaatcaatgtgcaataaggtactactgttgtactcaaagtcacaaaagaatacttgaagatagattttagacagtgtagttttgagtctttaaacagtaatttagtggtggtcatgataatccttctctttctaagccattgagtatgtattactgctttgaacatagaaatggtttttttaaaaaaataaggctcaagaaagatgcaaaaccaaggatagctagaaagaaaacacatgtatgaccatgggtatgatacctccagaaatgttaacaacttattcttctgccatgagtacccctcatcagggttggtttcaatgacaggttttggtgatgttcctgaccatatgaagtggtttatgtttagaaacattcaaattgagggacatcatttacagcatcgagtgtgtcagttatacatgcattcatcattaaatatcctaggttttatgacagacattgaaattatcactcagatgtgtttaacagcaaaaaattcccagcacatcctggcaaaggcttttatttccaaccgttgcattcttcatctctgcctcccattgcccactgaatgctttgctttctgtgcatcaagacagagttctaaaaccagaaaacatccatcttgaaaggtccaagaaaaagccaaattccatatagcaccacagaggaggccctttgtttccctgcagtatttcaaccaggaacattagtatcacatccaccaggaggcacatcactggcaagtaacatagaatcacagggctgcaggtgcccctggacactccccggttctggcttttctgccttgtacctcctcacctgcagatctaccctgcagcttttgcatagtcagtgacacacttgacaattggcacagctgtgctggggaagacgggagacaccttgctccttccaaactagaaggaaagattttggagccatcaccctgtgcttctagggatgcacgcctgtctttattatacaggtttcttgcaggtttttatcagccagtgggaactccacagtgatgagcactgaatcttcactaaatcttcctacagacatttaggaatccagtccttgcttttgcagatatgttttatgtcagcagcatgacaaagccatataattaaataatttatgtgaaagcattgcttattaacaaggaaaatatgtagatgcttcagagggaaaggcagctagagggaaattttcatcccaatatgttagctatattcagggttgattttttctttaatctcaactgtcactgatacattgaaaaatttttgctatgaatatagtgaaacagaaacattctgtaataccttaattaaacatgctattatttcaatgtataaccaaaacatatctccatggtacagttaagacttgttgcaatgacaatagcagcttaattaaatgcgttctcccttgcaaaatgtatgaatgtcaggagagtttagtggaaaagttttctttgtttcaggattggtttcttctagactgttctcaggactactttcttgagcaagaatggcttacagagactgaaggcttctgtttggttagtctattcagcagatatggagctggaaaacaagacatctcctatagcttgctataatagtgaaggagaaattggaaagttttaatcacaataatatccaataaaagcccattttgagagttttgttattaagtcaatgagaagggataggtaactttgtcctatatattaacttatgtctaaatagacatggttaagccatgttcctttctaatttcttttcttttcttttttttttttttttttgagacagtctctcgctctgtcgcccaggctagagtgcagtggtgcgatcttggttcactgccagctctgcctcccacgttcacaccattctcctgcctcagcctcctgagtagctggggactacaggcacccgccaccacgcccagctaattttttgtatttttagtagagacagggtttcaccgtgttagccagggtggtctcgatctcctgaccttgtgatctgcctgcctcggcctcccaaagtgatgggattataggcgtgagccaccaccgcgcccggtcattcctttctaatttcttgaaaaaactttgtcttgtccttatgtttacatgtgtgtaataatttcagcaactctggaatgtgggtgaggtggctgtggtggatgaatattactccctaccctccttggatctttctagatcttccagaccattaaatgcccctgaagctccttttatagttttgcaagtggatttacttgtagacatccttactatccagcataatcccccttggctgacatgagaacttggttagaggagaatttattggggtcagtgtaaatattcaagttcaaaagcctcagaacccaacactttaaagatttttaaatggaattttgtcgtagtcattgtacttttaaaatagtactttcagtttcattgaggttacaagaaagactgaagagtacaaaggaaatttagttacaatttttgcatttattatggccttaaagactcttgggaatcaggctctgttcaacagtcaataaatgtaatacacacattaatatagtactgactgggcgttcttctataaaagtttaagttctttggcttctaagaaaatgttgggcagttacagttaacttgatgactacttctagtattagccaaatgggtcctaagtggcagcattttgccagacattgactaaatccttacatgccacatttactgaattccaataaacatatagttcttctgtggagtagttaacagtaagtggcagctcactgaatttctcccaggttctgtctcttccaaaatcctccatcctctcttatgaagggaagctgataaaaaaaaatcctcttggtgcaagctgaagctgttaaggattccttttttcactctcaggaccaacagacgttcttttgtatttcaagataatttcacctgttgttgttgttgttgttgttgttgttgttgttgttgttgttgttacaaagaaacaaattttgagcagcaatgacaattcaaccatatctagattctccctaccttatttctccagccagtcacaccaggcagacgggtaacctttaacagacctggtgttctcatggaataccgatgctcgtcccagggagctgacctttctcactatgtccttatagagctgctcttacagagaactttgtgctcaggaccaagggatggtcaattaaaagttgcatgtaagcatcaggcttggatgggcaagggagggcttttatacatctttgaacgaccaggtctttccttgtctgcctgaaggcagagcttcgagaaacagcacttcccatgtgtctggtcctcttggtctctcagccagacacttaatcaatcctggactctccagtagtcctcagtcattgtagccatagcatctgcaaaaaaagaaatgctaaaataatcattagcgttttcaaaattaggaaatcaaagtagctgggtcactctcttacatgtgtatgagccagttaattctgctggacagatcatacttacgctgctgattgactcttctgagcagtaacacatctcctgaattaattaggtaggtcccgtttgggtgctttaagtgggatcagtcttagatgagtgccagtatgtgattgaatttcatacgcacaaatgccatgattcaagttctctctccagtttttcttatagatcaacacacagtacatgtggtcagttacttggttgaatttctgcttagctgtggtaagagacagagaaagggagtgaggtgggaccaggggaattatcagaaagacatgagtgaacctattggccaggtagcttccaagtatgttctattgtattgtctgttttgattctgatagtttagaactctttctgatagtttagaactcttacccagtggttacatgactgatcaaggcaactccatctggaaattaattgcttgggtaaaatgtccctgagtttcaacttgtcttttatctctggatattctcttatgagattattatgcatgtttctgtcacatgggcattatttacacacttgataaatgaaaggtatttctctgtccgttcaaggaaataaaatgtaagttcttgttttattaaatgaatgaagccttttggttaaaaaaaaagtaatgtaatatgtttctgttcaaacttgagctaatgacatttaaggaattaaagacattgatctagttcttagtatgaaaagtgtacatgtagatatagttatataattgtgtatatacatatctacacacatggttggttttatattgctttttcatcaatatttttgactgaaacctttacaataaattttattttaattatgtaaccactaatattttgagagaaggaagcaaatgttatatgtccttctgttaaaagaaaaaaaattcagtcctccgccaaccgcttcccacacactcatactctgcacatcttggctacattaaaatggactgacagaattatttaaaaggcactatgaaggtagaacactaccttaatattttatcctagtcagaagcctgatttaacactgaactttgaagggaagcttagctgtagctcatggctttcaaagattagaagaaacatttactggttctatggaaaatagtcttcttgctaggtagattggaaacaaagaaattgcattggtggtgttaaaatctaacatttataacaaatcctgttttattctagatgaaatacttagacaattcttccagtggaaaccagtgaacttttttaacagctttgggaattcttttgtatgataatttttaaaatgaaatgtgtactcttcaaactaattaaagcttgaagttttccaggagtcgcattttaaaagtgtttgtacacattttaacacttggatattttctattttggttttgtatatttttatgtatacacaatgtacagacttttttcttgtaaataaaacatgttttcatttgtct

SEQ ID NO: 20629 - DNA, 574 bp, Homo sapiens
  ENST00000361803
ttctggtttcattggaatcctcataatgatgtccatgtgcagagaggtgcacgtgtatgaatatatcccatccgtgcggcagacggagctgtgccactaccacgagctgtactacgacgcagcctgcaccctcggggcgtaccacccactactctatgagaagctcctggtgcagcgcctgaacatgggcacgcagggggatttgcatcgcaagggcaaggtggttcttcccggcttccaggcggtgcactgccctgcaccaagtccagtcattccacactcttaaaaagggtttcttgggaatcaatgtgcaataagatgaaatacttagacaattcttccagtggaaaccagtgaacttttttaacagctttgggaattcttttgtatgataatttttaaaatgaaatgtgtactcttcaaactaattaaagcttgaagttttccaggagtcgcattttaaaagtgtttgtacacattttaacacttggatattttctattttggttttgtatatttttatgtatacacaatgtacagacttttttcttgtaaataaaacatgttttcattt

SEQ ID NO: 20630 - DNA, 1657 bp, Homo sapiens
  ENST00000409087
cttccgccggggcaggcgccgggactccctcctggccgcccacagcctgtgcgcattcctgcattcctgccgccgcccgggacccgagtgccccggaggtgtccaggcgcggtgccaggcgggtactgtgcaggttcattctgccacccatctgcattaagacacaaggtgctgaccgcagagacctgccatgaaaccacacttgaagcaatggagacaacgaatgcttttcggaatattcgcttgggggctcctctttttgctgattttcatctacttcaccgacagcaaccccgctgagcctgtacccagctccctctccttcctggagaccaggaggctcctgccggtgcaggggaagcagcgggccatcatgggcgccgcacatgagccctccccgcctgggggcctggacgcacgccaggcgctgccccgcgcccacccagccggttcctttcatgcggggcctggagacctgcagaaatgggcccagtcccaagatgggtttgaacataaagagtttttttcatcccaggtggggagaaaatctcaaagtgctttctacccggaggatgacgactacttttttgctgctggtcagccagggtggcacagccacactcaggggacattgggattcccttcccccggggagccaggcccacgggagggggcttttccggctgcacaggtccagaggaggcgggtgaagaagaggcaccggaggcagagaaggagccacgtgttggaggagggcgacgacggcgacaggctgtactcctccatgtccagggccttcctgtaccggctctggaaggggaacgtctcttccaaaatgctgaacccgcgcctgcagaaggcgatgaaggattacctgaccgccaacaagcacggggtgcgcttccgcgggaagcgggaggccgggctgagcagggcacagctgctgtgccagctgcggagccgcgcgcgcgtgcggacgctggacggcaccgaggcgcccttttctgcgctgggctggcggcgcctggtgcccgccgtgcccctgagccagctgcacccccgcggcctgcgcagctgcgctgtcgtcatgtctgcaggcgcaatcctcaactcttccttgggcgaggaaatagattctcatgatgcggttttgagatttaactctgctcctacacgtggttatgagaaagatgttgggaataaaaccaccatacgcatcattaattcgcagattctgaccaaccccagccatcacttcattgacagttcactgtataaagacgtcattttggtggcctgggaccctgccccatattccgcaaatcttaacctgtggtacaaaaaaccggattacaacctgttcactccatatattcagcatcgtcagagaaacccaaatcagccattttacattcttcatcctaaatttatatggcagctctgggatattatccaggagaacactaaagagaagattcaaccaaacccaccatcttctggtttcattggctcatttgtaaaaattggccatatcagagcttgcagtgagccgagatcacgcgactgcactccagcctggacgacagagtgagactccatctcaaaaaaaaaaaaaaaactggccatataagaaacttaacattcatactgtttaaag

SEQ ID NO: 20631 - DNA, 308 bp, Homo sapiens
  ENST00000419159
acactccgtgtttaggagcgagacccgtgtgtggggaatgttgaaggtggtttggggaaaagcaggaaattctggagaagcgaacgggaggacggcttgcgctttggggacgggcggatacagttgtgcccctgtggctcagtaaaggttcattctgccacccatctgcattaagacacaaggtgctgaccgcagagacctgccatgaaaccacacttgaagcaatggagacaacgaatgcttttcggaatattcgcttgggggctcctctttttgctgattttcatctacttcaccgacagcaaccc

SEQ ID NO: 20632 - DNA, 6861 bp, Homo sapiens
  ENST00000328299
gcagcttacaccgcggtccccttatttggatctgcgggaatgtgggctggagaggtcctgccgtggtaccagcctccagcctgcccccaggactgcccctgacccaggcgcgcccgctgctcggtggcaggagggccggcggagcgccatggcctgcatcctgaagagaaagtctgtgattgctgtgagcttcatagcagcgttccttttcctgctggttgtgcgtcttgtaaatgaagtgaatttcccattgctactaaactgctttggacaacctggtacaaagtggataccattctcctacacatacaggcggccccttcgaactcactatggatacataaatgtgaagacacaagagcctttgcaactggactgtgacctttgtgccatagtgtcaaactcaggtcagatggttggccagaaggtgggaaatgagatagatcgatcctcctgcatttggagaatgaacaatgcccccaccaaaggttatgaagaagatgtcggccgcatgaccatgattcgagttgtgtcccataccagcgttcctcttttgctaaaaaaccctgattattttttcaaggaagcgaatactactatttatgttatttggggacctttccgcaatatgaggaaagatggcaatggcatcgtttacaacatgttgaaaaagacagttggtatctatccgaatgcccaaatatacgtgaccacagagaagcgcatgagttactgtgatggagtttttaagaaggaaactgggaaggacagagtccagtctggctcatatctcagcacagggtggtttaccttccttctggccatggacgcctgttatggcattcacgtctacgggatgataaatgacacctactgcaagacagaagggtatagaaaagtcccctaccattattatgaacaaggaagagatgagtgtgatgaatattttcttcatgaacatgccccatatgggggtcataggtttatcactgaaaagaaagtgtttgctaaatgggccaagaagcacaggataatatttacacatccaaactggacattgtcttgataatggttttcctgatcttgccgcatcacttaatgtgatccccatactgcaactgtgatgctgatgatgctaatggagatgatggtaatgataaagacaacaacaatgattatcaagttcctgtacactctcagatgtggatggtgactctgctagtaatttaaacttggcatttcatggaggatggttgtgctcatgatgttctttctggaggttcaacactacgtaccgcactttataatttaactggaattgagatgaaggccagtgacatgacaactgtgacctaagaaatgggaagattatctttcaagatagctgcctagaattgttcaacagtgagtaacttccagaagccaaaagagtttggcttcatgaggcaaggtgattgactcaatggcttgttgaatctcagcagttccgccatcttgaagaatgattgattgtcaaacactgacccaagaactgctatcagggtgcaagtatcttactacttagcctaaggatgggaaaatatctcttcctaatataccatctttctacagtatttcctacagctaaagcctcaggccattgcctaattaacaatgaagatttcatggacatcctacacttcaggattacttgactatctcaaacacataaatcaaaatgggccaagtagcaaatcttgatgaatttccactcttaccatccattcttactaccaacagtataactgaacatgtgattagaatgatctatattaatgtttagttatttttggttgagtgctaaatatttcagaaggctacttaacatgtaagataccaacttcaacactgtaataacatatactgtgaaaacattcctaaaaagtaaccaaagggtttgctaactctgcttcaacatccaacaacacaaaactatatgatttttaaaatcatgaaatagagacagcaaagcatatttttacatcaatttgtatcctatcatacttcataatatatatttgtatattcaaatttctattttataggcccaaggtgtgtttctccaaacattacattctcattgccaagtgccagctgttacacatggagaggaaatgattccttatattaaacctgaccagagctttttgccttctagggatttatttttcccatagtgtatcagttgttatgccacaataacaacaataataatgttcttaatgtccaaagtgctttgtcatttagagtcctttaacatctgttataccatgtgatgcccttgaacaccccattgggctattgtctgtgtattctgctctctttagcagatgatctgtaatttggtcattgttctgttatattccagattgctctacttgctaatatttgtatagaatagaatttatgtaaactagtaaccagttgatctctgtgccaaatacattatatcaggattacacaaaaagtatcacaaaggatggtcttggccatatgctagggcccctgtgaaaataagtagttttgagaagtttttctatatacgtatatatacacgtgtggttctatttaggtggggaaaaaatgaaaaagcagggacaacaggaggaaatgaaggcagagaaatatagtttcctttcctaggattgagacaattctatttttcatatactcgttgctcattaaatagtaaagggttgatttgctgcaagagtagctgagaattcaaaaacatccttgcagaatgattcaaaagacaaaagccaggctcaacttatagaatgttttggaaactggaagtaatgatacatttcacttcagaagcacttgtaggtctttactagtgctaagtattatggtgagctatcattaaagtgtgccatcttggataaaggccttttgcctactctcttctgcaattttgacacctcaatattcacacccataaacattactaagccccagttctatcgttggaaggagttgttattcttttgttgttcccttatgcaatttttaattctatgaatgttaagtttttttgagctaatgatagatagaaatgcccactcaaagaaaaataaacagagacaaatgttaaaattgccatacagactgtttttccccctgttgtttcactttaaaataaaaagaaatccttgattaatcagaatggcttgggacatgaacttaatttatttagttttctaataaatgaagggccaactcttatttgttctagcccctactgatgagaaacatttgaaaacttgcttgctctcctgcctcgttgtagctttctctgatgaagacttctgcagtatattgtatccctcactctatagcagaaggtgtgtgtggaatatgtagactccagtgttttcttaggaggggtgggaaagggctttctttcctctcctctcctctcgtctcctctttctttcctttctttttgcaactaaactgctactctacactttttattgttgttttctttgtctttttctttctacaaacaggaaacaaaaaaaaaaaaaaacaagtttttctcaatttggagactcaattgaataatttccagtataatcagcattttgatagaatctcacaacttatttttctctgcttttatttcctgtttttctttgttccatctttctaattctagtgaaaatgcaaagtctaatttctcccatgttgagaataaatttttcatctatgatttgctgatagagaagagcttggtaagggagcaattcaaggaaactattttgccatgcacatttctgatcaattcccacagattctggtcaaatgaaagatattctatccaacatttaaacattgaaaaatttaactgaacttacttatcactgatgtgtatttatcccagaaattaattaatatctgtgaaaaataaaaatatttcaatactatccgtgcttcttggaaaatgaactataaaaaagggtcacaatttttctgaaattggcatgaaaacattcaagataaaaataatagactaaacattattttctgttatgcataattctatgaaaaagcaaggtaatttaaaaagagttttaaaatgtgtgtttgaatcttttccaatttaaccaagtgagaagtagcaatgatttacattgttatgatgataatgtgaataagaaaccttttagagtatatgattttacattgctatcaaacctatcaaagaaaaggcaattggaatttggaggaatgtttgtatatatgcacatagagtctatttgtgtgtgtgtgaacgcacatatatatacatctatatacttataactatatataaaagcatatatataatcctatattcttcactggtgcatgtgaatcacagaaagccctattttagacttcatctgaaattcgttgggttacattttgaatcctgatgaaaaaagcaaaaatccaaattaaatggactgattgctaagagtacgtaaaatcatattcaaaagctggccagaagaataaagctagagaagctgctaaatctagaaaacacaatcagatgccacagttgtcacaaatcagacttgtaagtatagcaatctgtattgtaggttctgccgattgcaggcttagctaaagtcacattgaaaaacattgcatcaagcttcattcacactgaagtaaatgaacattggtcctcctattcaaataagccagtctttagcataagcaaaatccagatttgcatgatttttattatatagctacagaactgtgaccactgtgaaaaaggaaaattatacaaggagattgctcttggaggatttggtatgaatcagctgaggtaggaacaagagtctgaattggggacctgctgaccttccaagaagtagaaggccatcagaagaaaatcactgttacttagagaagagacaacactaaagtacttcacctggtagtgttaattggatgttaattatgagctcggtttaatttcaataagcaagaaaatataatcagatgactgatttaaaaaaaaacaacaacaatgtgcccatctagcctttaatgtgacatgtcaaatgcaaataataaattatgttattcagtatcagttgtttgcatgtcttagcacaacaaaggatttacagtctgagggccaagagagaaaaaatgcttttttcttaaaacagcatatttaaaagacaagacctcatcatttcagtagtgtacatagattagtgactgaaggagccagtgctagcctttttaagtaggtcaggcttttagagctgaaagagattttaaagaccagccaattcaactcctacaccttggagctgaggaaacagacagaggtgaagtgacttgcctgtagttataaactggactaatggcagtactgagactcaaattcttgtctcatgttttcttctctagtgctttttccactacactttttagacagaagagtagctggaaaaagaatgcctaactgatttactaaagagtctattcatggaatccaagggctccaaattgtgctaattctgctcaggatgaaacaaatccccacgctgaagtggagaaatattttcataattgaaggaacatatcccattgattgtctacactttcttctctctgtttgttgctattggtaaggctaggctatgttctgttatcacaaaattctaggacttgtttaaagaacttaaaggtcagtttcttagtttctctttgtgattgaggatgagcaagccattgatacaccaagagctgctgagtgttggaggttgcctggtgaaactggcaggccctgttgttgacatttccccagagctaaaatgtcctcatactcaaaccaactgtgctgcccaagttagtgaaattatccatcagcactaacaccaccctttgggttcatgctcatccctgcactccatgtgacctttgagcccagatacccttctagaaggtgaatgaaagccccacatgtcccgcaagacttagtctgcataaaagatttaaaaggatttttttttctctacagtccatttatatgatactgttagaagtgaagaattttgaaactacatacactggcctctgaaaatggttcttgtggctcagaaatagtatattgttctgttgcttgtttttgctgaactgtagagaaaacaccagagtaaaattccatgtaaattgctaaggcatcgaatcagaactgtccttgggcgttgtaacagtgcagaaaatctcatttagtttttttctttttttttttcagttaactacttgtttgtttcttttcagaataggcacttttttttgagtagaaaacctcttctttctccacagatacatctctttttgttcacgccttgaagacttcagaaaaatagaagctcacttccttccataaaggtgaagaacatcttgatgaataaacagtcaactaccaagttcacatatttgcctatgaagtgagagctatttctaagaaacttcaaaaagatcaaaacgaggcaattttatagctttttgttacctaatctacaaagtactaatttccttgtgtttagctttgttgtcactgttactgagtaaatacccatttctgttacatatggtacattttttgcttcacttattttcctgagttcccatgattttttttctgtagtttctcattcattttaaaacccataatcttcatctatttttagaagaaagtgtaaatgcacagttgtacgtttgttgagagtttttatggcattatagtgctttatttataagcattgtgtcttagaataaagcttacaaaatggcaaa

SEQ ID NO: 20633 - DNA, 861 bp, Homo sapiens
  ENST00000464140
cctggtacaaagtggataccattctcctacacatacaggcggccccttcgaactcactatggatacataaatgtgaagacacaagagcctttgcaactggactgtgacctttgtgccatagtgtcaaactcaggtcagatggttggccagaaggtgggaaatgagatagatcgatcctcctgcatttggagaatgaacaatgcccccaccaaaggttatgaagaagatgtcggccgcatgaccatgattcgagttgtgtcccataccagcgttcctcttttgctaaaaaaccctgattattttttcaaggaagcgaatactactatttatgttatttggggacctttccgcaatatgaggaaagatggcaatggcatcgtttacaacatgttgaaaaagacagttggtatctatccgaatgcccaaatatacgtgaccacagagaagcgcatgagttactgtgatggagtttttaagaaggaaactgggaaggacagtacagagtgaccatgcagtgttgattgatcgaacagcaaccaccacatacatgtcctgccccaccacaaaaggaaggaaggaataaaagaaagaaagaaagaaacaaacaaacaaacaaacaaaactaagcaagacaaaacaaatacccatgtcagtggttcaaagattaagattgtggctttgtgtaaagttctttccctttgtagacttgctgcataattattcaggtatgatggttacagtttttaaaaaggaagggaaattgtggtatgtggtatgtaaatatttttaaatgttgtctctctgttttgatcagtttttgttttattcaatttgtctttattaaatcttatcaaagcaaaa

SEQ ID NO: 20634 - DNA, 617 bp, Homo sapiens
  ENST00000621530
tgtagagaaagtctgtgattgctgtgagcttcatagcagcgttccttttcctgctggttgtgcgtcttgtaaatgaagtgaatttcccattgctactaaactgctttggacaacctggtacaaagtggataccattctcctacacatacaggcggccccttcgaactcactatggatacataaatgtgaagacacaagagcctttgcaactggactgtgacctttgtgccatagtgtcaaactcaggtcagatggttggccagaaggtgggaaatgagatagatcgatcctcctgcatttggagaatgaacaatgcccccaccaaaggttatgaagaagatgtcggccgcatgaccatgattcgagttgtgtcccataccagcgttcctcttttgctaaaaaaccctgattattttttcaaggaagcgaatactactatttatgttatttggggacctttccgcaatatgaggaaagatggcaatggcatcgtttacaacatgttgaaaaagacagttggtatctatccgaatgcccaaatatacgtgaccacagagaagcgcatgagttactgtgatggagtttttaagaaggaaactgggaaggacagaaatgag

SEQ ID NO: 20635 - DNA, 3751 bp, Homo sapiens
  ENST00000477717
agttgtgtagatcgctgagagactacgagggtccggttcagttttaattctgtctctaatctctgcaacagccgcgcttcccgggtcccgcggctcccgcgcgcgatctgccgcggccggctgctgggcaaaaatcagagccgcctccgccccattacccatcatggaaaccctccaggaaaaagtggccccggacgcgcgagcctgaggattctgcacaaaagaggtgcccaaaatgaagaccctgatgcgccatggtctggcagtgtgtttagcgctcaccaccatgtgcaccagcttgttgctagtgtacagcagcctcggcggccagaaggagcggcccccgcagcagcagcagcagcagcagcaacagcagcagcaggcgtcggccaccggcagctcgcagccggcggcggagagcagcacccagcagcgccccggggtccccgcgggaccgcggccactggacggatacctcggagtggcggaccacaagcccctgaaaatgcactgcagggactgtgccctggtgaccagctcagggcatctgctgcacagtcggcaaggctcccagattgaccagacagagtgtgtcatccgcatgaatgacgcccccacacgcggctatgggcgtgacgtgggcaatcgcaccagcctgagggtcatcgcgcattccagcatccagaggatcctccgcaaccgccatgacctgctcaacgtgagccagggcaccgtgttcatcttctggggccccagcagctacatgcggcgggacggcaagggccaggtctacaacaacctgcatctcctgagccaggtgctgccccggctgaaggccttcatgattactcgccacaagatgctgcagtttgatgagctcttcaagcaggagactggcaaagacaggaagatatccaacacttggctcagcactggctggtttacaatgacaattgcactggagctctgtgacaggatcaatgtttatggcatggtgcccccagacttctgcagggatcccaatcacccttcagtaccttatcattattatgaaccttttggacctgatgaatgtacaatgtacctctcccatgagcgaggacgcaagggcagtcatcaccgctttatcacagagaaacgagtctttaagaactgggcacggacattcaatattcacttttttcaaccagactggaaaccagaatcacttgctataaatcatcctgagaataaacctgtgttctaaggaatgagcatgccagactgtaatcccaggtattcactgcatcagacaccgagacactgaacttcctgagccaccagacaggaaagggtagcagaaaacagcttcactcctcaggaagtaccatggacagacgcctaccaggggtgacaaagcagtgcagttggattgtaaggaaaaattccggaattaatgcatcctaatgaatgttgtccccttcaatggtgttaccttaggagctgaacattcaattcagttacaccactatgactaaaaacagtttggatctcttagtattgcctttgaaactgcaacataagcaactcaacaatattagttgcattcctttatagacataccatgtcaaagacgtttttctatcaagttgtattctttcctgttctataacctttgtcatctgttagactctgtatgtgtgatttgtaaaaagcaggctgaaactatggacatgatttctgaagagcacatctccactgactttcataaagcaaatgtccaatatttatttattgagagttttttagtgcaatctgggccagtatttttatagattatgattatgtggtaatttatccttcctaactctttaatcctgaatgatggttggaaatggcctagaattaggttactctgttcacaatgctcattgttagcatgcaattggtatttgacttggaagtgttgtgttgtattttttgaacccctaggcttcaggaaaactgctcttttgtaaaaagaatagcgatgacattttctaatgtgcagaaatgttccaaaaggacaaaattgaaaaccaaaaactatgttattaaaacaaaaaaatgctaacaagagaaatttaaaggtagttttctttagtaataatttatgtaagtgtcctctcttgagccctagtttcctttttggcagaatgatgtcactgtaccagacaacctcttaggtttcatcccaaatctaaacttgtggcctcttcttgacccatttgaagactctgcacttggagtgatggggccccaacagtagcaggaactttattttggggagccttatctacattcatattacttatatcactcttgtggttaaaactacacttcttcctgtgtccacatgggctaaaatctaccccctgcttctctcgaagcatcaccatccgcctcttccccagcctctcaacacaaaaacacaggatacacacacacacacacacacaaaagacatagctccaaggggttccctggctacaatagcaaacagctgcccttctgtgaggaaaagagactacaaggacatgccctatcattcaactcatttatgctatgaactgtttagactcactacaaatcttcttagattatattcattaccattccctggtctgaaggagtataaaggacttattttattcagagccaagataaattcatattatagatttttatttaaacaagtaatattgttcaaaaatagtctcttataaatatactagtgttttctttacacatgacttagaaggcattagtttctctaatgccaaatttgaaggcaccagcaaatattatgtatgaagactgacattgttttacagacatgacctggcttatgataaaagaagttttatcgcattaccacttcttttcccttttcttaattagtacactaactagtactattaattacacggagtattgttgttaaaatgcaaacacaatcagggtactcacataacataaacaaagttgatattgatgtgtatggcttgggctgttcaaagccagtaagattgaaatggccgtccaaaacatactggaatatgttctttaagttttctcatagtttttaaagggactatgaattttattccaacacattgtcttccacagcatggactctgaacacatcatactttatcaacatatgaaaaagtgtattaattttatacaatttacttataggccacctttataatcacttgaagacgttatgttgctcaaacataagtggctcctttggcaatttctatatttgtggaaatttggaaaggcatagtttcaacatgcaagaatgtaattatattgcttcatctaataatatctcacatatctgtctatcttcagattttagattttctttattaaaaaaaccatcatggtagctccatctcgtttgtaacttctccctctcaaatactcagaagaatgaagaggccaaattcagaaaatcatggcttcactgggaaatgttttaaatctacatgtagctaggatatgtgatttcatattttttaaaaatgtggtgtaaataagtgtaaaaaattaccacttgcaaagtggttttattacagcgttaaagaaaatgactagaattctgatagattgtgctgatgaacctggttgtgggcaattgaattcttgtcttcccactaccatttcatgactgtcgtctgaacactattcaacaccattaaatataaactctgatataaaa

SEQ ID NO: 20636 - DNA, 573 bp, Homo sapiens
  ENST00000480428
agttttaattctgtctctaatctctgcaacagccgcgcttcccgggtcccgcggctcccgcgcgcgatctgccgcggccggctgctgggcaaaaatcagagccgcctccgccccattacccatcatggaaaccctccaggaaaaagtggccccggacgcgcgagcctgaggattctgcacaaaagaggtgcccaaaatgaagaccctgatgcgccatggtctggcagtgtgtttagcgctcaccaccatgtgcaccagcttgttgctagtgtacagcagcctcggcggccagaaggagcggcccccgcagcagcagcagcagcagcagcaacagcagcagcaggcgtcggccaccggcagctcgcagccggcggcggagagcagcacccagcagcgccccggggtccccgcgggaccgcggccactggacggatacctcggagtggcggaccacaaggcctcaggaaaatgatggaatatgctggatgtgatgaccaccaagccatatgctgctgcgtattgaatcagaattccaacagccttttttatctgccattgttttacatagtctgg

SEQ ID NO: 20637 - DNA, 2055 bp, Homo sapiens
  ENST00000318803
agttttaattctgtctctaatctctgcaacagccgcgcttcccgggtcccgcggctcccgcgcgcgatctgccgcggccggctgctgggcaaaaatcagagccgcctccgccccattacccatcatggaaaccctccaggaaaaagtggccccggacgcgcgagcctgaggattctgcacaaaagaggtgcccaaaatgaagaccctgatgcgccatggtctggcagtgtgtttagcgctcaccaccatgtgcaccagcttgttgctagtgtacagcagcctcggcggccagaaggagcggcccccgcagcagcagcagcagcagcagcaacagcagcagcaggcgtcggccaccggcagctcgcagccggcggcggagagcagcacccagcagcgccccggggtccccgcgggaccgcggccactggacggatacctcggagtggcggaccacaagcccctgaaaatgcactgcagggactgtgccctggtgaccagctcagggcatctgctgcacagtcggcaaggctcccagattgaccagacagagtgtgtcatccgcatgaatgacgcccccacacgcggctatgggcgtgacgtgggcaatcgcaccagcctgagggtcatcgcgcattccagcatccagaggatcctccgcaaccgccatgacctgctcaacgtgagccagggcaccgtgttcatcttctggggccccagcagctacatgcggcgggacggcaagggccaggtctacaacaacctgcatctcctgagccaggtgctgccccggctgaaggccttcatgattactcgccacaagatgctgcagtttgatgagctcttcaagcaggagactggcaaagacagatatccaacacttggctcagcactggctggtttacaatgacaattgcactggagctctgtgacaggatcaatgtttatggcatggtgcccccagacttctgcagggatcccaatcacccttcagtaccttatcattattatgaaccttttggacctgatgaatgtacaatgtacctctcccatgagcgaggacgcaagggcagtcatcaccgctttatcacagagaaacgagtctttaagaactgggcacggacattcaatattcacttttttcaaccagactggaaaccagaatcacttgctataaatcatcctgagaataaacctgtgttctaaggaatgagcatgccagactgtaatcccaggtattcactgcatcagacaccgagacactgaacttcctgagccaccagacaggaaagggtagcagaaaacagcttcactcctcaggaagtaccatggacagacgcctaccaggggtgacaaagcagtgcagttggattgtaaggaaaaattccggaattaatgcatcctaatgaatgttgtccccttcaatggtgttaccttaggagctgaacattcaattcagttacaccactatgactaaaaacagtttggatctcttagtattgcctttgaaactgcaacataagcaactcaacaatattagttgcattcctttatagacataccatgtcaaagacgtttttctatcaagttgtattctttcctgttctataacctttgtcatctgttagactctgtatgtgtgatttgtaaaaagcaggctgaaactatggacatgatttctgaagagcacatctccactgactttcataaagcaaatgtccaatatttatttattgagagttttttagtgcaatctgggccagtatttttatagattatgattatgtggtaatttatccttcctaactctttaatcctgaatgatggttggaaatggcctagaattaggttactctgttcacaatgctcattgttagcatgcaattggtatttgacttggaagtgttgtgttgtattttttgaacccctaggcttcaggaaaactgctcttttgtaaaaagaatagcgatgacattttctaatgtgcagaaatgttccaaaaggacaaaattgaaaaccaaaaactatgttattaaaacaaaaaaatgctaacaagag

SEQ ID NO: 20638 - DNA, 787 bp, Homo sapiens
  ENST00000496845
ttttaattctgtctctaatctctgcaacagccgcgcttcccgggtcccgcggctcccgcgcgcgatctgccgcggccggctgctgggcaaaaatcagagccgcctccgccccattacccatcatggaaaccctccaggaaaaagtggccccggacgcgcgagcctgaggattctgcacaaaagaggtgcccaaaatgaagaccctgatgcgccatggtctggcagtgtgtttagcgctcaccaccatgtgcaccagcttgttgctagtgtacagcagcctcggcggccagaaggagcggcccccgcagcagcagcagcagcagcagcaacagcagcagcaggcgtcggccaccggcagctcgcagccggcggcggagagcagcacccagcagcgccccggggtccccgcgggaccgcggccactggacggatacctcggagtggcggaccacaaggtgacagcatgcccgccagcccgctcgccactcagcctggggatcccgcacacctgagccttccccctttcccggggctgggaggcgctgtgagtaggtgccgttcgaaggctggaggggagtggacccgctggggtagggtgggctagttccaacttggtatgaattcttatttggagaaagacacaaagttttgtagaaaataggggtgaggtgcgtggaccccaaagcctaatttcccagcagaaatcggccctggaactagaactccctgatccccagaattgcagctgcggatggaggtccggttcctgaagcctcgggtttggccg

SEQ ID NO: 20639 - DNA, 533 bp, Homo sapiens
  ENST00000488940
tgcgtgagggaagagcagagtcatagactctcctcagactatcttattgacggacaagttacagcccctgaaaatgcactgcagggactgtgccctggtgaccagctcagggcatctgctgcacagtcggcaaggctcccagattgaccagacagagtgtgtcatccgcatgaatgacgcccccacacgcggctatgggcgtgacgtgggcaatcgcaccagcctgagggtcatcgcgcattccagcatccagaggatcctccgcaaccgccatgacctgctcaacgtgagccagggcaccgtgttcatcttctggggccccagcagctacatgcggcgggacggcaagggccaggtctacaacaacctgcatctcctgagccaggtgctgccccggctgaaggccttcatgattactcgccacaagatgctgcagtttgatgagctcttcaagcaggagactggcaaagacaggaagatatccaacacttggctcagcactggctggtttacaatgacaattgcactggagc

SEQ ID NO: 20640 - DNA, 8251 bp, Homo sapiens
  ENST00000388887
accaagactcctggatttgccatttttcctttctgaaggcaggtctcacctatctcctggttcgatctaggaaaaaggaaaggaagggatttaaaagtaaacagtgaaatgagaaagaattcactgggagtttatcaaactaagttaaaatagctaagtcagcctgacaggtgcttggcacagagaaggagcaaatatttcctcatgatgctacaacatttagtaattttttgtcttggattggttgtacaaaatttctgctccccagctgaaaccacagggcaggcaagaagatgtgataggaagtctcttcttacaattaggaccgagtgccgatcctgcgctctcaaccttggagtcaagtgcccggatggttacaccatgattaccagtggctctgtaggggttcgagattgcaggtacacctttgaggtcagaacatactctctgtctctccccggatgccgccatatttgtaggaaggactatctccaacctcggtgttgtcctggccgctggggcccagactgtatagagtgcccaggtggagcggggtcaccctgcaatggcagaggcagttgtgctgaaggcatggaaggaaatggaacctgctcctgccaagaagggtttggtggaacagcctgtgaaacctgtgctgacgacaacttatttggacccagctgttcatcagtgtgcaactgtgtgcatggggtgtgcaacagtggactagatggcgatggaacctgtgagtgctactctgcgtacactggccccaagtgtgacaagcccatccctgaatgtgcagccttgctctgcccagaaaattccagatgttcgccttccactgaagatgaaaacaaactggaatgcaaatgccttcccaattaccgaggcgatggcaaatactgcgaccccatcaatccatgtttacgaaaaatctgccaccctcatgctcattgtacgtacctgggaccaaatcggcacagttgtacatgccaagaaggctaccgtggggatggccaagtgtgcttgcctgtggacccctgccaaattaactttggaaactgccctacaaagtctacagtgtgcaaatatgatgggcctggacagtctcactgcgagtgtaaggagcattaccagaatttcgtacctggagtggggtgcagtatgactgatatatgtaaatcagataacccgtgtcataggaatgcaaattgcaccaccgtcgcaccaggccgaactgaatgcatttgccagaaaggttacgtgggtgatggcttaacgtgttatggaaacattatggagcgactcagagaattaaatactgaacccagaggaaaatggcaaggaaggctgacctctttcatctcactcctagacaaagcttatgcctggccactgagtaagctgggacccttcacggtgctgttacctacagacaagggactgaaaggattcaatgtaaatgagcttttggtggataataaagctgctcaatactttgtgaaactccacataattgctggtcagatgaacatcgaatatatgaataacacagacatgttctacaccttgactggaaagtcgggggaaatcttcaacagcgataaggacaatcaaataaagcttaaactccatggaggcaaaaagaaggtaaaaattatacaaggggacatcattgcttccaatgggcttctgcacatccttgacagagccatggacaagttagaacccacatttgagagcaacaatgagcaaaccataatgacaatgctacaaccaaggtacagcaagttcagatctttgttagaggaaaccaatttgggacatgccttagatgaggatggagttggtggaccatacaccatttttgttccaaataatgaagcattgaataacatgaaggacggcactctcgattacctcctttctccagagggatctcggaagcttctggaactcgtcagataccacattgtcccatttacccagcttgaagtggccactctcatctccacccctcacatcaggagcatggccaaccagctcatacagttcaacaccaccgacaatggacagattctggcaaatgatgtggcaatggaagaaattgagatcactgccaaaaatggccgaatttacacactgacaggagttctcattcctccctccattgtcccgattctgccccatcgatgtgatgaaacaaagagagagatgaaactgggcacttgtgtgagctgttctctggtgtactggagcagatgtcctgctaactctgagcccacagcactcttcacacacagatgtgtctacagtggcaggtttgggagcctgaagagcggctgtgcccggtactgcaatgccactgtgaagattccaaagtgctgcaaaggcttctatggacctgactgcaaccagtgtccaggaggcttctcaaatccatgctcaggaaatggacagtgtgcagatagcctcggcggcaacgggacatgcatttgtgaggagggcttccaaggctcccagtgtcagttctgctctgatcccaataaatacggacctcggtgtaacaaaaaatgcctgtgcgttcacggaacatgcaataacaggatagacagcgatggggcctgcctcactggcacatgcagagacggctctgccgggagactctgtgataagcagacctcagcctgtgggccctacgtgcagttctgtcacatccacgccacctgtgaatacagcaatgggacagccagttgtatttgcaaagcaggatatgaaggagatggaactctgtgttctgagatggacccttgcacaggactaactccaggaggctgtagccgcaatgcagaatgcatcaaaactggcacgggcacccacacctgcgtgtgtcagcagggttggacagggaatgggagagactgctcggagatcaacaactgcctgctgcccagtgcaggcggctgccacgacaacgcatcctgtttgtatgtgggtcccgggcagaatgagtgtgagtgcaagaaaggatttcgaggaaatgggattgactgtgaaccaataacttcatgcttggaacaaaccgggaaatgtcatccattggcaagctgtcaatctacttcgtctggtgtctggagctgtgtttgtcaagagggctatgaaggagatggctttctgtgctatggaaacgcagcagtggaattgtcatttctctccgaagcagctatatttaaccgatggataaataatgcttctctacaacccacactgtcagccacctcaaacctcactgtcctcgtgccttcccaacaagctactgaggacatggaccaggatgagaaaagcttctggttgtcacagagcaatattccagccctaataaagtaccatatgctactaggcacatacagagtggcagatctgcagaccctgtcttcttctgacatgttggcaacatctttgcagggcaacttccttcacttggcaaaggtggatgggaatatcacaattgaaggggcctccattgtcgatggggacaacgcagccacaaatggagtgatacacatcatcaacaaggtgctggtcccacaaagacgtctaactggctccttaccaaacctgctcatgcggctggaacagatgcctgactattccatcttccggggctacatcattcaatataatctggcgaatgcaattgaggctgccgatgcctacacagtgtttgctccaaacaacaatgccatcgagaattacatcagggagaagaaagtcttgtctctagaggaggacgtcctccggtatcatgtggtcctggaggagaaactcctgaagaatgacctgcacaatggcatgcatcgtgagaccatgctgggtttctcctatttccttagcttctttctccataatgaccagctctatgtaaatgaggctccaataaactacaccaatgtagccactgataagggagtgatccatggcttgggaaaagttctggaaattcagaagaacagatgtgataataatgacactactattatacgaggaagatgtaggacatgctcctcagagctgacctgcccattcggaactaaatctctaggtaatgagaagaggagatgcatctatacctcctatttcatgggaagacgaaccctgtttattgggtgccagccaaaatgtgtgagaaccgtcattacgagagaatgctgtgccggcttctttggcccccaatgccagccctgcccagggaatgcccagaatgtctgctttggtaatggcatctgtttggatggagtgaatggcacaggtgtgtgtgagtgtggggagggcttcagcggcacagcctgcgagacctgcaccgagggcaagtacggcatccactgtgaccaagcatgttcttgtgtccatgggagatgcaaccaaggacccttgggagatggctcctgtgactgtgatgttggctggcgaggagtgcattgtgacaatgcaaccacagaagacaactgcaatgggacatgccataccagcgccaactgcctcaccaactcagatggtacagcttcatgcaagtgtgcagcaggattccaaggaaacgggaccatctgcacagcaatcaatgcctgtgagatcagcaatggaggttgctctgccaaggctgactgtaagagaaccaccccaggaaggcgagtgtgcacgtgcaaagcaggctacacgggtgatggcattgtgtgcctggaaatcaacccgtgtttggagaaccatggtggctgtgacaagaatgcggagtgcacacagacaggacccaaccaggctgcctgtaactgtttgccagcatacactggagatggaaaggtctgcacactcatcaatgtctgcttaactaaaaatggcggctgtagtgaatttgccatctgcaaccacactgggcaagtagaaaggacttgtacttgcaagccaaactacattggagatggatttacctgccgcggcagcatttatcaggagcttcccaagaacccgaaaacttcccagtatttcttccagttgcaggagcatttcgtgaaagatctggtcggcccaggccccttcactgtttttgcacctttatctgcagcctttgatgaggaagctcgggttaaagactgggacaaatacggtttaatgccccaggttcttcggtaccatgtggtcgcctgccaccagctgcttctggaaaacctgaaattgatctcaaatgctacttccctccaaggagagccaatagtcatctccgtctctcagagcacggtgtatataaacaataaggctaagatcatatccagtgatatcatcagtactaatgggattgttcatatcatagacaaattgctatctcccaaaaatttgcttatcactcccaaagacaactctggaagaattctgcaaaatcttacgactttggcaacaaacaatggctacatcaaatttagcaacttaatacaggactcaggtttgctgagtgtcatcaccgatcccatccacaccccagtcactctcttctggcccaccgaccaagccctccatgccctacctgctgaacaacaggacttcctgttcaaccaagacaacaaggacaagctgaaggagtatttgaagtttcatgtgatacgagatgccaaggttttagctgtggatcttcccacatccactgcctggaagaccctgcaaggttcagagctgagtgtgaaatgtggagctggcagggacatcggtgacctctttctgaatggccaaacctgcagaattgtgcagcgggagctcttgtttgacctgggtgtggcctacggcattgactgtctgctgattgatcccaccctggggggccgctgtgacacctttactactttcgatgcctcgggggagtgtgggagctgtgtcaatactcccagctgcccaaggtggagtaaaccaaagggtgtgaagcagaagtgtctctacaacctgcccttcaagaggaacctggaaggctgccgggagcggtgcagcctggtgatacagatccccaggtgctgcaagggctacttcgggcgagactgtcaggcctgccctggaggaccagatgccccgtgtaataaccggggtgtctgccttgatcagtactcggccaccggagagtgtaaatgcaacaccggcttcaatgggacggcgtgtgagatgtgctggccggggagattcgggcctgattgtctgccctgtggctgctcagaccacggacagtgcgatgatggcatcacgggctccgggcagtgcctctgtgaaacggggtggacaggcccctcgtgtgacactcaggcagttttgcctgcagtgtgtacgcctccttgttctgctcatgccacctgtaaggagaacaacacgtgtgagtgtaacctggattatgaaggtgacggaatcacatgcacagttgtggatttctgcaaacaggacaacgggggctgtgcaaaggtggccagatgctcccagaagggcacgaaggtctcctgcagctgccagaagggatacaaaggggacgggcacagctgcacagagatagacccctgtgcagacggccttaacggagggtgtcacgagcacgccacctgtaagatgacaggcccgggcaagcacaagtgtgagtgtaaaagtcactatgtcggagatgggctgaactgtgagccggagcagctgcccattgaccgctgcttacaggacaatgggcagtgccatgcagacgccaaatgtgtcgacctccacttccaggataccactgttggggtgttccatctacgctccccactgggccagtataagctgacctttgacaaagccagagaggcctgtgccaacgaagctgcgaccatggcaacctacaaccagctctcctatgcccagaaggccaagtaccacctgtgctcagcaggctggctggagaccgggcgggttgcctaccccacagccttcgcctcccagaactgtggctctggtgtggttgggatagtggactatggacctagacccaacaagagtgaaatgtgggatgtcttctgctatcggatgaaagatgtgaactgcacctgcaaggtgggctatgtgggagatggcttctcatgcagtgggaacctgctgcaggtcctgatgtccttcccctcactcacaaacttcctgacggaagtgctggcctattccaacagctcagctcgaggccgtgcatttctagaacacctgactgacctgtccatccgcggcaccctctttgtgccacagaacagtgggctgggggagaatgagaccttgtctgggcgggacatcgagcaccacctcgccaatgtcagcatgtttttctacaatgaccttgtcaatggcaccaccctgcaaacgaggctgggaagcaagctgctcatcactgccagccaggacccactccaaccgacggagaccaggtttgttgatggaagagccattctgcagtgggacatctttgcctccaatgggatcattcatgtcatttccaggcctttaaaagcaccccctgcccccgtgaccttgacccacactggcttgggagcagggatcttctttgccatcatcctggtgactggggctgttgccttggctgcttactcctactttcggataaaccggagaacaatcggcttccagcattttgagtcggaagaggacattaatgttgcagctcttggcaagcagcagcctgagaatatctcgaaccccttgtatgagagcacaacctcagctcccccagaaccttcctacgaccccttcacggactctgaagaacggcagcttgagggcaatgaccccttgaggacactgtgagggcctggacgggagatgccagccatcactcactgccacctgggccatcaactgtgaattctcagcaccagttgccttttaggaacgtaaagtcctttaagcactcagaagccatacctcatctctctggctgatctgggggttgtttctgtgggtgagagatgtgttgctgtgcccacccagtacagcttcctcctctgaccctttggctcttcttcctttgtactcttcagctggcacctgctccattctgccctacatgatgggtaactgtgatctttcttccctgttagattgtaagcctccgtctttgtatcccagcccctagcccagtgcctgacacaggaactgtgcacaataaaggtttatggaacagaaacaaagtcaacag

SEQ ID NO: 20641 - DNA, 310 bp, Homo sapiens
  ENST00000549474
cagaagaacagatgtgataataatgacactactattatacgaggaagatgtaggacatgctcctcagagctgacctgcccattcggaactaaatctctatagccagttgaggaccgcagcaagaaatcttgtcagagaagagagattccatatccaaaaccatatccagcctggatatattccacctgcctgatttccttttatagttgaagttgcaactaactttctcaaagaaacagatggcagggtaatgagaagaggagatgcatctatacctcctatttcatgggaagacgaaccctgtttattg

SEQ ID NO: 20642 - DNA, 301 bp, Homo sapiens
  ENST00000549798
tggctttgagcttcatggcagccagtataaaaaaggattgacatgacctcatagttttatatcgctcacatgatacatatcacttccaaagaagtagcttttctgagcacaaaatactaaaaatcctcaggtgagatttagtaagagggctaagacagcaactggttctctttttcagcaaccacagaagacaactgcaatgggacatgccataccagcgccaactgcctcaccaactcagatggtacagcttcatgcaagtgtgcagcaggattccaaggaaacgggaccatctgcacag

SEQ ID NO: 20643 - DNA, 793 bp, Homo sapiens
  ENST00000548073
caagaaagagaggacacttttgttcacccagtggctcaatcaatcagtcaacatctaatgaccacctactgtgtgccaggcacagaggtgcaataggcaaagtgagactttatgggttttatggcctaataggggaatcagacattaaccaagtgatgccacaacacatgaacttgcagctgacccatggccctgtctgtatccctgcaggccaagtaccacctgtgctcagcaggctggctggagaccgggcgggttgcctaccccacagccttcgcctcccagaactgtggctctggtgtggttgggatagtggactatggacctagacccaacaagagtgaaatgtgggatgtcttctgctatcggatgaaagatgtgaactgcacctgcaaggtgggctatgtgggagatggcttctcatgcagtgggaacctgctgcaggtcctgatgtccttcccctcactcacaaacttcctgacggattcactgaggaaaggaaaagtcctcaaactctcccacggcgcaggcagaagacacagcaaaggagcagcaggctgagttggctcacaccatgaatattcacagatgggtgatgccctgggaccttcttcagccacccaggtccctgcacaccagggctggcccctctgatgacttccttcttctccccaggaagtgctggcctattccaacagctcagctcgaggccgtgcatttctagaacacctgactgacctgtccatccgcggcaccctctttgtgccacagaacagtgggctgggggagaatg

SEQ ID NO: 20644 - DNA, 561 bp, Homo sapiens
  ENST00000548579
tcaagcagccacgtggaggatgggctgtgacgtggctgtgtcttaaaccataggattcactgaggaaaggaaaagtcctcaaactctcccacggcgcaggcagaagacacagcaaaggagcagcaggctgagttggctcacaccatgaatattcacagatgggtgatgccctgggaccttcttcagccacccaggtccctgcacaccagggctggcccctctgatgacttccttcttctccccaggaagtgctggcctattccaacagctcagctcgaggccgtgcatttctagaacacctgactgacctgtccatccgcggcaccctctttgtgccacagaacagtgggctgggggagaatgagaccttgtctgggcgggacatcgagcaccacctcgccaatgtcagcatgtttttctacaatgaccttgtcaatggcaccaccctgcaaacgaggctgggaagcaagctgctcatcactgccagccaggacccactccaaccgacggagaccaggtttgttgatggaagagccattctgcagtgggacatctttgcct

SEQ ID NO: 20645 - DNA, 499 bp, Homo sapiens
  ENST00000552777
gaggacattaatgttgcagctcttggcaagcagcagcctgagaatatctcgaaccccttgtatgagagcacaacctcagctcccccagaaccttcctacgaccccttcacgatgaagaaactgcagccgagttgggatgatttgtcttgggccacccagcttcaagcaggagagactaaaacaggtggccctacccccagcccatcctgcctcccaacacaaggcagcagcacaaacaaacacgcccagcacatacgtgttcacagtgctcagggagagtcatgcctcagaccagtggccaccagaaagattcaactaggactcaacacacagaatgccctgcccccttacaaccctctcttttccaggactctgaagaacggcagcttgagggcaatgaccccttgaggacactgtgagggcctggacgggagatgccagccatcactcactgccacctgggccatcaactgtgaattctcagcaccagttgcctttt

SEQ ID NO: 20646 - DNA, 3227 bp, Homo sapiens
  ENST00000273183
agaagcccgctcgcccgctgccgagtggcagtcacgactgtgaggtcgccggcgaggtggccgcgggcgcggcggggcggggcagggcgcactctcctccacgcccgcggaagtgccggggaggtgggcagggcggggagggagagggagcgaggctggaggagggcacgtcggcgcctcggcgaggatgggagtccccaggacccggagctgagcagcctggcgcgcggcgggcagggcgcgcaggacagaagcctcgctgttcctccgggagcccaacaccgttcccgcgcggccacgatgatccctccgagcagcccccgcgaggacggcgtggacgggctgcccaaggaggcggtgggcgccgagcaaccgccctctcctgcatccaccagcagccaggaatccaagctccagaaactaaaacgatcactttctttcaagaccaagagtttacggagcaaaagtgctgacaacttcttccagcgaaccaacagcgaagacatgaaactgcaagcacacatggtggctgagatcagccccagctccagcccactccctgctccaggaagcctgacgtccacacccgccagggctggtctgcatccaggtggcaaggctcatgcctttcaggaatacatcttcaagaagcccactttctgtgatgtctgcaaccacatgatagtgggaacaaatgctaagcatggactgcgctgcaaagcctgtaagatgagcatccaccacaagtgcacagatggcctggcaccccagcggtgcatgggcaagctgccaaaggggtttcggcgttactacagctcccccttgctcattcatgaacagtttggctgcattaaagaagttatgcccattgcctgtggcaataaggtggaccctgtctacgagaccctccgcttcggcacctccctggcccagaggacaaagaagggcagctccggcagtggctctgactcacctcacagaacctctacttcagatcttgtggaggttcctgaggaagccaatgggccaggaggcgggtatgacctaaggaaacgcagcaacagcgtgtttacatatccagaaaatggcactgatgatttcagagatccagcgaagaacataaaccaccagggatctctttccaaagacccattacagatgaacacctatgttgccttgtacaaatttgtaccacaggagaatgaagatttggaaatgaggccaggagacataattactcttttagaggattccaatgaagactggtggaaagggaaaattcaagacagaattggcttctttccagccaactttgttcagagactacaacaaaatgagaagatttttagatgtgttagaaccttcattgggtgtaaggaacaggggcagataacactgaaagagaatcagatctgcgtgagttctgaagaagaacaagatggttttatcagagtcctcagtggaaaaaagaaaggcctcatcccccttgatgtactagaaaacatctgattgctggctcctcctccgtttgcagtaggcaagctctgctgcgatgcctctgcctcatctcacactgcgtcaacccaaaggagctgccgcactgacccagccccccaggaaacagtgagacaagaatcaagtatctgagactgtggagtaatagccacaaaacagagggcccactgcacagcatatccaggctgccacaggtggggacgaggctgagagagtcagcaggcagagccagatgccatgcttggcagcagcagtaggactataaaccacagctgtcccccaggatcccactcctttcctgtctgtgtggtgtaagttaacacactggagtgtgctccagtttgcagggtagcccagtgcaaggttcagatccatgtagctaagtattatcctgcttccagacctatgtcaccagtaccaatcagtcagtgtcatcacatttcaggccccaagcaatctctgtgcaaagcatcagaaagacctgcttcccagcccccagcattccagtgctctccaggcttcctctctttgtgattgtgctgtccagagtgtccagcttgttctttctttctcttcagtcctctgagtacatctggtggtgtgcattagatgtgagggctatgttgacatggcatcacctccaaagacctgacctgcctaaagactgatgacaggccatccttcctgctgttctaggtactggcctgggtgacagagcaggacatgagacatagatacagtggggaggagaagtggggaaaggtggagcagagagttcttacttattgaagattatacagccctttcggttatgaagtccctgcttgaaggcaatggacctggggaagagactatcacaaaaagtctccattttcattttacatcctctctattggaggcagcacttttccctcatgctgtcctataggactccactttgaaggttgtgcctacgttgcagggaactaggaacatggaggggaaccaacaacagcatcttagaagaaatgtagccaaattggagtccattcttctttagggcagtatatgaaatcctagcagatgtaaaatggaaaagaatcctaatgcttcttccttcagaaagtagaggaactaggggcccaattagcatcatctaggggaatctctattactctgtacttatactaatgtttacaagaatgcaatatactgtgatgccttcctactcaagcctcctagcattcaaacttccatcctattagtcattaacatggttaaacttcaattcacaatcaccttggaatcaatgtcagtttgatttattttgttacagagcaataaaatcattagaacaatggtttttaaaagacttaagtggatgcatcctatgcatgtaagcattatttcccaaaccaaagcatcattcatctccatttatttcttttgttcccgctcagtgtgaagttgggaactgagaggggatggctgctggtttcacagaagtttggatgccttactcttatcttaaagccagcatccagaatttcctccctctctgatgccacatgcaaaaccaggtgtacgatgtcaagatggattctttgagagccagggtagatcatatgactgcctttctgtaaaattggatgcctagtacaaatgctctttgcctctaattcagtattccatttaataaaaacaatacagtggctggaaaggagcatcagaaa

SEQ ID NO: 20647 - DNA, 1366 bp, Homo sapiens
  ENST00000457375
aggagggcacgtcggcgcctcggcgaggatgggagtccccaggacccggagctgagcagcctggcgcgcggcgggcagggcgcgcaggacagaagcctcgctgttcctccgggagcccaacaccgttcccgcgcggccacgatgatccctccgagcagcccccgcgaggacggcgtggacgggctgcccaaggaggcggtgggcgccgagcaaccgccctctcctgcatccaccagcagccaggaatccaagctccagaaactaaaacgatcactttctttcaagaccaagagtttacggagcaaaagtgctgacaacttcttccagcgaaccaacagcgaagacatgaaactgcaagcacacatggtggctgagatcagccccagctccagcccactccctgctccaggaagcctgacgtccacacccgccagggctggtctgcatccaggtggcaaggctcatgcctttcaggaatacatcttcaagaagcccactttctgtgatgtctgcaaccacatgatagtggcctgtggcaataaggtggaccctgtctacgagaccctccgcttcggcacctccctggcccagaggacaaagaagggcagctccggcagtggctctgactcacctcacagaacctctacttcagatcttgtggaggttcctgaggaagccaatgggccaggaggcgggtatgacctaaggaaacgcagcaacagcgtgtttacatatccagaaaatggcactgatgatttcagagatccagcgaagaacataaaccaccagggatctctttccaaagacccattacagatgaacacctatgttgccttgtacaaatttgtaccacaggagaatgaagatttggaaatgaggccaggagacataattactcttttagaggattccaatgaagactggtggaaagggaaaattcaagacagaattggcttctttccagccaactttgttcagagactacaacaaaatgagaagatttttagatgtgttagaaccttcattgggtgtaaggaacaggggcagataacactgaaagagaatcagatctgcgtgagttctgaagaagaacaagatggttttatcagagtcctcagtggaaaaaagaaaggcctcatcccccttgatgtactagaaaacatctgattgctggctcctcctccgtttgcagtaggcaagctctgctgcgatgcctctgcctcatctcacactgcgtcaacccaaaggagctgccgcactgacccagccccccaggaaacagtgagacaagaatcaagtatctgagactgtggagtaatagccacaaaacagagggcccactgcacagcatatccaggctgccaca

SEQ ID NO: 20648 - DNA, 605 bp, Homo sapiens
  ENST00000427486
aggatgggagtccccaggacccggagctgagcagcctggcgcgcggcgggcagggcgcgcaggacagaagcctcgctgttcctccgggagcccaacaccgttcccgcgcggccacgatgatccctccgagcagcccccgcgaggacggcgtggacgggctgcccaaggaggcggtgggcgccgagcaaccgccctctcctgcatccaccagcagccaggaatccaaggaacaaatgctaagcatggactgcgctgcaaagcctgtaagatgagcatccaccacaagtgcacagatggcctggcaccccagcggtgcatgggcaagctgccaaaggggtttcggcgttactacagctcccccttgctcattcatgaacagtttggctgcattaaagaagttatgcccattgcctgtggcaataaggtggaccctgtctacgagaccctccgcttcggcacctccctggcccagaggacaaagaagggcagctccggcagtggctctgactcacctcacagaacctctacttcagatcttgtggaggttcctgaggaagccaatgggccaggaggcgggtatgacctaaggaaacgcagcaacagcg

SEQ ID NO: 20649 - DNA, 827 bp, Homo sapiens
  ENST00000434649
gcgggcagggcgcgcaggacagaagcctcgctgttcctccgggagcccaacaccgttcccgcgcggccacgatgatccctccgagcagcccccgcgaggacggcgtggacgggctgcccaaggaggcggtgggcgccgagcaaccgccctctcctgcatccaccagcagccaggaatccaagaccaagagtttacggagcaaaagtgctgacaacttcttccagcgaaccaacagcgaagacatgaaactgcaagcacacatggtggctgagatcagccccagctccagcccactccctgctccaggaagcctgacgtccacacccgccagggctggtctgcatccaggtggcaaggctcatgcctttcaggaatacatcttcaagaagcccactttctgtgatgtctgcaaccacatgatagtggcctgtggcaataaggtggaccctgtctacgagaccctccgcttcggcacctccctggcccagaggacaaagaagggcagctccggcagtggctctgactcacctcacagaacctctacttcagatcttgtggaggttcctgaggaagccaatgggccaggaggcgggtatgacctaaggaaacgcagcaacagcgtgtttacatatccagaaaatggcactgatgatttcagagatccagcgaagaacataaaccaccagggatctctttccaaagacccattacagatgaacacctatgttgccttgtacaaatttgtaccacaggagaatgaagatttggaaatgaggccaggagacataattactcttttagaggattccaatgaagactggtggaaa

SEQ ID NO: 20650 - DNA, 1230 bp, Homo sapiens
  ENST00000476388
aggacggcgtggacgggctgcccaaggaggcggtgggcgccgagcaaccgccctctcctgcatccaccagcagccaggaatccaagccctatggatgacgtgaactgagtggttcttgacccagaaaaccaaatgaactcttgaggaatcatgtccatcaaaagtttagttggcctgtagtgctgagagcaacacaaatgattctgcacagtgacactgacttgaagatatcttgtatccactccatccatccacgtgcatcttggggaaaaatagaggaggcaagtcatgcattaaattatcaagctccagaaactaaaacgatcactttctttcaagaccaagagtttacggagcaaaagtgctgacaacttcttccagcgaaccaacagcgaagacatgaaactgcaagcacacatggtggctgagatcagccccagctccagcccactccctgctccaggaagcctgacgtccacacccgccagggctggtctgcatccaggtggcaaggctcatgcctttcaggaatacatcttcaagaagcccactttctgtgatgtctgcaaccacatgatagtgggaacaaatgctaagcatggactgcgctgcaaagcctgtaagatgagcatccaccacaagtgcacagatggcctggcaccccagcggtgcatgggcaagctgccaaaggggtttcggcgttactacagctcccccttgctcattcatgaacagtttggctgcattaaagaagttatgcccattgttgcctcctactgcaaactttgtgtctcaagtctttgtaccttggtgagcacagcctcccagtagaggagataaagctgatccctgcaagaacctggaaatcagagaggaataacgaaagaggaaattcaatcaggaagaattcgggagcagagtactagctgcctgtggcaataaggtggaccctgtctacgagaccctccgcttcggcacctccctggcccagaggacaaagaagggcagctccggcagtggctctgactcacctcacagaacctctacttcagatcttgtggaggttcctgaggaagccaatgggccaggaggcgggtatgacctaaggaaacgcagcaacagcgtgtttacatatccagaaaatggcactgatgatttcagagatccagcgaagaacataaaccaccagggatctctttccaaagacccattacagatgaacacctatgt

SEQ ID NO: 20651 - DNA, 476 bp, Homo sapiens
  ENST00000486143
gctgcccaaggaggcggtgggcgccgagcaaccgccctctcctgcatccaccagcagccaggaatccaagctccagaaactaaaacgatcactttctttcaagaccaagagtttacggagcaaaagtgctgacaacttcttccagcgaaccaacagcgaagacatgaaactgcaagcacacatggtggctgagatcagccccagctccagcccactccctgctccaggaagcctgacgtccacacccgccagggctggtctgcatccaggtggcaaggctcatgcctttcaggaatacatcttcaagaagcccactttctgtgatgtctgcaaccacatgatagtggatgcttcatatatacagattatcctggtaaataattggggatacacataaaaacacctgaaccaaagcatatacaaagtactagggaaagccacaagtggaaacaatagttctacctcaggaggaagag

SEQ ID NO: 20652 - DNA, 715 bp, Homo sapiens
  ENST00000473452
ccgcttcggcacctccctggcccagaggacaaagaagggcagctccggcagtggctctgactcacctcacagaacctctacttcagatcttgtggaggttcctgaggaagccaatgggccaggaggcgggtatgacctaaggaaacgcagcaacagcgtgtttacatatccagaaaatggcactgatgatttcagagatccagcgaagaacataaaccaccagggatctctttccaaagacccattacagatgaacacctatgttgccttgtacaaatttgtaccacaggagaatgaagatttggaaatgaggtaaaaaccttctgtaaagaaaaaaaagagtaaaattttaaagtcagtatttctccatgtgaaaaagtaagtccatctgtgcccctcctaatgctttatagctgtgattctcaaactttagcatgtatctaatgacctgcaaggctggttaacacacaggccctgtccccagagtttttgattcatcagatctgaggcagggcctcagaagttgcattcctaaggagttcccaggtggcactgacaatgctgtccaaggaacacactttgggaagcaccactttagtacatgctcaacagaactgctaatgggagttttcatgaaggttgaacgttaaatgcacttggcatctggtggggcctaatagggaatcaaaaaatatatttaatcaaatatcagata

SEQ ID NO: 20653 - DNA, 431 bp, Homo sapiens
  ENST00000465064
attactcttttagaggattccaatgaagactggtggaaagggaaaattcaagacagaattggcttctttccagccaactttgttcagagactacaacaaaatgagaagatttttagatgtgttagaaccttcattgggtgtaaggaacaggggcagataacactgaaagagaatcaggtgagtaaaccacacaaacacattccagatatgagccaaatagggtgtcattttaataaacttaataatatgtataaatctgaatgagtggggtcacattcaaagtattcactttgagaaaagatatacttactccaatgatgtcagtgttgtaggagctaaacatgcaaactaaaattttaggaatctcacttggtgatacctgttcataaacgaaacgtgatagtggcaggcgacgacatctcgtcccccat

SEQ ID NO: 20654 - DNA, 3362 bp, Homo sapiens
  ENST00000333461
atggggggcgggcgcagcggacggcggagccggctggacacggacagctccttggctccctccctcggctcatccccgcggccccacttccctcctccccgcgctgcgagcagcatcctctgcagaccctcggtcctcgcgcccggggtcgtcccgctcctgcggctcagcgtggtggcctcccctcgcccgccaccccggcaactttctctgcccgctcccgcgggttgggggctgccgtgccgggggctaactgggggcagcctctggagaacggcttcagagtcccggagacgcccgccacccgcagcctgcccgcggtgggcctgccgtcggatctcggcaccctctcctcccctctccccgaaccatgaccgagatgagcgagaaggagaacgaaccggatgacgcggccacccacagccccccagggaccgtctccgccctccaggaaaccaagctccagcgattcaagcgctccctctccctcaagaccatcctccgaagtaagagcttggagaacttcttccttcgctcgggctctgagctcaagtgccccaccgaggtgctgctgacgcccccaaccccactgccccctccctccccaccacccacagcctcggacaggggcctggctaccccatccccctccccatgcccagtcccacgccccctggcagcgctcaaaccagtgaggctgcacagcttccaggaacatgtcttcaagcgagctagcccttgtgagctgtgccaccagctcatcgtaggaaactccaaacagggcttgcgatgtaagatgtgcaaagtcagcgtccacctctggtgctctgaggagatctcccaccagcaatgcccaggcaagacgtccacctccttccgccgcaacttcagttcccctctcctggtgcatgagccgccaccagtctgtgccacaagcaaagagtccccacccactggggacagtgggaaggtggaccctgtctacgagaccctgcgctatggcacctccctggcactgatgaaccgctccagtttcagcagcacctctgagtccccgacaaggagcctgagtgagcgggatgagctgaccgaggatggggaaggcagcatccgcagctctgaggaggggcctggtgacagtgcatctccagtattcacagccccagcagagagtgaagggccaggaccagaggagaagagtcctggacagcagctccccaaagccaccctgcggaaggatgtggggcccatgtactcctacgttgcactctacaagtttctgccccaggagaacaatgatctggctctgcagcctggagatcggatcatgctggtggatgactctaacgaggactggtggaagggcaagatcggcgaccgggttggcttcttcccagctaattttgtgcaacgggtgaggccaggcgagaatgtttggcgctgctgccaacccttctccgggaacaaggaacagggttacatgagcctcaaggagaaccagatctgcgtgggcgtgggcagaagcaaggatgctgacggcttcatccgcgtcagcagtggcaagaagcggggcctggtgccagtcgacgccctgactgagatctgagaggagccaagggaacccagatgacacccttgcccatgcctggaccttgcttctggccagggaggggatcaggcccccttgtccactccatacccttcctccctctgtccctctcctaggtgccacttaccgtggcttaggagccttttgtactggggaagattttatttcttgggtggggtgccctgagtgggttgatcctctgggacttggcggggatggggtggggtgggagggaatgaggaagctacaggtaggtccacccaacgcccaggcaccccagtctacttgctgggctgagtccagccctggggaagattcctggggaatttatttgctgcttctcccagccttcccctgcccacaccacctgcgcatgcctggcacacccctctccccacagagcctctgcttgggtctatgtgtgtgtgaccgtgcatctgctcctttgcaagtggggtcttgggagcaggcctttttgtgtcctcggccctccacccttggtggggaggggacccaggaccataggaaggtcctgagtccacctcctggtctccacctctgtcattccgtcaattctcaggaaagttttgcaggaatctctcccgttacttgaaacctgggcggacagatgaggggaaggctgaggtccctggaaggtgtaacaaatcagagactatctgttcaagtagaaaacccaagagctggccaggtgtggtggctcatgcctgtaatcccagcactttgggaggctgaggtgggcagatcacctgaggtcaggagttcaagaccagcctggccaacatggtgaaaccccgtctctactaaaagtacgaaacttagccaggcatgatgggggtctgcctgtaatgccagctactccagaggctgaggcaagagaatcacttgaacccgggaggcggaggtttcagtgagccgagattgcaccattgcaccccagcctgggcaacagagcgagactccgtctcaaaaaaaaaaaaagaaagaaagaaaaggaaacccaagagctgcctggacacacggaaacccaactgagaacaaaatcctggcccgtgcttggtcaaagcaaacccatttcactgtcaggacccccggtcacacaggaaccacccgccaggggagcctgtgactgtcagttcctgtcccaggctttgcccggccgccccaggaacccaaccctctgggctgacctttctcctgcttctctccaggctctgcaggggacagggcaggtgctgcaggagcccctttgctggctttatctgctcccttgttctggacacagagccctgggaaaaagagggggtggaagacagacaaggaaggtggaatgttctgttttggccaccaggaaatggggtggggtgggcatacacagagaggacccctctcttaatacagctgcttttctcggtgccaacctccctcccccaagctcagatcctcctcttatgcccttgattgtgccagcccatgccacccccatcctgggcacagttacaccctcccatgcagtgggagaaacacagaccctcgtacccaaaggcccctgccccacttctcccccacaaagcggggtctcaagccacactgccctgtttgctgccatgaggcccccccccccagcaatatcccaggggcgggcccaatgcccactgtacatgaggctgcatgatgggtctggggccttgctgattccccagacccctaattaaatgtttcttgtcccagccca

SEQ ID NO: 20655 - DNA, 2251 bp, Homo sapiens
  ENST00000584501
ctttctctgcccgctcccgcgggttgggggctgccgtgccgggggctaactgggggcagcctctggagaacggcttcagagtcccggagacgcccgccacccgcagcctgcccgcggtgggcctgccgtcggatctcggcaccctctcctcccctctccccgaaccatgaccgagatgagcgagaaggagaacgaaccggatgacgcggccacccacagccccccagggaccgtctccgccctccaggaaaccaagctccagcgattcaagcgctccctctccctcaagaccatcctccgaagtaagagcttggagaacttcttccttcgctcgggctctgagctcaagtgccccaccgaggaaactccaaacagggcttgcgatgtaagatgtgcaaagtcagcgtccacctctggtgctctgaggagatctcccaccagcaatgcccaggcaagacgtccacctccttccgccgcaacttcagttcccctctcctggtgcatgagccgccaccagtctgtgccacaagcaaagagtccccacccactggggacagtgggaaggtggaccctgtctacgagaccctgcgctatggcacctccctggcactgatgaaccgctccagtttcagcagcacctctgagtccccgacaaggagcctgagtgagcgggatgagctgaccgaggatggggaaggcagcatccgcagctctgaggaggggcctggtgacagtgcatctccagtattcacagccccagcagagagtgaagggccaggaccagaggagaagagtcctggacagcagctccccaaagccaccctgcggaaggatgtggggcccatgtactcctacgttgcactctacaagtttctgccccaggagaacaatgatctggctctgcagcctggagatcggatcatgctggtggatgactctaacgaggactggtggaagggcaagatcggcgaccgggttggcttcttcccagctaattttgtgcaacgggtgaggccaggcgagaatgtttggcgctgctgccaacccttctccgggaacaaggaacagggttacatgagcctcaaggagaaccagatctgcgtgggcgtgggcagaagcaaggatgctgacggcttcatccgcgtcagcagtggcaagaagcggggcctggtgccagtcgacgccctgactgagatctgagaggagccaagggaacccagatgacacccttgcccatgcctggaccttgcttctggccagggaggggatcaggcccccttgtccactccatacccttcctccctctgtccctctcctaggtgccacttaccgtggcttaggagccttttgtactggggaagattttatttcttgggtggggtgccctgagtgggttgatcctctgggacttggcggggatggggtggggtgggagggaatgaggaagctacaggtaggtccacccaacgcccaggcaccccagtctacttgctgggctgagtccagccctggggaagattcctggggaatttatttgctgcttctcccagccttcccctgcccacaccacctgcgcatgcctggcacacccctctccccacagagcctctgcttgggtctatgtgtgtgtgaccgtgcatctgctcctttgcaagtggggtcttgggagcaggcctttttgtgtcctcggccctccacccttggtggggaggggacccaggaccataggaaggtcctgagtccacctcctggtctccacctctgtcattccgtcaattctcaggaaagttttgcaggaatctctcccgttacttgaaacctgggcggacagatgaggggaaggctgaggtccctggaaggtgtaacaaatcagagactatctgttcaagtagaaaacccaagagctggccaggtgtggtggctcatgcctgtaatcccagcactttgggaggctgaggtgggcagatcacctgaggtcaggagttcaagaccagcctggccaacatggtgaaaccccgtctctactaaaagtacgaaacttagccaggcatgatgggggtctgcctgtaatgccagctactccagaggctgaggcaagagaatcacttgaacccgggaggcggaggtttcagtgagccgagattgcaccattgcaccccagcctgggcaacagagcgagactccgtctcaaaaaaaaaaaaagaaagaaagaaaaggaaacccaagagctgcctggacacacggaaaccca

SEQ ID NO: 20656 - DNA, 4450 bp, Homo sapiens
  ENST00000426455
gtggcgatccggctcaaaaggcggggcctgggtggaacctagcctatggcaattgagaagccagattaaaggggttactagcagtctggtccaaaacccgcccaatggagtaggagattgagggtagcgggggtgggacctgggtgggggcggggctaaagcgggccgcccgcgtgcccaagcccacgtgagagggcaggacgcctgagagcttgaggccacacgaggctgtggagcggcgtgactcaaacgtggcgcgcatcagctcgcacacttccaaacctcgcgatagctactggccctgggcgagccgttgggattgcgcttgcgcacagcgtgtcttctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcagtctttggtagatgagtggctggatagctacaagcaagaccaggatgcaggatttctggagcttgttaactttttcatccaatcttgcggatgtaaaggcattgtgacccctgagatgttcaagaagatgtccaactcagagatcatccagcacctaacagagcagtttaatgaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctggtaaaagttgccctccaactgagtgtgcaccaagataacaatcagcgtcagtatgaggctgaaagaaacaaggggccagggcagagggcacctgagcggctggagagcctgttggagaaacgcaaagagctccaagagcatcaagaggagattgaggggatgatgaatgccctcttcaggggtgtctttgttcatcggtacagggatgtccttcctgagatccgtgctatctgcattgaggaaattgggtgttggatgcaaagctacagcacgtctttcctcaccgacagctatttaaaatatattggttggactctgcatgataagcaccgagaagtccgcctgaagtgtgtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaaggggtgctgacggacgcggattgtgagagcgtctacccagttgtgtatgcctctcatcgaggcctggcctctgccgcaggcgaatttctgtactggaaactcttctaccctgagtgcgagataagaatgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagaacctgggtgatgtgcaggagagcacactgatagaaatccttgtgtccagtgcccggcaagcttcagaggggcacccgcctgtgggccgggtcactgggaggaagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacagtcgtccttcctagatgaggatgaggtatataatctggcagccactctgaaacgcctctctgccttctacaacactcatgacctgactcgctgggagctctatgagccatgttgccaactcctgcagaaggctgtggacacaggagaggttcctcaccaggttatcctgccagccttgactcttgtctatttttccattctctggacactaacccacatttctaaatcagatgcttcccagaagcagctgtcgagtttgagggacagaatggtggccttctgtgaactctgccagagttgcctctcagatgtggatactgagatccaggagcaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgattcccaggaggatcatttacagatagagcggctacaccagcggcgccgcctcctagccgggttctgcaagctgttgctttatggggtgctggagatggatgcagcctcagatgttttcaaacactacaacaagttctacaatgactatggtgacattatcaaggaaacattaactagagcaaggcagattgaccgaagtcattgttcccgaatcctgctgctgagcctcaagcagctgtacacagaactgctgcaggagcatgggccccagggcctgaatgagcttcctgccttcatcgagatgagggacctggcccggaggtttgccttgagttttggaccccagcagctgcagaaccgtgacctcgtggtcatgctacacaaggaaggcatccagttctccttgtctgagcttcctccagctggctcctccaatcagcctccaaatctggcattcctggagctcctttcagagttttccccccgactcttccatcaggacaagcagcttttactgtcctatctagaaaagtgcctgcagcatgtctcccaggcacctggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctgacaggactctgggcccctccccagctccactccctacctcaagaatgtgaccatttggaaaaggcaaagagaaaaggagcaaaatgaagcattcccccaggcttcagccctgggctctgaggggaaagagttgggcattgtttttctaacctaacctttccctctggggtagagaagccgagagaccctgtcctccctaatgcactgtggcccagtccccttgcctttttcctgttctgtttggagtggagaagggcagcacctctgtgtttaatggaaatagcccatagtctcctggatttttggaacatctttctcagcctattttgtgtcctaatgattcgctcaataaacatgtttgaatcc

SEQ ID NO: 20657 - DNA, 4163 bp, Homo sapiens
  ENST00000394018
agcccacgtgagagggcaggacgcctgagagcttgaggccacacgaggctgtggagcggcgtgactcaaacgtggcgcgcatcagctcgcacacttccaaacctcgcgatagctactggccctgggcgagccgttgggattgcgcttgcgcacagcgtgtcttgtacgttcccgcgcttttctggaatctttcgcccccggaagggcagcggcgggcgcctgtgtggaagctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctggtaaaagttgccctccaactgagtgtgcaccaagataacaatcagcgtcagtatgaggctgaaagaaacaaggggccagggcagagggcacctgagcggctggagagcctgttggagaaacgcaaagagctccaagagcatcaagaggagattgaggggatgatgaatgccctcttcaggggtgtctttgttcatcggtacagggatgtccttcctgagatccgtgctatctgcattgaggaaattgggtgttggatgcaaagctacagcacgtctttcctcaccgacagctatttaaaatatattggttggactctgcatgataagcaccgagaagtccgcctgaagtgtgtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaaggggtgctgacggacgcggattgtgagagcgtctacccagttgtgtatgcctctcatcgaggcctggcctctgccgcaggcgaatttctgtactggaaactcttctaccctgagtgcgagataagaatgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagaacctgggtgatgtgcaggagagcacactgatagaaatccttgtgtccagtgcccggcaagcttcagaggggcacccgcctgtgggccgggtcactgggaggaagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacagtcgtccttcctagatgaggatgaggtatataatctggcagccactctgaaacgcctctctgccttctacaacactcatgacctgactcgctgggagctctatgagccatgttgccaactcctgcagaaggctgtggacacaggagaggttcctcaccaggttatcctgccagccttgactcttgtctatttttccattctctggacactaacccacatttctaaatcagatgcttcccagaagcagctgtcgagtttgagggacagaatggtggccttctgtgaactctgccagagttgcctctcagatgtggatactgagatccaggagcaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgattcccaggaggatcatttacagatagagcggctacaccagcggcgccgcctcctagccgggttctgcaagctgttgctttatggggtgctggagatggatgcagcctcagatgttttcaaacactacaacaagttctacaatgactatggtgacattatcaaggaaacattaactagagcaaggcagattgaccgaagtcattgttcccgaatcctgctgctgagcctcaagcagctgtacacagaactgctgcaggagcatgggccccagggcctgaatgagcttcctgccttcatcgagatgagggacctggcccggaggtttgccttgagttttggaccccagcagctgcagaaccgtgacctcgtggtcatgctacacaaggaaggcatccagttctccttgtctgagcttcctccagctggctcctccaatcagcctccaaatctggcattcctggagctcctttcagagttttccccccgactcttccatcaggacaagcagcttttactgtcctatctagaaaagtgcctgcagcatgtctcccaggcacctggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctgacaggactctgggcccctccccagctccactccctacctcaagaatgtgaccatttggaaaaggcaaagagaaaaggagcaaaatgaagcattcccccaggcttcagccctgggctctgaggggaaagagttgggcattgtttttctaacctaacctttccctctggggtagagaagccgagagaccctgtcctccctaatgcactgtggcccagtccccttgcctttttcctgttctgtttggagtggagaagggcagcacctctgtgtttaatggaaatagcccatagtctcctggatttttggaacatctttctcagcctattttgtgtcctaatgattcgctcaataaacatgtttgaatcc

SEQ ID NO: 20658 - DNA, 605 bp, Homo sapiens
  ENST00000416412
gggcgagccgttgggattgcgcttgcgcacagcgtgtcttgtacgttcccgcgcttttctggaatctttcgcccccggaagggcagcggcgggcgcctgtgtggaagctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcagtctttggtagatgagtggctggatagctacaagcaagaccaggatgcaggatttctggagcttgttaactttttcatccaatcttgcggatgtaaagg

SEQ ID NO: 20659 - DNA, 4198 bp, Homo sapiens
  ENST00000317296
gcgcttttctggaatctttcgcccccggaagggcagcggcgggcgcctgtgtggaaggtggggtggccagagacacccgagggacctgagctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcagtctttggtagatgagtggctggatagctacaagcaagaccaggatgcaggatttctggagcttgttaactttttcatccaatcttgcggatgtaaaggcattgtgacccctgagatgttcaagaagatgtccaactcagagatcatccagcacctaacagagcagtttaatgaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctggtaaaagttgccctccaactgagtgtgcaccaagataacaatcagcgtcagtatgaggctgaaagaaacaaggggccagggcagagggcacctgagcggctggagagcctgttggagaaacgcaaagagctccaagagcatcaagaggagattgaggggatgatgaatgccctcttcaggggtgtctttgttcatcggtacagggatgtccttcctgagatccgtgctatctgcattgaggaaattgggtgttggatgcaaagctacagcacgtctttcctcaccgacagctatttaaaatatattggttggactctgcatgataagcaccgagaagtccgcctgaagtgtgtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaaggggtgctgacggacgcggattgtgagagcgtctacccagttgtgtatgcctctcatcgaggcctggcctctgccgcaggcgaatttctgtactggaaactcttctaccctgagtgcgagataagaatgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagaacctgggtgatgtgcaggagagcacactgatagaaatccttgtgtccagtgcccggcaagcttcagaggggcacccgcctgtgggccgggtcactgggaggaagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacagtcgtccttcctagatgaggatgaggtatataatctggcagccactctgaaacgcctctctgccttctacaacactcatgacctgactcgctgggagctctatgagccatgttgccaactcctgcagaaggctgtggacacaggagaggttcctcaccaggttatcctgccagccttgactcttgtctatttttccattctctggacactaacccacatttctaaatcagatgcttcccagaagcagctgtcgagtttgagggacagaatggtggccttctgtgaactctgccagagttgcctctcagatgtggatactgagatccaggagcaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgattcccaggaggatcatttacagatagagcggctacaccagcggcgccgcctcctagccgggttctgcaagctgttgctttatggggtgctggagatggatgcagcctcagatgttttcaaacactacaacaagttctacaatgactatggtgacattatcaaggaaacattaactagagcaaggcagattgaccgaagtcattgttcccgaatcctgctgctgagcctcaagcagctgtacacagaactgctgcaggagcatgggccccagggcctgaatgagcttcctgccttcatcgagatgagggacctggcccggaggtttgccttgagttttggaccccagcagctgcagaaccgtgacctcgtggtcatgctacacaaggaaggcatccagttctccttgtctgagcttcctccagctggctcctccaatcagcctccaaatctggcattcctggagctcctttcagagttttccccccgactcttccatcaggacaagcagcttttactgtcctatctagaaaagtgcctgcagcatgtctcccaggcacctggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctgacaggactctgggcccctccccagctccactccctacctcaagaatgtgaccatttggaaaaggcaaagagaaaaggagcaaaatgaagcattcccccaggcttcagccctgggctctgaggggaaagagttgggcattgtttttctaacctaacctttccctctggggtagagaagccgagagaccctgtcctccctaatgcactgtggcccagtccccttgcctttttcctgttctgtttggagtggagaagggcagcacctctgtgtttaatggaaatagcccatagtctcctggatttttggaacatctttctcagcctattttgtgtcctaatgattcgctcaataaacatgtttgaatcca

SEQ ID NO: 20660 - DNA, 534 bp, Homo sapiens
  ENST00000422690
atctttcgcccccggaagggcagcggcgggcgcctgtgtggaaggtggggtggccagagacacccgagggacctgaggtggggaccttccctgaaccctgctcggccagaagtcactcttccaggctctgacagctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcag

SEQ ID NO: 20661 - DNA, 3585 bp, Homo sapiens
  ENST00000496157
cgcccccggaagggcagcggcgggcgcctgtgtggaaggtggggtggccagagacacccgagggacctgagctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcagtctttggtagatgagtggctggatagctacaagcaagaccaggatgcaggatttctggagcttgttaactttttcatccaatcttgcggatgtaaaggcattgtgacccctgagatgttcaagaagatgtccaactcagagatcatccagcacctaacagagcagtttaatgaggtggaagaagatgaccaggatcctcttacccctcttatttcaaaacacaatgcctattatccccttctttttgattctgtgaaatagggtagcttttagaaggaggaattcagtctcttgggggtaaaagagatctgaatatgcctctcaaattggggagaataccaggaaatgaggtataacagatatttttactggactgttgagttttgacatccaagcccctatgacttcatggacctggtaataactttcccatccttttcatacatccttttgtaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctggtaaaagttgccctccaactgagtgtgcaccaagataacaatcagcgtcagtatgaggctgaaagaaacaaggggccagggcagagggcacctgagcggctggagagcctgttggagaaacgcaaagagctccaagagcatcaagaggagattgaggggatgatgaatgccctcttcaggggtgtctttgttcatcggtacagggatgtccttcctgagatccgtgctatctgcattgaggaaattgggtgttggatgcaaagctacagcacgtctttcctcaccgacagctatttaaaatatattggttggactctgcatgataagcaccgagaagtccgcctgaagtgtgtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaaggggtgctgacggacgcggattgtgagagcgtctacccagttgtgtatgcctctcatcgaggcctggcctctgccgcaggcgaatttctgtactggaaactcttctaccctgagtgcgagataagaatgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagaacctgggtgatgtgcaggagagcacactgatagaaatccttgtgtccagtgcccggcaagcttcagaggggcacccgcctgtgggccgggtcactgggaggaagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacagtcgtccttcctagatgaggatgaggtatataatctggcagccactctgaaacgcctctctgccttctacaacactcatgacctgactcgctgggagctctatgagccatgttgccaactcctgcagaaggctgtggacacaggagaggttcctcaccaggttatcctgccagccttgactcttgtctatttttccattctctggacactaacccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggcagtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctgacaggactctgggcccctccccagctccactccctacctcaagaatgtgaccatttggaaaaggcaaagagaaaaggagcaaaatgaagcattcccccaggcttcagccctgggctctgaggggaaagagttgggcattgtttttctaacctaacctttccctctggggtagagaagccgagagaccctgtcctccctaatgcactgtggcccagtccccttgcctttttcctgttctgtttggagtggagaagggcagcacctctgtgtttaatggaaatagcccatagtctcctggatttttggaacatctttctcagcctattttgtgtcctaatgattcgctcaataaacatgtttgaatccacacgtt

SEQ ID NO: 20662 - DNA, 699 bp, Homo sapiens
  ENST00000439782
gcccccggaagggcagcggcgggcgcctgtgtggaaggtggggtggccagagacacccgagggacctgagctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctgg

SEQ ID NO: 20663 - DNA, 472 bp, Homo sapiens
  ENST00000482546
cccccggaagggcagcggcgggcgcctgtgtggaaggtggggtggccagagacacccgagggacctgagctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggtaagtagatgttgcattgtgtggccacttcctgtgtccctggcagccttccccctcgttttcccacattgatgataatatgcgtgggactgtgtgaaaacaccagaagtgctatactcgttcagcacagtgacaccctccctccagctccaggtgttttttttggcggtcctagatgttgtagacatcaaaatagtagtacatcctgttttttttttttttt

SEQ ID NO: 20664 - DNA, 535 bp, Homo sapiens
  ENST00000459699
aaagttataaacttgaattgataagacatgtggtttatgtttcaagggggtgaaatttaactctagatacatattactctcccatttatggatgaatgatagatgacttcctgagccatgattatctttctctacaaagagcagtgatctcgctacctgctaagaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcagctatgaaactgatgacctccctggtaaaagttgccctccaactgagtgtgcaccaagataacaatcagcgtcagtatgaggctgaaagaaacaaggggccagggcagagggcacctgagcggctggagagcctgttggagaaacgcaaagag

SEQ ID NO: 20665 - DNA, 3031 bp, Homo sapiens
  ENST00000491498
ggataaggtagagagagacatacccaggagatgaaatgactcaaaacctgagcaccgagaagtccgcctgaagtgtgtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaaggggtgctgacggacgcggattgtgagagcgtctacccagttgtgtatgcctctcatcgaggcctggcctctgccgcaggcgaatttctgtactggaaactcttctaccctgagtgcgagataagaatgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagaacctgggtgatgtgcaggagagcacactgatagaaatccttgtgtccagtgcccggcaagcttcagaggggcacccgcctgtgggccgggtcactgggaggaagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacagtcgtccttcctagatgaggatgaggtatataatctggcagccactctgaaacgcctctctgccttctacaacactcatgacctgactcgctgggagctctatgagccatgttgccaactcctgcagaaggctgtggacacaggagaggttcctcaccaggttatcctgccagccttgactcttgtctatttttccattctctggacactaacccacatttctaaatcagatgcttcccagaagcagctgtcgagtttgagggacagaatggtggccttctgtgaactctgccagagttgcctctcagatgtggatactgagatccaggagcaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgattcccaggaggatcatttacagatagagcggctacaccagcggcgccgcctcctagccgggttctgcaagctgttgctttatggggtgctggagatggatgcagcctcagatgttttcaaacactacaacaagttctacaatgactatggtgacattatcaaggaaacattaactagagcaaggcagattgaccgaagtcattgttcccgaatcctgctgctgagcctcaagcagctgtacacagaactgctgcaggagcatgggccccagggcctgaatgagcttcctgccttcatcgagatgagggacctggcccggaggtttgccttgagttttggaccccagcagctgcagaaccgtgacctcgtggtcatgctacacaaggaaggcatccagttctccttgtctgagcttcctccagctggctcctccaatcagcctccaaatctggcattcctggagctcctttcagagttttccccccgactcttccatcaggacaagcagcttttactgtcctatctagaaaagtgcctgcagcatgtctcccaggcacctggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctgacaggactctgggcccctccccagctccactccctacctcaagaatgtgaccatttggaaaaggcaaagagaaaaggagcaaaatgaagcattcccccaggcttcagccctgggctctgaggggaaagagttgggcattgtttttctaacctaacctttccctctggggtagagaagccgagagaccctgtcctccctaatgcactgtggcccagtccccttgcctttttcctgttctgtttggagtggagaagggcagcacctctgtgtttaatggaaatagcccatagtctcctggatttttggaacatctttctcagcctattttgtgtcctaatgattcgctcaataaacatgtttgaatcca

SEQ ID NO: 20666 - DNA, 3121 bp, Homo sapiens
  ENST00000440830
gaaatgactcaaaacctgaggtacggggagagagactttcccatggaagagagttattgatggatggtaatgcaggtgctaaggggcagccaaaggatccttctcatcatgagtactgctgtgatccttttgttttttaacaccgagaagtccgcctgaagtgtgtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaaggggtgctgacggacgcggattgtgagagcgtctacccagttgtgtatgcctctcatcgaggcctggcctctgccgcaggcgaatttctgtactggaaactcttctaccctgagtgcgagataagaatgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagaacctgggtgatgtgcaggagagcacactgatagaaatccttgtgtccagtgcccggcaagcttcagaggggcacccgcctgtgggccgggtcactgggaggaagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacagtcgtccttcctagatgaggatgaggtatataatctggcagccactctgaaacgcctctctgccttctacaacactcatgacctgactcgctgggagctctatgagccatgttgccaactcctgcagaaggctgtggacacaggagaggttcctcaccaggttatcctgccagccttgactcttgtctatttttccattctctggacactaacccacatttctaaatcagatgcttcccagaagcagctgtcgagtttgagggacagaatggtggccttctgtgaactctgccagagttgcctctcagatgtggatactgagatccaggagcaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgattcccaggaggatcatttacagatagagcggctacaccagcggcgccgcctcctagccgggttctgcaagctgttgctttatggggtgctggagatggatgcagcctcagatgttttcaaacactacaacaagttctacaatgactatggtgacattatcaaggaaacattaactagagcaaggcagattgaccgaagtcattgttcccgaatcctgctgctgagcctcaagcagctgtacacagaactgctgcaggagcatgggccccagggcctgaatgagcttcctgccttcatcgagatgagggacctggcccggaggtttgccttgagttttggaccccagcagctgcagaaccgtgacctcgtggtcatgctacacaaggaaggcatccagttctccttgtctgagcttcctccagctggctcctccaatcagcctccaaatctggcattcctggagctcctttcagagttttccccccgactcttccatcaggacaagcagcttttactgtcctatctagaaaagtgcctgcagcatgtctcccaggcacctggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctgacaggactctgggcccctccccagctccactccctacctcaagaatgtgaccatttggaaaaggcaaagagaaaaggagcaaaatgaagcattcccccaggcttcagccctgggctctgaggggaaagagttgggcattgtttttctaacctaacctttccctctggggtagagaagccgagagaccctgtcctccctaatgcactgtggcccagtccccttgcctttttcctgttctgtttggagtggagaagggcagcacctctgtgtttaatggaaatagcccatagtctcctggatttttggaacatctttctcagcctattttgtgtcctaatgattcgctcaataaacatgtttgaatccaca

SEQ ID NO: 20667 - DNA, 719 bp, Homo sapiens
  ENST00000477469
gtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaaggggtgctgacggacgcggattgtgagagcgtctacccagttgtgtatgcctctcatcgaggcctggcctctgccgcaggcgaatttctgtactggaaactcttctaccctgagtgcgagataagaatgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagagtacgtgtcacacggagccagggacagggaccttccaccccctagggtgaaactgggagggattgcttgcttcacttgtacaaggcagcaacggtggcatcgggtggggggagcttggagttggaaggtggctaatctttgattctatgtttttgatcctcctggcactccagacctgggtgatgtgcaggagagcacactgatagaaatccttgtgtccagtgcccggcaagct

SEQ ID NO: 20668 - DNA, 583 bp, Homo sapiens
  ENST00000476057
cttctaggcagataaggtcatggggaggaggactgcacacaccccctgcaccagtgtttctttacacctcccccacccccaagtgactctcattccagggcttaacctctaaggagcgcaagacccaagccgatgacagggtgaagttgactgagcacctcatccccctgctgccccagctcctggccaaggtaccgctgcccctccactctgcatcacaccaagagaagtgaaaggaaatggcctctgtgggggtgggagtaggaattagcaatgtgtcagcttgtaaggaggcctccctgtcaatcatcacagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagc

SEQ ID NO: 20669 - DNA, 780 bp, Homo sapiens
  ENST00000479359
agataaggtcatggggaggaggactgcacacaccccctgcaccagtgtttctttacacctcccccacccccaagtgactctcattccagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacagtcgtccttcctagatgaggatgaggtatataatctggcagccactctgaaacgcctctctgccttctacaacactcatgacctgactcgctgggagctctatgagccatgttgccaactcctgcagaaggctgtggacacaggagaggttcctcaccaggttatcctgccagccttgactcttgtctatttttccattctctggacactaacccacatttctaaatcagatgcttcccagaagcagctgtcgagtttgagggacagaatggtggccttctgtgaactctgccagagttgcctctcag

SEQ ID NO: 20670 - DNA, 920 bp, Homo sapiens
  ENST00000412190
ggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggcagtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctgacaggactctgggcccctccccagctccactccctacctcaagaatgtgaccatttggaaaaggcaaagagaaaaggagcaaaatgaagcattcccccaggcttcagccctgggctctgaggggaaagagttgggcattgtttttctaacctaacctttccctctggggtagagaagccgagagaccctgtcctccctaatgcactgtggcccagtccccttgcctttttcctgttctgtttggagtggagaagggcagcacctctgtgtttaatggaaatagcccatagtctcctggatttttggaacatctttctcagcctattttgtgtcctaatgattcgctcaataaacatgtttgaatcc

SEQ ID NO: 20671 - DNA, 3056 bp, Homo sapiens
  ENST00000451963
cccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggcagtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgagattactgagagtcttccgttactaggtaagtcaccgcatccttataactccaggtgacactgactggggtttatgggatgaaagaggagtgtgtgcttggatgatggggtgtgatagtgaaggggtgaaaggtttcttctcacacatagacatcgtgaggtcttccttgagctctttagagccttccctcgggataggatgaaatactgagatcctagaaaggattcacaaaacgtgtcactcatcagcgcagattcaccgattcacccctagatgtgtgtgggatttggatggcagagagaaacaggcactgaagatttttggtcaggacagggcagagaaataagaagagttgaaaattcaccaaaggatagataaacccagggcgtttagagaaaacctgtagtgtgcaaaggagcccagaatcctggggcaacttggagggaaatatacttaatttgattcactaagttaggcccagtgaagggattgggtggcataggtagaagccgaaaaataaagtatcttgtattgctggagtagcctctgtttctgaggtcacatccaaacttagcgaggcagcttaacctggtgagagacatgggttcaactcctggcttctgcactgctagggcagaggactgctgtttgctgacacaatcttggtgcgttggaagtgaaagggaagaggcactggtggctgtgctttgggcccgagcagccagaagccagttgccatcacctatgacgaggagacagcgcctggggcagagcccagtatggggtgcgttcagggtagatcaggaggtatgagtgggtagtgggcgagccaggctgggggttgtgggggaggcctgcattgcaggtgtaagcgtgggacccacatcagattggtagtgggtcatgcatgctgggctggctctcaggtcctccctgctggcttcccactcccaggggctttctcctccgattccttagctgggtgaggggcgggacagagccctttcttagggaagcccggcaccccttgctgtccagggaaggggagtccttctagcccctgacagcttctctgcccctcccctggcctccccaggcctagccagggctgggttctcacccacctgtgccgccctgccttgttacctggaagcacagccttggggactgagcaggccctcactgtcactttaagaagggaatcagccactttgtgctcaccacctctggggaaggtgtgagaggagagaaggaagtggctgtttggctgctgacaacatgaagacttcctgcgatgagaacagaggcacaggtgccggccctgcagcccccagaacctggactggagggggccatggggcaccggaccctggtcctgccctgggtgctgctgaccttgtgtgtcactgcggggaccccggaggtgtgggttcaagttcggatggaggccaccgagctctcgtccttcaccatccgttgtgggttcctggggtctggctccatctccctggtgactgtgagctgggggggccccaacggtgctggggggaccacgctggctgtgttgcacccagaacgtggcatccggcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccaggtggggccggggcgaggggtccaggagggcagggaggggctcgggaactggccacccatctgattcttgtctccgtgcccagggctctctgccccgccgactcctgcccccattctgcgggcagacctggccgggatcttgggggtctcaggagtcctcctctttggctgtgtctacctccttcatctgctgcgccgacataagcaccgccctgcccctaggctccagccgtcccgcaccagcccccaggcaccgagagcacgagcatgggcaccaagccaggcctcccaggctgctcttcacgtcccttatgccactatcaacaccagctgccgcccagctactttggacacagctcacccccatggggggccgtcctggtgggcgtcactccccacccacgctgcacaccggccccagggccctgccgcctgggcctccacacccatccctgcacgtggcagctttgtctctgttgagaatggactctacgctcaggcaggggagaggcctcctcacactggtcccggcctcactcttttccctgaccctcgggggcccagggccatggaaggacccttaggagttcgatgagagagaccatgaggccactgggctttccccctcccaggcctcctgggtgtcacccccttactttaattcttgggcctccaataagtgtcccataggtgtctggccaggcccacctgctgcggatgtggtctctgtgtgtgcgtgtgtgggcacaggtgtgagtgtgtgagtgacagttaccccatttcagtcatttcctgctgcaactaagtcagcaacacagtttctctgatgtcg

SEQ ID NO: 20672 - DNA, 666 bp, Homo sapiens
  ENST00000492674
acttcctgtcagcacaatcgggaaactactatgctgtacttactgctccccacttcccccaccccgggtgtctgagaaactctcaggggtcctcaaagaacagtttgaaaagccagtctctttgcccctacatcagactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctgacaggactctgggcccctccccagctccactccctacctcaagaatgtgaccatttggaaaaggcaaagagaaaaggagcaaaatgaagcattcccccaggcttcagccctgggctctgaggggaaagagttgggcattgtttttctaacctaacctttccctctggggtagagaagccgagagaccctgtcctccctaatgcactgtggcccagtccccttgcctttttcctgttctgtttggagtggagaagggcagcacctctgtgtttaatggaaatagcccatagtctcctggatttttggaacatctttctcagcctattttgtgtcctaatgattcgctcaataaacatgtttgaatccac

SEQ ID NO: 20673 - DNA, 4203 bp, Homo sapiens
  ENST00000620100
agcccacgtgagagggcaggacgcctgagagcttgaggccacacgaggctgtggagcggcgtgactcaaacgtggcgcgcatcagctcgcacacttccaaacctcgcgatagctactggccctgggcgagccgttgggattgcgcttgcgcacagcgtgtcttgtacgttcccgcgcttttctggaatctttcgcccccggaagggcagcggcgggcgcctgtgtggaaggtggggtggccagagacacccgagggacctgagctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctggtaaaagttgccctccaactgagtgtgcaccaagataacaatcagcgtcagtatgaggctgaaagaaacaaggggccagggcagagggcacctgagcggctggagagcctgttggagaaacgcaaagagctccaagagcatcaagaggagattgaggggatgatgaatgccctcttcaggggtgtctttgttcatcggtacagggatgtccttcctgagatccgtgctatctgcattgaggaaattgggtgttggatgcaaagctacagcacgtctttcctcaccgacagctatttaaaatatattggttggactctgcatgataagcaccgagaagtccgcctgaagtgtgtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaaggggtgctgacggacgcggattgtgagagcgtctacccagttgtgtatgcctctcatcgaggcctggcctctgccgcaggcgaatttctgtactggaaactcttctaccctgagtgcgagataagaatgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagaacctgggtgatgtgcaggagagcacactgatagaaatccttgtgtccagtgcccggcaagcttcagaggggcacccgcctgtgggccgggtcactgggaggaagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacagtcgtccttcctagatgaggatgaggtatataatctggcagccactctgaaacgcctctctgccttctacaacactcatgacctgactcgctgggagctctatgagccatgttgccaactcctgcagaaggctgtggacacaggagaggttcctcaccaggttatcctgccagccttgactcttgtctatttttccattctctggacactaacccacatttctaaatcagatgcttcccagaagcagctgtcgagtttgagggacagaatggtggccttctgtgaactctgccagagttgcctctcagatgtggatactgagatccaggagcaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgattcccaggaggatcatttacagatagagcggctacaccagcggcgccgcctcctagccgggttctgcaagctgttgctttatggggtgctggagatggatgcagcctcagatgttttcaaacactacaacaagttctacaatgactatggtgacattatcaaggaaacattaactagagcaaggcagattgaccgaagtcattgttcccgaatcctgctgctgagcctcaagcagctgtacacagaactgctgcaggagcatgggccccagggcctgaatgagcttcctgccttcatcgagatgagggacctggcccggaggtttgccttgagttttggaccccagcagctgcagaaccgtgacctcgtggtcatgctacacaaggaaggcatccagttctccttgtctgagcttcctccagctggctcctccaatcagcctccaaatctggcattcctggagctcctttcagagttttccccccgactcttccatcaggacaagcagcttttactgtcctatctagaaaagtgcctgcagcatgtctcccaggcacctggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctgacaggactctgggcccctccccagctccactccctacctcaagaatgtgaccatttggaaaaggcaaagagaaaaggagcaaaatgaagcattcccccaggcttcagccctgggctctgaggggaaagagttgggcattgtttttctaacctaacctttccctctggggtagagaagccgagagaccctgtcctccctaatgcactgtggcccagtccccttgcctttttcctgttctgtttggagtggagaagggcagcacctctgtgtttaatggaaatagcccatagtctcctggatttttggaacatctttctcagcctattttgtgtcctaatgattcgctcaataaacatgtttgaatccacacgtt

SEQ ID NO: 20674 - DNA, 4380 bp, Homo sapiens
  ENST00000615138
agcccacgtgagagggcaggacgcctgagagcttgaggccacacgaggctgtggagcggcgtgactcaaacgtggcgcgcatcagctcgcacacttccaaacctcgcgatagctactggccctgggcgagccgttgggattgcgcttgcgcacagcgtgtcttgtacgttcccgcgcttttctggaatctttcgcccccggaagggcagcggcgggcgcctgtgtggaaggtggggtggccagagacacccgagggacctgagctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcagtctttggtagatgagtggctggatagctacaagcaagaccaggatgcaggatttctggagcttgttaactttttcatccaatcttgcggatgtaaaggcattgtgacccctgagatgttcaagaagatgtccaactcagagatcatccagcacctaacagagcagtttaatgaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctggtaaaagttgccctccaactgagtgtgcaccaagataacaatcagcgtcagtatgaggctgaaagaaacaaggggccagggcagagggcacctgagcggctggagagcctgttggagaaacgcaaagagctccaagagcatcaagaggagattgaggggatgatgaatgccctcttcaggggtgtctttgttcatcggtacagggatgtccttcctgagatccgtgctatctgcattgaggaaattgggtgttggatgcaaagctacagcacgtctttcctcaccgacagctatttaaaatatattggttggactctgcatgataagcaccgagaagtccgcctgaagtgtgtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaaggggtgctgacggacgcggattgtgagagcgtctacccagttgtgtatgcctctcatcgaggcctggcctctgccgcaggcgaatttctgtactggaaactcttctaccctgagtgcgagataagaatgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagaacctgggtgatgtgcaggagagcacactgatagaaatccttgtgtccagtgcccggcaagcttcagaggggcacccgcctgtgggccgggtcactgggaggaagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacagtcgtccttcctagatgaggatgaggtatataatctggcagccactctgaaacgcctctctgccttctacaacactcatgacctgactcgctgggagctctatgagccatgttgccaactcctgcagaaggctgtggacacaggagaggttcctcaccaggttatcctgccagccttgactcttgtctatttttccattctctggacactaacccacatttctaaatcagatgcttcccagaagcagctgtcgagtttgagggacagaatggtggccttctgtgaactctgccagagttgcctctcagatgtggatactgagatccaggagcaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgattcccaggaggatcatttacagatagagcggctacaccagcggcgccgcctcctagccgggttctgcaagctgttgctttatggggtgctggagatggatgcagcctcagatgttttcaaacactacaacaagttctacaatgactatggtgacattatcaaggaaacattaactagagcaaggcagattgaccgaagtcattgttcccgaatcctgctgctgagcctcaagcagctgtacacagaactgctgcaggagcatgggccccagggcctgaatgagcttcctgccttcatcgagatgagggacctggcccggaggtttgccttgagttttggaccccagcagctgcagaaccgtgacctcgtggtcatgctacacaaggaaggcatccagttctccttgtctgagcttcctccagctggctcctccaatcagcctccaaatctggcattcctggagctcctttcagagttttccccccgactcttccatcaggacaagcagcttttactgtcctatctagaaaagtgcctgcagcatgtctcccaggcacctggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggcagtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctgacaggactctgggcccctccccagctccactccctacctcaagaatgtgaccatttggaaaaggcaaagagaaaaggagcaaaatgaagcattcccccaggcttcagccctgggctctgaggggaaagagttgggcattgtttttctaacctaacctttccctctggggtagagaagccgagagaccctgtcctccctaatgcactgtggcccagtccccttgcctttttcctgttctgtttggagtggagaagggcagcacctctgtgtttaatggaaatagcccatagtctcctggatttttggaacatctttctcagcctattttgtgtcctaatgattcgctcaataaacatgtttgaatccacacgtt

SEQ ID NO: 20675 - DNA, 2532 bp, Homo sapiens
  ENST00000371926
taacatccaggagatattctaatacttcttattttccaagtacacacaaattgggggtagggggaagggctaagatgcttaatagtgggcgtagccagttgtggataaatatcaaaaagggaatcctaacatgaagtataagtgggattttcaccaaaaccctatccttccccagactccagtgacagtttaacggtcagctgcatcaaggcttgtgtactgtgcagtcttaaaaggcaccactcctgtccatctcggtgaaattgatggtggagcaaaagggagtttaggtggttccggtctggggagaagacgtgcagggtttcagatgcgaaagtcgcacccaaccgcttcactcgggctctaggccatccgcaggggccctgcttccttccacctgcgagctttttctgcagaatgcgggaagccgccgccgccgccacagaggagggggcggaggcagaggcggaggcggcacccaggggccggggcaggggaggccgggaccatcgcagtgacaatttattttcctgcagcagcggcagcagggacggttgctgcaggttcggggtcggccggcctgcgcgtgggcttgcgaggacgctgttcgtcccctgcgctggggtgtccgacagcgaggaggagaacgacgcacggagcccgcgcgactggaaccagcaaagctccatctgtcggcagaggagaagggggaggaggcacggccgaggcaaacgagcggacgcctcgtcgccgggtgccggtatcaccccgctgcaacgccttccagcaaaagccaccgcggcccgggttgcagcagccggacggatgccaaggccacacggcagccacgggggcagccgtcgcagtcgccgtcccacacgggctgcggacaccaagggttgctaatgaagtgattgagaagaaacagtgaacatcctcatttcacagataagacaacatggatcagccttttactgtgaattctctgaaaaagttagctgctatgcctgaccatacagatgtttccctaagcccagaagagcgagtccgtgccctaagcaagcttggttgtaatatcaccatcagtgaagacatcactccacgacgttactttaggtctggagtagagatggagaggatggcgtctgtgtatttggaagaaggaaatttggaaaatgcctttgttctttataataaatttataaccttatttgtagaaaagcttcctaaccatcgagattaccagcaatgtgcagtacctgaaaagcaggatattatgaagaaactgaaggagattgcattcccaaggacagatgaattgaaaaacgaccttttaaagaaatataacgtagaataccaagaatatttgcaaagcaaaaacaaatataaagctgaaattctcaaaaaattggagcatcagagattgatagaggcagaaaggaagcggattgctcagatgcgccagcagcagctagaatcggagcagtttctgtttttcgaagatcaactcaagaagcaagagttagcccgaggtcaaatgcgaagtcagcaaacctcagggctgtcagagcagattgatgggagcgctttgtcctgcttttccacacaccagaacaattccttgctgaatgtatttgcagatcaacctaataaaagtgatgcaaccaattatgctagccactctcctcctgtaaacagggccttaacgccagctgctactctaagtgctgttcagaatttagtggttgaaggactgcgatgtgtagttttgccagaagatctttgccacaaatttctgcaactggcagaatctaatacagtgagaggaatagaaacctgtggaatactctgtggaaaactgacacataatgaatttactattacccatgtaattgtgccaaagcagtctgcgggaccagactattgtgacatggagaatgtagaggaattattcaatgttcaggatcaacatgatctcctcactctaggatggatccatacacatcccactcaaactgcatttttatccagcgttgatcttcacactcactgttcctatcaactcatgttgccagaggccattgccattgtttgctcaccaaagcataaagacactggcatcttcaggctcaccaatgctggcatgcttgaggtttctgcttgtaaaaaaaagggctttcatccacacaccaaggagcccaggctgttcagtatatgcaaacatgtgttggtaaaagacataaaaataattgtgttggatctgaggtgatatgttctgaatgtaagcaccgtcaacatcagacacctactcatggacatgtggttgccggattttcttaagatgtttccagaaatgactgatattttatatttatacattttagatgacaaagcttgatatttattgctgttgcacattttaaagttttctttttgggttgctctgtgtcaagagaggttacatggtgttaaatcggtacctgataatgtacccaaatactatggccagataataaattgtgctgcaaacaa

SEQ ID NO: 20676 - DNA, 4184 bp, Homo sapiens
  ENST00000371927
taacatccaggagatattctaatacttcttattttccaagtacacacaaattgggggtagggggaagggctaagatgcttaatagtgggcgtagccagttgtggataaatatcaaaaagggaatcctaacatgaagtataagtgggattttcaccaaaaccctatccttccccagactccagtgacagtttaacggtcagctgcatcaaggcttgtgtactgtgcagtcttaaaaggcaccactcctgtccatctcggtgaaattgatggtggagcaaaagggagtttaggtggttccggtctggggagaagacgtgcagggtttcagatgcgaaagtcgcacccaaccgcttcactcgggctctaggccatccgcaggggccctgcttccttccacctgcgagctttttctgcagaatgcgggaagccgccgccgccgccacagaggagggggcggaggcagaggcggaggcggcacccaggggccggggcaggggaggccgggaccatcgcagtgacaatttattttcctgcagcagcggcagcagggacggttgctgcaggttcggggtcggccggcctgcgcgtgggcttgcgaggacgctgttcgtcccctgcgctggggtgtccgacagcgaggaggagaacgacgcacggagcccgcgcgactggaaccagcaaagctccatctgtcggcagaggagaagggggaggaggcacggccgaggcaaacgagcggacgcctcgtcgccgggtgccggtatcaccccgctgcaacgccttccagcaaaagccaccgcggcccgggttgcagcagccggacggatgccaaggccacacggcagccacgggggcagccgtcgcagtcgccgtcccacacgggctgcggacaccaagggttgctaatgaagtgattgagaagaaacagtgaacatcctcatttcacagataagacaacatggatcagccttttactgtgaattctctgaaaaagttagctgctatgcctgaccatacagatgtttccctaagcccagaagagcgagtccgtgccctaagcaagcttggttgtaatatcaccatcagtgaagacatcactccacgacgttactttaggtctggagtagagatggagaggatggcgtctgtgtatttggaagaaggaaatttggaaaatgcctttgttctttataataaatttataaccttatttgtagaaaagcttcctaaccatcgagattaccagcaatgtgcagtacctgaaaagcaggatattatgaagaaactgaaggagattgcattcccaaggacagatgaattgaaaaacgaccttttaaagaaatataacgtagaataccaagaatatttgcaaagcaaaaacaaatataaagctgaaattctcaaaaaattggagcatcagagattgatagaggcagaaaggaagcggattgctcagatgcgccagcagcagctagaatcggagcagtttctgtttttcgaagatcaactcaagaagcaagagttagcccgaggtcaaatgcgaagtcagcaaacctcagggctgtcagagcagattgatgggagcgctttgtcctgcttttccacacaccagaacaattccttgctgaatgtatttgcagatcaacctaataaaagtgatgcaaccaattatgctagccactctcctcctgtaaacagggccttaacgccagctgctactctaagtgctgttcagaatttagtggttgaaggactgcgatgtgtagttttgccagaagatctttgccacaaatttctgcaactggcagaatctaatacagtgagaggaatagaaacctgtggaatactctgtggaaaactgacacataatgaatttactattacccatgtaattgtgccaaagcagtctgcgggaccagactattgtgacatggagaatgtagaggaattattcaatgttcaggatcaacatgatctcctcactctaggatggatccatacacatcccactcaaactgcatttttatccagcgttgatcttcacactcactgttcctatcaactcatgttgccagaggccattgccattgtttgctcaccaaagcataaagacactggcatcttcaggctcaccaatgctggcatgcttgaggtttctgcttgtaaaaaaaagggctttcatccacacaccaaggagcccaggctgttcagtattcagaaattcctttctgggataatttctggcactgctttggagatggagcccctgaaaattggctatggaccaaatggattcccactcttggggatctctaggtcatcatcaccatctgaacagctctgagagagacaagaagtggaatggagaaggtgattaggtaatccaagaattgccaggcgaacaattgtgaaaatctttcatagagttcccgatgaaaacaactctttcttgttagccattatctctgcctttcctttctaaagaaaaacacgtcatttcatcttgattatcagtttctcaagtactcatggatgtgaggccaggtaccctgtcaccttggctctgtttgggatgcaatgttgtgtttgtcaccacttcccattccccaaaagcatctttaacatagaccattcattcttcagattcaaaatgcttaagctgaactaacctcaaagggccctcattaatttacagacatttgaataacacccatattcatttctgctactgaaccaaagccttttccaaaaaaatcatctagcaaactgtttttgccaggccaaatattaacaggtatatatatttgcatacataaatatttacctctatgtcttgtgtgtttttgttatgagacagagtctcactctgtcgcccaggctggagtgcagtggcacagtctcagctcactgcaacctccacctcccaggttcaagcgattctcatgcctcagcctcccgagtagcgaggactacaggcgtgcaccaccacgcccagctaatttttgtatttttagtagagatggggttttaccctgttggccagggtggtctcgaattcctgacctctgatgatctacccgcctggacctctcaaagtgctgggattacagacatgagccactgtgccctgcctctgttttgtgtatttacataaatacatgtctccagagctttaaattcttcttaaattttaaaactagaactaaaccagacattgagaggacccagaaatataccctgactaacgtgggtggaatttcatttggcttgactctttggtgaaaaaaaaaaaaatcaggctctcaaggactcaatttggtgaaccaatgccaaatagaaaaatgttcttgacattttccccaaaatagatgtctaaagattttgcacttcaaattggtactttatgtattaaaagtgatattgaaactaaattcctacccaattagttgaaaaatatgaaaaaagcaattgctagagaatgcaatttattaaatgttggtggtcttttaaaaaatgaattcctcttgtagccagtgagatcagttatttatttatttattttaatagtaacaaggtctcactatattgtccaggctgatcttgaactcctggcctcaagctgtcctcccatctcagcttcccaaagtgctgagattataggcatgagccaccatgcctggctagttaatggttattaagtaatacaaacatttctgtgaattccaccagatcattgactttggcatagttcacttaagactttgtttgataaaataaatctctttcactctaattaggaagcatttttgggatcctgattaatgctctaatattgtggggccaaaaaatatgtggaacgtggccctgcagttagatgagctgagatcactatagtactatatagcgctctaaatcctaaatgctagatcactgtaatactgtacagatcagccacttgctggcttgtgactctgggccatttacttcacctctcaaaaggcatatttaaagtgaggaaaataataagtttattttggaaattcagttagatgatgcaaattgtttactgtaatttctagcatgtagttcgtgctccatgcatttaactgttattacaggttgtattagtatcacattaaattacccactgaagtgaaagtgaaaccagaatgctgtcaacgatt

SEQ ID NO: 20677 - DNA, 619 bp, Homo sapiens
  ENST00000461650
gcaggggaggccgggaccatcgcagtgacaatttattttcctgcagcagcggcagcagggacggttgctgcaggttcggggtcggccggcctgcgcgtgggcttgcgaggacgctgttcgtcccctgcgctggggtgtccgacagcgaggaggagaacgacgcacggagcccgcgcgactggaaccagcaaagctccatctgtcggcagaggagaagggggaggaggcacggccgaggcaaacgagcggacgcctcgtcgccgggtgccggtatcaccccgctgcaacgccttccagcaaaagccaccgcggcccgggttgcagcagccggacggatgccaaggccacacggcagccacgggggcagccgtcgcagtcgccgtcccacacgggctgcggacaccaagggttgctagacccttcccagctgtaagaatttacagctacaatccaagaaatgagattgcattttacaagaaaagaaaactgatgattcttgcccaaaacatgagaagtagaaggaatgtgagagaaaataatgtagattccgtccaggaagtgctaggtgctttcctggcccaaggatgtgaccttctcttggattttcctgattattatg

SEQ ID NO: 20678 - DNA, 450 bp, Homo sapiens
  ENST00000468698
actggttcttgggaatttcaagaagaaacttgttttcttatcctcacctataaagacccttcccagctgtaagaatttacagctacaatccaagaaatgagattgcattttacaagaaaagaaaactgatgattcttgcccaaaacatgagaagtagaaggaatgtgagagaaaataatgtagattccgtccaggaagtgctaggtgctttcctggtgggtacatttacaaattagggacattttaattaatctactggatttgtgattctgtctgctactatcttctttttcttgaccttatgaaagatttatagatggcttcaactgaaactacaggaaatgactcatggttatccctgaagatattagagccagatttccattccttagggctgatgcatagcagctctttgataaatatttgctaaataaatgacaaattttagaa

SEQ ID NO: 20679 - DNA, 2208 bp, Homo sapiens
  ENST00000371924
ctcttcatctttgtcatgtgattcaacatattcatgggaataatattccatgacctttgctgtcttctattggttagaagccaactacaggtcttaaacacactcaagtggagaggattacacaaacctacagatatcaaggggcaggaatcacagagctatcttagaattctgcctgttatagttctaaggttgagtttaaatccagactggctctaagtttaacagtccatgcttctaatcagtattatcttctttattcctttgaagaaagcaaacctactttataaccttgcatagagttctaagtaaggtatcccgcagcagattcatactgggtgtcagtcaaatgtgaattattttcacaccttcacttttaaagatcagcttcaggaaactataaccacttgcagttttgtattttcaggaagagatttccaacagtctctctaaacactcaggttatataggttatttcaatttgttcctgtttgtctgaggcagagataaccctggggtttgggatttcaaacttgggtctcaaaaaataactttagttctgcttcttgtttttgaaacagatgaagtgattgagaagaaacagtgaacatcctcatttcacagataagacaacatggatcagccttttactgtgaattctctgaaaaagttagctgctatgcctgaccatacagatgtttccctaagcccagaagagcgagtccgtgccctaagcaagcttggttgtaatatcaccatcagtgaagacatcactccacgacgttactttaggtctggagtagagatggagaggatggcgtctgtgtatttggaagaaggaaatttggaaaatgcctttgttctttataataaatttataaccttatttgtagaaaagcttcctaaccatcgagattaccagcaatgtgcagtacctgaaaagcaggatattatgaagaaactgaaggagattgcattcccaaggacagatgaattgaaaaacgaccttttaaagaaatataacgtagaataccaagaatatttgcaaagcaaaaacaaatataaagctgaaattctcaaaaaattggagcatcagagattgatagaggcagaaaggaagcggattgctcagatgcgccagcagcagctagaatcggagcagtttctgtttttcgaagatcaactcaagaagcaagagttagcccgaggtcaaatgcgaagtcagcaaacctcagggctgtcagagcagattgatgggagcgctttgtcctgcttttccacacaccagaacaattccttgctgaatgtatttgcagatcaacctaataaaagtgatgcaaccaattatgctagccactctcctcctgtaaacagggccttaacgccagctgctactctaagtgctgttcagaatttagtggttgaaggactgcgatgtgtagttttgccagaagatctttgccacaaatttctgcaactggcagaatctaatacagtgagaggaatagaaacctgtggaatactctgtggaaaactgacacataatgaatttactattacccatgtaattgtgccaaagcagtctgcgggaccagactattgtgacatggagaatgtagaggaattattcaatgttcaggatcaacatgatctcctcactctaggatggatccatacacatcccactcaaactgcatttttatccagcgttgatcttcacactcactgttcctatcaactcatgttgccagaggccattgccattgtttgctcaccaaagcataaagacactggcatcttcaggctcaccaatgctggcatgcttgaggtttctgcttgtaaaaaaaagggctttcatccacacaccaaggagcccaggctgttcagtatatgcaaacatgtgttggtaaaagacataaaaataattgtgttggatctgaggtgatatgttctgaatgtaagcaccgtcaacatcagacacctactcatggacatgtggttgccggattttcttaagatgtttccagaaatgactgatattttatatttatacattttagatgacaaagcttgatatttattgctgttgcacattttaaagttttctttttgggttgctctgtgtcaagagaggttacatggtgttaaatcggtacctgataatgtacccaaatactatggccagataataaattgtgctgcaaacaa

SEQ ID NO: 20680 - DNA, 1899 bp, Homo sapiens
  ENST00000371922
atattatctgacctaataagcctggatattttgttagaactggagagcttgggactcctcctttttagcaaaactctgggttagtggtgacagagaaggttggaacacattttaataaccattttttagtgattccttcttatccataaatttccagcagagtatgagttctagagtcaaatgcgaaaggttctagggcagcactgttcaatagaactcctgtgatgatggaagtgttctgtttggcactttccaatatggtatccactagccacatgtggcttctgggtacttaaatgtgactgactagtgtccctgaggtactgaatttctaattttgtttaattttaatcaagttcaaataaccacatgtggctagtggccactatattagaagtgcagtaggggtgagatattttgtttcatatggtcttgttggtctgactgagcaaacaaccttgacgttgattttccagtatttaaaagcattagggaatgaagggatcctgattgtcatggcctgtctctggtaaaatatcagtggatttagaactgctatgttaatcagatcaaggggcttttgccctgatgttatgtatttctctcactgttccatgagtgtccctgtgggcatatcacagtatctagcattttctctgtctgcttgaagactgaaaatgtctaattccagttcaatgtttctccttggaaactaaccttctcttctggctgccacactttttagaacaaatataaagctgaaattctcaaaaaattggagcatcagagattgatagaggcagaaaggaagcggattgctcagatgcgccagcagcagctagaatcggagcagtttctgtttttcgaagatcaactcaagaagcaagagttagcccgaggtcaaatgcgaagtcagcaaacctcagggctgtcagagcagattgatgggagcgctttgtcctgcttttccacacaccagaacaattccttgctgaatgtatttgcagatcaacctaataaaagtgatgcaaccaattatgctagccactctcctcctgtaaacagggccttaacgccagctgctactctaagtgctgttcagaatttagtggttgaaggactgcgatgtgtagttttgccagaagatctttgccacaaatttctgcaactggcagaatctaatacagtgagaggaatagaaacctgtggaatactctgtggaaaactgacacataatgaatttactattacccatgtaattgtgccaaagcagtctgcgggaccagactattgtgacatggagaatgtagaggaattattcaatgttcaggatcaacatgatctcctcactctaggatggatccatacacatcccactcaaactgcatttttatccagcgttgatcttcacactcactgttcctatcaactcatgttgccagaggccattgccattgtttgctcaccaaagcataaagacactggcatcttcaggctcaccaatgctggcatgcttgaggtttctgcttgtaaaaaaaagggctttcatccacacaccaaggagcccaggctgttcagtatatgcaaacatgtgttggtaaaagacataaaaataattgtgttggatctgaggtgatatgttctgaatgtaagcaccgtcaacatcagacacctactcatggacatgtggttgccggattttcttaagatgtttccagaaatgactgatattttatatttatacattttagatgacaaagcttgatatttattgctgttgcacattttaaagttttctttttgggttgctctgtgtcaagagaggttacatggtgttaaatcggtacctgataatgtacccaaatactatggccagataataaattgtgctgcaaacaa

SEQ ID NO: 20681 - DNA, 5917 bp, Homo sapiens
  ENST00000336934
aaaaatcgctgggtctgttgagctgtcctgggctgggtgccttgctctttgactgagactggagacagacggcaacagccacaggcagactgaggtggcaataggaaatctgccgagatgttcagtcaggtgcccaggaccccagcctcaggctgctactacctaaattccatgacacctgagggccaggagatgtacttgcgatttgatcagactacaagacgctctccttacaggatgagccggattctagcacgccatcagctagtgactaaaattcaacaagaaattgaggcaaaagaagcatgtgactggctccgtgctgccgggttcccgcaatacgctcagttatatgaggattcacaatttcccatcaacattgtggctgtcaagaatgatcatgattttcttgaaaaggaccttgtagaacctctttgcagacgactaaatacgttgaacaagtgtgcctcaatgaaacttgatgtgaacttccaaaggaaaaagggtgacgactccgatgaggaagatctttgtatcagcaacaaatggactttccaaagaaccagtcgcaggtggtctcgtgtggacgacctctacacgctgctccctcgaggagacagaaatgggtcaccgggaggcacggggatgaggaacacgaccagcagtgagagcgtcctcacagacctgagcgagcctgaggtctgctccattcacagcgaaagcagtggaggcagcgacagtcgcagccagccgggccagtgctgtacagacaacccggtcatgctggatgccccactcgtcagcagcagcctcccacagccccccagagatgtcctcaaccaccccttccaccccaagaatgagaagcccacgagggctagggccaaatcatttttgaaacgcatggaaacactccgagggaagggagcccacgggaggcataaggggtctgggcggacaggtggcctggtgatcagtgggcccatgttgcagcaggagccagagtcctttaaggctatgcagtgcatccaaataccaaatggagatctccagaattcgccgccacctgcctgcagaaaagggctcccatgctctggcaagtcgagtggcgagagcagcccgtcggagcacagcagcagcggggtgagcacgccctgcctgaaggaacgcaagtgccacgaggccaacaagcgcgggggcatgtacttggaggacctagatgtgctggcggggacagcactgccggatgcaggggaccaaagccgtatgcatgaatttcactcccaagagaatttggtggtgcatattcccaaggatcacaaaccaggaacattccccaaggcactttctattgaaagcctctctcccacagatagtagcaatggggttaattggaggaccggtagcatctccctgggcagagagcaggtccctggtgccagggagccccggctcatggcgtcctgccacagagccagccgagtcagtatctatgacaatgtccctggctcccatctgtatgccagcacaggagatcttttggacttggagaaagatgaccttttccctcacttggatgacattctgcagcatgtcaatgggctccaagaggtagtcgatgactggtccaaagatgtcttgcctgaactgcaaactcatgatacattggttggggaacctggcttatccacctttccatctcctaatcagatcaccttagattttgaaggtaactctgtctcagaaggtcggacgacacccagtgatgtggaaagagatgtaacatctcttaatgaatctgagcctcctggggtcagagacaggagggattctggtgtaggggcctctctgaccaggccaaacaggcgactccgatggaacagtttccagctgtcgcaccagccccggccggccccagcatcgccccacatcagcagccagacggccagccagctgagcctgctccagcgcttctcactgctccgcctcacggccatcatggagaagcactccatgtccaacaagcacggctggacatggtcagttccaaagttcatgaagaggatgaaagttcccgactacaaagacaaggctgtctttggcgttcctctcatagtccacgtccaaagaacgggacagcccctgcctcaaagtattcagcaagcactgagatatctacgcagcaactgcctcgatcaggtgggtctttttcgcaaatcaggagtgaagtctcgaatccatgcccttcgccaaatgaatgaaaacttccctgagaacgtcaactatgaagaccagtctgcttatgatgtggcggatatggtgaaacagttcttccgggacctccctgagcctcttttcaccaacaagctcagtgagacctttctccatatctatcagtatgtctccaaagagcagcggctgcaggccgtgcaggctgccatcctgctactggccgatgagaacagggaggtcctgcagacgctcttgtgtttcctgaacgacgtcgtcaacttggtggaagagaatcagatgacgcccatgaacctggcagtgtgtctggccccctccctctttcatcttaatttattgaagaaagaaagctctccacgagtcatacagaagaaatatgccactgggaagccagatcaaaaggacctcaacgagaatctggcagcagctcaggggctagcgcacatgatcatggaatgcgacagactttttgaggttccacacgagttggtggcccagtctcgtaactcgtatgtggaggctgagatccacgtgccaaccctggaagaattggggacacagctggaggagagtggggcaactttccacacttacctgaaccatctcatccagggcctccagaaagaagccaaggagaagttcaaaggatgggtcacgtgctccagcacggacaatacagatcttgctttcaaaaaggtgggcgacgggaacccgctgaagctgtggaaggcttctgtggaggtggaagcacccccctcagtggtcctgaaccgcgtgctgagagagcgccacctgtgggacgaggactttgtgcagtggaaggttgtggaaactctagacaggcaaacagagatctaccagtatgtgctgaacagcatggctccccatccttccagagactttgtggttctcaggacctggaaaactgatttgcccaaaggaatgtgtaccctggtgtccctctccgtggagcatgaggaagcccagctcctgggtggtgtgcgagcagtggtgatggactcgcagtacttgatagaaccgtgtggctctggcaagtcaagactgactcacatctgcaggatagacctgaaaggtcactccccagaatggtacagcaaaggctttggacatctgtgtgcagcagaagttgccaggattagaaactctttccagcccctcattgctgagggcccagaaactaaaatctgagttttgcccagtgtgacatcaaactcagggaagaggaagctaaagtgacgagtgtggcagagagtgtgcatgtgagaaagcgagagaaagaggaactgaaggacgcggttaatgcctaaaaatggaaacgttaagaagttggaatgttggagatgcaagaatttccaagaactttcttagccttcctggagatggctacatccctactaatataattttaaaatgagaactttatatatattacttaaaattaaatggactattccttgtgcattgcctaatttgctatttaaaggcttctaagaagcgtatacctaactgtaaataaatgtatgtatagcatatgtacatatgtgtgtatatctccatctttactgtatatatgtaaaataccaattttatatagaattgtgtgttttgaaaatgacggtgtctgactcagtgagtcccttcctcacacagttctttccaagtggctctgggccccatctctccactgtcctgtaagctgtgcagaacctgctgctaacaccaaggtgtgaacatgccctgatgcctaaccaaagatgagttaaccaaaggaaaataacattaaaggagacttatgtgttaacgctttgtttctgctattcaaaaactgagagtggagatctgggataaagcaaggaaataataattactcctccttaaagcaaatgggggggtgagaagtcattaccaaatttaaagctagatgaggagttgccactgggcccagtaagatggaatttcagtgagatatggaccaccggagtcagcgagagtgactgaaacagaagcgatacctctcgctcccatgcccatcactacagaccccaagtcaagatgaatatcatagcctttacttcttcacagccaaagggagcccctgtgttgtctcaagtttttataaatacatttcataatgttattaaatgtcattctatttgaccagtggcctatttggtcacagttaattggtgttttcttattgcactgaattcaactccagacaccatacaaagggagatgatggccattccgttcaaatcctagatcgttacagcttcagggaattcatattttgttatgtgtaggatactcttaaaatgtaattcattaaacttttacaatctgaaagacagggtttttaactaacatgagaccaaaactatgttctttgattagttttagatagtataatcgggtttattaattcttctgtgtttcttcactagccagtccaagctacctatgcatttgacccaaccttatttattattgtacagatgaagcgaattgactccctttagccaactgctaatggatcgaatgtgctttttattgtaattcaacagctatagagagaaagataacttattgtgtgtttgatttcagggagagagattttctttggtcatccataatagagattgataagatttagcaactggtgttggagaaaaaaagaaaagcaaatgagtgttttcaggtttttttgcattatatgcatttatgtaatgtttctgttatcagcaatgtgcaattattttattgagaggaataaaaaagctttctatgagtttggtatggtgcgaggaaaatcttacagtttgaattatgacctagaaatttttcattcccatatctacctaagaaggaagcagtaaatccataatttaccttttgggcaatgctttgtgagcaaaacaaagtcacttctgccataacatcttgaatttaaccatatatgccagattactttatatgcatcaacaagatcaccagtgaagtttaatctagctaaacactggtcctgctcctgagatgggatcctatgtgtttggaaaacgtgataggcacacgaggatgagtggctttgtatcgcccagagaggtgcttgtccagatttcacatgcacatgaattgcctggggatcttgtgaaactgcagactctgctccaagtaatctgggctgggcctgagattctgcatttctaaggagtctcagggatgcctatgctgctggcctaaaaccacactcagaaacgaggacctagaagatccctaaaacagaataagaacaaatgtgattgtatttctgattctccctctcttcgaattatctgacttttttgtttttgtgcacatagtaatcatatcaccgctgcataacaacacagtgcatctttttaaaacaaggaaaagggaaaaaaaggagaaaaaacgatgcatcaagcttgtttgtcaaataccacagtattttattcattgttatcttgccaatggaaataaagtatgatattgcatttaaatattatatttatacctcatgtatatttttacctcaattgttgatatcaatcatcaattgtaaataaataattgccaaggcaaataaatttatatatattaaatatttcctattttctataaaata

SEQ ID NO: 20682 - DNA, 5798 bp, Homo sapiens
  ENST00000255486
cggaaacatgagagaggactatcatctgctccttgctctgaatttctttgaacctccatgctggaaccctcctcagttctccatgcaaacgttaaccaggcccctttgtggtgcttggtgctgcgctggtgcagagaatgcaaagacactgtctgtggtgggaaacagaaaagcagagtgaaccacacattccagcgccgggaaattgaggcaaaagaagcatgtgactggctccgtgctgccgggttcccgcaatacgctcagttatatgaggattcacaatttcccatcaacattgtggctgtcaagaatgatcatgattttcttgaaaaggaccttgtagaacctctttgcagacgactaaatacgttgaacaagtgtgcctcaatgaaacttgatgtgaacttccaaaggaaaaagggtgacgactccgatgaggaagatctttgtatcagcaacaaatggactttccaaagaaccagtcgcaggtggtctcgtgtggacgacctctacacgctgctccctcgaggagacagaaatgggtcaccgggaggcacggggatgaggaacacgaccagcagtgagagcgtcctcacagacctgagcgagcctgaggtctgctccattcacagcgaaagcagtggaggcagcgacagtcgcagccagccgggccagtgctgtacagacaacccggtcatgctggatgccccactcgtcagcagcagcctcccacagccccccagagatgtcctcaaccaccccttccaccccaagaatgagaagcccacgagggctagggccaaatcatttttgaaacgcatggaaacactccgagggaagggagcccacgggaggcataaggggtctgggcggacaggtggcctggtgatcagtgggcccatgttgcagcaggagccagagtcctttaaggctatgcagtgcatccaaataccaaatggagatctccagaattcgccgccacctgcctgcagaaaagggctcccatgctctggcaagtcgagtggcgagagcagcccgtcggagcacagcagcagcggggtgagcacgccctgcctgaaggaacgcaagtgccacgaggccaacaagcgcgggggcatgtacttggaggacctagatgtgctggcggggacagcactgccggatgcaggggaccaaagccgtatgcatgaatttcactcccaagagaatttggtggtgcatattcccaaggatcacaaaccaggaacattccccaaggcactttctattgaaagcctctctcccacagatagtagcaatggggttaattggaggaccggtagcatctccctgggcagagagcaggtccctggtgccagggagccccggctcatggcgtcctgccacagagccagccgagtcagtatctatgacaatgtccctggctcccatctgtatgccagcacaggagatcttttggacttggagaaagatgaccttttccctcacttggatgacattctgcagcatgtcaatgggctccaagaggtagtcgatgactggtccaaagatgtcttgcctgaactgcaaactcatgatacattggttggggaacctggcttatccacctttccatctcctaatcagatcaccttagattttgaaggtaactctgtctcagaaggtcggacgacacccagtgatgtggaaagagatgtaacatctcttaatgaatctgagcctcctggggtcagagacaggagggattctggtgtaggggcctctctgaccaggccaaacaggcgactccgatggaacagtttccagctgtcgcaccagccccggccggccccagcatcgccccacatcagcagccagacggccagccagctgagcctgctccagcgcttctcactgctccgcctcacggccatcatggagaagcactccatgtccaacaagcacggctggacatggtcagttccaaagttcatgaagaggatgaaagttcccgactacaaagacaaggctgtctttggcgttcctctcatagtccacgtccaaagaacgggacagcccctgcctcaaagtattcagcaagcactgagatatctacgcagcaactgcctcgatcaggtgggtctttttcgcaaatcaggagtgaagtctcgaatccatgcccttcgccaaatgaatgaaaacttccctgagaacgtcaactatgaagaccagtctgcttatgatgtggcggatatggtgaaacagttcttccgggacctccctgagcctcttttcaccaacaagctcagtgagacctttctccatatctatcagtatgtctccaaagagcagcggctgcaggccgtgcaggctgccatcctgctactggccgatgagaacagggaggtcctgcagacgctcttgtgtttcctgaacgacgtcgtcaacttggtggaagagaatcagatgacgcccatgaacctggcagtgtgtctggccccctccctctttcatcttaatttattgaagaaagaaagctctccacgagtcatacagaagaaatatgccactgggaagccagatcaaaaggacctcaacgagaatctggcagcagctcaggggctagcgcacatgatcatggaatgcgacagactttttgaggttccacacgagttggtggcccagtctcgtaactcgtatgtggaggctgagatccacgtgccaaccctggaagaattggggacacagctggaggagagtggggcaactttccacacttacctgaaccatctcatccagggcctccagaaagaagccaaggagaagttcaaaggatgggtcacgtgctccagcacggacaatacagatcttgctttcaaaaaggtgggcgacgggaacccgctgaagctgtggaaggcttctgtggaggtggaagcacccccctcagtggtcctgaaccgcgtgctgagagagcgccacctgtgggacgaggactttgtgcagtggaaggttgtggaaactctagacaggcaaacagagatctaccagtatgtgctgaacagcatggctccccatccttccagagactttgtggttctcaggacctggaaaactgatttgcccaaaggaatgtgtaccctggtgtccctctccgtggagcatgaggaagcccagctcctgggtggtgtgcgagcagtggtgatggactcgcagtacttgatagaaccgtgtggctctggcaagtcaagactgactcacatctgcaggatagacctgaaaggtcactccccagaatggtacagcaaaggctttggacatctgtgtgcagcagaagttgccaggattagaaactctttccagcccctcattgctgagggcccagaaactaaaatctgagttttgcccagtgtgacatcaaactcagggaagaggaagctaaagtgacgagtgtggcagagagtgtgcatgtgagaaagcgagagaaagaggaactgaaggacgcggttaatgcctaaaaatggaaacgttaagaagttggaatgttggagatgcaagaatttccaagaactttcttagccttcctggagatggctacatccctactaatataattttaaaatgagaactttatatatattacttaaaattaaatggactattccttgtgcattgcctaatttgctatttaaaggcttctaagaagcgtatacctaactgtaaataaatgtatgtatagcatatgtacatatgtgtgtatatctccatctttactgtatatatgtaaaataccaattttatatagaattgtgtgttttgaaaatgacggtgtctgactcagtgagtcccttcctcacacagttctttccaagtggctctgggccccatctctccactgtcctgtaagctgtgcagaacctgctgctaacaccaaggtgtgaacatgccctgatgcctaaccaaagatgagttaaccaaaggaaaataacattaaaggagacttatgtgttaacgctttgtttctgctattcaaaaactgagagtggagatctgggataaagcaaggaaataataattactcctccttaaagcaaatgggggggtgagaagtcattaccaaatttaaagctagatgaggagttgccactgggcccagtaagatggaatttcagtgagatatggaccaccggagtcagcgagagtgactgaaacagaagcgatacctctcgctcccatgcccatcactacagaccccaagtcaagatgaatatcatagcctttacttcttcacagccaaagggagcccctgtgttgtctcaagtttttataaatacatttcataatgttattaaatgtcattctatttgaccagtggcctatttggtcacagttaattggtgttttcttattgcactgaattcaactccagacaccatacaaagggagatgatggccattccgttcaaatcctagatcgttacagcttcagggaattcatattttgttatgtgtaggatactcttaaaatgtaattcattaaacttttacaatctgaaagacagggtttttaactaacatgagaccaaaactatgttctttgattagttttagatagtataatcgggtttattaattcttctgtgtttcttcactagccagtccaagctacctatgcatttgacccaaccttatttattattgtacagatgaagcgaattgactccctttagccaactgctaatggatcgaatgtgctttttattgtaattcaacagctatagagagaaagataacttattgtgtgtttgatttcagggagagagattttctttggtcatccataatagagattgataagatttagcaactggtgttggagaaaaaaagaaaagcaaatgagtgttttcaggtttttttgcattatatgcatttatgtaatgtttctgttatcagcaatgtgcaattattttattgagaggaataaaaaagctttctatgagtttggtatggtgcgaggaaaatcttacagtttgaattatgacctagaaatttttcattcccatatctacctaagaaggaagcagtaaatccataatttaccttttgggcaatgctttgtgagcaaaacaaagtcacttctgccataacatcttgaatttaaccatatatgccagattactttatatgcatcaacaagatcaccagtgaagtttaatctagctaaacactggtcctgctcctgagatgggatcctatgtgtttggaaaacgtgataggcacacgaggatgagtggctttgtatcgcccagagaggtgcttgtccagatttcacatgcacatgaattgcctggggatcttgtgaaactgcagactctgctccaagtaatctgggctgggcctgagattctgcatttctaaggagtctcagggatgcctatgctgctggcctaaaaccacactcagaaacgaggacctagaagatccctaaaacagaataagaacaaatgtgattgtatttctgattctccctctcttcgaattatctgacttttttgtttttgtgcacatagtaatcatatcaccgctgcataacaacacagtgcatctttttaaaacaaggaaaagggaaaaaaaggagaaaaaacgatgcatcaagcttgtttgtcaaataccacagtattttattcattgttatcttgccaatggaaataaagtatgatattgcatttaaatattatatttatacctcatgtatatttttacctcaattgttgatatcaatcatcaattgtaaataaataattgccaaggcaaataaattt

SEQ ID NO: 20683 - DNA, 5784 bp, Homo sapiens
  ENST00000399365
ctcacagacaacagccaagcacagaggaaatattagctggcagagataacgaagagaaaacactcggtgacagatgcaccatctgtcagtttctgaggagcagttttcaagaaagctgaaaatgaattgaagaagagaggggttttgtttgaaaggtacagcacagcctaaggacaattttaaacaaaaaattgaggcaaaagaagcatgtgactggctccgtgctgccgggttcccgcaatacgctcagttatatgaggattcacaatttcccatcaacattgtggctgtcaagaatgatcatgattttcttgaaaaggaccttgtagaacctctttgcagacgactaaatacgttgaacaagtgtgcctcaatgaaacttgatgtgaacttccaaaggaaaaagggtgacgactccgatgaggaagatctttgtatcagcaacaaatggactttccaaagaaccagtcgcaggtggtctcgtgtggacgacctctacacgctgctccctcgaggagacagaaatgggtcaccgggaggcacggggatgaggaacacgaccagcagtgagagcgtcctcacagacctgagcgagcctgaggtctgctccattcacagcgaaagcagtggaggcagcgacagtcgcagccagccgggccagtgctgtacagacaacccggtcatgctggatgccccactcgtcagcagcagcctcccacagccccccagagatgtcctcaaccaccccttccaccccaagaatgagaagcccacgagggctagggccaaatcatttttgaaacgcatggaaacactccgagggaagggagcccacgggaggcataaggggtctgggcggacaggtggcctggtgatcagtgggcccatgttgcagcaggagccagagtcctttaaggctatgcagtgcatccaaataccaaatggagatctccagaattcgccgccacctgcctgcagaaaagggctcccatgctctggcaagtcgagtggcgagagcagcccgtcggagcacagcagcagcggggtgagcacgccctgcctgaaggaacgcaagtgccacgaggccaacaagcgcgggggcatgtacttggaggacctagatgtgctggcggggacagcactgccggatgcaggggaccaaagccgtatgcatgaatttcactcccaagagaatttggtggtgcatattcccaaggatcacaaaccaggaacattccccaaggcactttctattgaaagcctctctcccacagatagtagcaatggggttaattggaggaccggtagcatctccctgggcagagagcaggtccctggtgccagggagccccggctcatggcgtcctgccacagagccagccgagtcagtatctatgacaatgtccctggctcccatctgtatgccagcacaggagatcttttggacttggagaaagatgaccttttccctcacttggatgacattctgcagcatgtcaatgggctccaagaggtagtcgatgactggtccaaagatgtcttgcctgaactgcaaactcatgatacattggttggggaacctggcttatccacctttccatctcctaatcagatcaccttagattttgaaggtaactctgtctcagaaggtcggacgacacccagtgatgtggaaagagatgtaacatctcttaatgaatctgagcctcctggggtcagagacaggagggattctggtgtaggggcctctctgaccaggccaaacaggcgactccgatggaacagtttccagctgtcgcaccagccccggccggccccagcatcgccccacatcagcagccagacggccagccagctgagcctgctccagcgcttctcactgctccgcctcacggccatcatggagaagcactccatgtccaacaagcacggctggacatggtcagttccaaagttcatgaagaggatgaaagttcccgactacaaagacaaggctgtctttggcgttcctctcatagtccacgtccaaagaacgggacagcccctgcctcaaagtattcagcaagcactgagatatctacgcagcaactgcctcgatcaggtgggtctttttcgcaaatcaggagtgaagtctcgaatccatgcccttcgccaaatgaatgaaaacttccctgagaacgtcaactatgaagaccagtctgcttatgatgtggcggatatggtgaaacagttcttccgggacctccctgagcctcttttcaccaacaagctcagtgagacctttctccatatctatcagtatgtctccaaagagcagcggctgcaggccgtgcaggctgccatcctgctactggccgatgagaacagggaggtcctgcagacgctcttgtgtttcctgaacgacgtcgtcaacttggtggaagagaatcagatgacgcccatgaacctggcagtgtgtctggccccctccctctttcatcttaatttattgaagaaagaaagctctccacgagtcatacagaagaaatatgccactgggaagccagatcaaaaggacctcaacgagaatctggcagcagctcaggggctagcgcacatgatcatggaatgcgacagactttttgaggttccacacgagttggtggcccagtctcgtaactcgtatgtggaggctgagatccacgtgccaaccctggaagaattggggacacagctggaggagagtggggcaactttccacacttacctgaaccatctcatccagggcctccagaaagaagccaaggagaagttcaaaggatgggtcacgtgctccagcacggacaatacagatcttgctttcaaaaaggtgggcgacgggaacccgctgaagctgtggaaggcttctgtggaggtggaagcacccccctcagtggtcctgaaccgcgtgctgagagagcgccacctgtgggacgaggactttgtgcagtggaaggttgtggaaactctagacaggcaaacagagatctaccagtatgtgctgaacagcatggctccccatccttccagagactttgtggttctcaggacctggaaaactgatttgcccaaaggaatgtgtaccctggtgtccctctccgtggagcatgaggaagcccagctcctgggtggtgtgcgagcagtggtgatggactcgcagtacttgatagaaccgtgtggctctggcaagtcaagactgactcacatctgcaggatagacctgaaaggtcactccccagaatggtacagcaaaggctttggacatctgtgtgcagcagaagttgccaggattagaaactctttccagcccctcattgctgagggcccagaaactaaaatctgagttttgcccagtgtgacatcaaactcagggaagaggaagctaaagtgacgagtgtggcagagagtgtgcatgtgagaaagcgagagaaagaggaactgaaggacgcggttaatgcctaaaaatggaaacgttaagaagttggaatgttggagatgcaagaatttccaagaactttcttagccttcctggagatggctacatccctactaatataattttaaaatgagaactttatatatattacttaaaattaaatggactattccttgtgcattgcctaatttgctatttaaaggcttctaagaagcgtatacctaactgtaaataaatgtatgtatagcatatgtacatatgtgtgtatatctccatctttactgtatatatgtaaaataccaattttatatagaattgtgtgttttgaaaatgacggtgtctgactcagtgagtcccttcctcacacagttctttccaagtggctctgggccccatctctccactgtcctgtaagctgtgcagaacctgctgctaacaccaaggtgtgaacatgccctgatgcctaaccaaagatgagttaaccaaaggaaaataacattaaaggagacttatgtgttaacgctttgtttctgctattcaaaaactgagagtggagatctgggataaagcaaggaaataataattactcctccttaaagcaaatgggggggtgagaagtcattaccaaatttaaagctagatgaggagttgccactgggcccagtaagatggaatttcagtgagatatggaccaccggagtcagcgagagtgactgaaacagaagcgatacctctcgctcccatgcccatcactacagaccccaagtcaagatgaatatcatagcctttacttcttcacagccaaagggagcccctgtgttgtctcaagtttttataaatacatttcataatgttattaaatgtcattctatttgaccagtggcctatttggtcacagttaattggtgttttcttattgcactgaattcaactccagacaccatacaaagggagatgatggccattccgttcaaatcctagatcgttacagcttcagggaattcatattttgttatgtgtaggatactcttaaaatgtaattcattaaacttttacaatctgaaagacagggtttttaactaacatgagaccaaaactatgttctttgattagttttagatagtataatcgggtttattaattcttctgtgtttcttcactagccagtccaagctacctatgcatttgacccaaccttatttattattgtacagatgaagcgaattgactccctttagccaactgctaatggatcgaatgtgctttttattgtaattcaacagctatagagagaaagataacttattgtgtgtttgatttcagggagagagattttctttggtcatccataatagagattgataagatttagcaactggtgttggagaaaaaaagaaaagcaaatgagtgttttcaggtttttttgcattatatgcatttatgtaatgtttctgttatcagcaatgtgcaattattttattgagaggaataaaaaagctttctatgagtttggtatggtgcgaggaaaatcttacagtttgaattatgacctagaaatttttcattcccatatctacctaagaaggaagcagtaaatccataatttaccttttgggcaatgctttgtgagcaaaacaaagtcacttctgccataacatcttgaatttaaccatatatgccagattactttatatgcatcaacaagatcaccagtgaagtttaatctagctaaacactggtcctgctcctgagatgggatcctatgtgtttggaaaacgtgataggcacacgaggatgagtggctttgtatcgcccagagaggtgcttgtccagatttcacatgcacatgaattgcctggggatcttgtgaaactgcagactctgctccaagtaatctgggctgggcctgagattctgcatttctaaggagtctcagggatgcctatgctgctggcctaaaaccacactcagaaacgaggacctagaagatccctaaaacagaataagaacaaatgtgattgtatttctgattctccctctcttcgaattatctgacttttttgtttttgtgcacatagtaatcatatcaccgctgcataacaacacagtgcatctttttaaaacaaggaaaagggaaaaaaaggagaaaaaacgatgcatcaagcttgtttgtcaaataccacagtattttattcattgttatcttgccaatggaaataaagtatgatattgcatttaaatattatatttatacctcatgtatatttttacctcaattgttgatatcaatcatcaattgtaaataaataattgccaaggcaaataaattt

SEQ ID NO: 20684 - DNA, 582 bp, Homo sapiens
  ENST00000491333
ccctttctaaaccctgcttggccatcgagagcgtgggatccaaagttcaattgcaagggttgggactcagctctgcctcccatgagctgcgaggcctcagcaattactgacttctttgtgcctttcctgctgttctggttgtttttgttgatgatgactctgggtgcgtgttcacacgaggaatgtggagcttacacagtgcttcccagctggctctttctatgtctgctcctccaatgacctggcatccacttttcctcagatgtctccaaagagcagcggctgcaggccgtgcaggctgccatcctgctactggccgatgagaacagggaggtcctgcagacgctcttgtgtttcctgaacgacgtcgtcaacttggtggaagagaatcagatgacgcccatgaacctggcagtgtgtctggccccctccctctttcatcttaatttattgaagaaagaaagctctccacgagtcatacagaagaaatatgccactgggaagccagatcaaaaggacctcaacgagaatctggcagcagctcaggggctagcgcacatgatcatggaatgcgacagactt

SEQ ID NO: 20685 - DNA, 2037 bp, Homo sapiens
  ENST00000567873
aataacctagcgcggcgtttctggtggccaggcatcccggtcctcgcgcgtggcgcagcctcccagcgccggaccgacccatgtcgcgcccgcattgggtcccgggaccccggcgggagtgccgcgtccgtcctttccagtcgccgggagtctgagtcgcgggccacgcgggagtggcggtggagagcccgccggtcgttatgaggacggatctaaaatgaccagcaaacggaaaccttgccaaacgcagctcaggagatccatcagtgagcagttgcgggactccacggccagagcctgggatctgctgtggaagaacgtccgggagaggcggctggcagaaattgaggcaaaagaagcatgtgactggctccgtgctgccgggttcccgcaatacgctcagttatatgaggattcacaatttcccatcaacattgtggctgtcaagaatgatcatgattttcttgaaaaggaccttgtagaacctctttgcagacgactaaatacgttgaacaagtgtgcctcaatgaaacttgatgtgaacttccaaaggaaaaagggtgacgactccgatgaggaagatctttgtatcagcaacaaatggactttccaaagaaccagtcgcaggtggtctcgtgtggacgacctctacacgctgctccctcgaggagacagaaatgggtcaccgggaggcacggggatgaggaacacgaccagcagtgagagcgtcctcacagacctgagcgagcctgaggtctgctccattcacagcgaaagcagtggaggcagcgacagtcgcagccagccgggccagtgctgtacagacaacccggtcatgctggatgccccactcgtcagcagcagcctcccacagccccccagagatgtcctcaaccaccccttccaccccaagaatgagaagcccacgagggctagggccaaatcatttttgaaacgcatggaaacactccgagggaagggagcccacgggaggcataaggggtctgggcggacaggtggcctggtgatcagtgggcccatgttgcagcaggagccagagtcctttaaggctatgcagtgcatccaaataccaaatggagatctccagaattcgccgccacctgcctgcagaaaagggctcccatgctctggcaagtcgagtggcgagagcagcccgtcggagcacagcagcagcggggtgagcacgccctgcctgaaggaacgcaagtgccacgaggccaacaagcgcgggggcatgtacttggaggacctagatgtgctggcggggacagcactgccggatgcaggggaccaaagccgtatgcatgaatttcactcccaagagaatttggtggtgcatattcccaaggatcacaaaccaggaacattccccaaggcactttctattgaaagcctctctcccacagatagtagcaatggggttaattggaggaccggtagcatctccctgggcagagagcaggtccctggtgccagggagccccggctcatggcgtcctgccacagagccagccgagtcagtatctatgacaatgtccctggctcccatctgtatgccagcacaggagatcttttggacttggagaaagatgaccttttccctcacttggatgacattctgcagcatgtcaatgggctccaagaggtagtcgatgactggtccaaagatgtcttgcctgaactgcaaactcatgatacattggttggggaacctggcttatccacctttccatctcctaatcagatcaccttagattttgaaggtaactctgtctcagaaggtcggacgacacccagtgatgtggaaagagatgtaacatctcttaatgaatctgagcctcctggggtcagagacaggagggattctggtgtaggggcctctctgaccaggccaaacaggcgactccgatggaacagtttccagctgtcgcaccagccccggccggccccagcatcgccccacatcagcagccagacggccagccagctgagcctgctccagcgcttctcactgct

SEQ ID NO: 20686 - DNA, 939 bp, Homo sapiens
  ENST00000487412
aaaaatcgctgggtctgttgagctgtcctgggctgggtgccttgctctttgactgagactggagacagacggcaacagccacaggcagactgaggtggcaataggaaatctgccgagatgttcagtcaggtgcccaggaccccagcctcaggctgctactacctaaattccatgacacctgagggccaggagatgtacttgcgatttgatcagactacaagacgctctccttacaggatgagccggattctagcacgccatcagctagtgactaaaattcaacaagaaattgaggcaaaagaagcatgtgactggctccgtgctgccgggttcccgcaatacgctcagttatatgaggattcacaatttcccatcaacattgtggctgtcaagaatgatcatgattttcttgaaaaggaccttgtagaacctctttgcagacgactaaatacgttgaacaagtgtgcctcaatgaaacttgatgtgaacttccaaaggaaaaagaagagaaaagggaccctttaaggattcgagatgaccttccctgcctctgtaagagtcaggtggaggagtattctcgagcttagctgcacgcctcactggaagactaacaacccagccaagagcatttcaggagacaggacaccagcacttctgccgcctgcagctcgggctctccactcccgcggcattcccagcggcccattcctgcttccaaacaggcaggcccggccacgtagctccagttaacgtctaaatttctatgtgactatggatgcgttgccttttgcagctgtggattcgtgtgggttcctgtttccagtgtaaagatatggccaaattccgtcttttgaaaaaagcccttctttatggaatgtctggttggcatctgtctctgaggaatatataatttcagtgaagaatgttctcatttttaga

SEQ ID NO: 20687 - DNA, 568 bp, Homo sapiens
  ENST00000498019
ttgactgagactggagacagacggcaacagccacaggcagactgaggtggcaataggaaatctgccgagatgttcagtcaggtgcccaggaccccagcctcaggctgctactacctaaattccatgacacctgagggccaggagatgtacttgcgatttgatcagactacaagacgctctccttacaggatgagccggattctagcacgccatcagctagtgactaaaattcaacaagaaattgaggcaaaagaagcatgtgactggctccgtgctgccgggttcccgcaatacgctcagttatatgaggattcacaatttcccatcaacattgtggctgtcaagaatgatcatgattttcttgaaaaggaccttgtagaacctctttgcaggtactcaggatgacttttatatgcctaagctttcaggaagaatgtgtaagaagatacaaaatcagggaggagattgaggggaagagagagactttatattcttgttattcacttctctatgtatatttcaggtgtttgtattgcattattaaaaacattagcaatgttttaaaaaa

SEQ ID NO: 20688 - DNA, 524 bp, Homo sapiens
  ENST00000344312
gagctgtcctgggctgggtgccttgctctttgactgagactggagacagacggcaacagccacaggcagactgaggtggcaataggaaatctgccgagatgttcagtcaggtgcccaggaccccagcctcaggctgctactacctaaattccatgacacctgagggccaggagatgtacttgcgatttgatcagactacaagacgctctccttacaggatgagccggattctagcacgccatcagctagtgactaaaattcaacaagataggaaagtctactgacctccttccctgaaaatttggatcctcatattagcattccattccacttgctgtacttttagttggaaggtctaaggcagacaaagctgcttaaatatttttatcactgacttcctagaagaaggaggaaaaaatcttggcaagaagaagggaaatcagtcttgcagaatatcttgaagaagcctgcgaaggaattccactgactgtgttcattatctattggtcccaatactgagtgga

SEQ ID NO: 20689 - DNA, 945 bp, Homo sapiens
  ENST00000439831
ctagcgcggcgtttctggtggccaggcatcccggtcctcgcgcgtggcgcagcctcccagcgccggaccgacccatgtcgcgcccgcattgggtcccgggaccccggcgggagtgccgcgtccgtcctttccagtcgccgggagtctgagtcgcgggccacgcgggagtggcggtggagagcccgccggtcgttatgaggacggatctaaaatgaccagcaaacggaaaccttgccaaacgcagctcaggagatccatcagtgagcagttgcgggactccacggccagagcctgggatctgctgtggaagaacgtccgggagaggcggctggcaggactatctcttgagctgggcagtgaccaccacatggggcagaagaaagttctagagaagaaggtctgatgcctagaaagaaggaaaggacaccactggtgaagcgggagatttaaccttctttgaactcctcccttttttccttacttgaactgtaaagcaagtggtttgctaggtgttctgcccttaaacccatgcacccacatcctcatcagcctgaaagcattctggggaagatgcccagaatctatagcaccttgagagaaggtcactagcaagctaaattagaagtggagattatggatgattccaacactcaatgttgtaagcatacaatgttcattccacattttctctccaacacagtggccacatttagtgtgcacctaagaaataaacagacttttttggtttggacccagaaataaattgtggtaacccagcagttttgactgttgatgtttaaaaacctgtacatgcactgtagacctcaattaataacaattagtaactttccctgttatcatgctaaattgtatattctacatgatggatggtgttagagaaatttttgtggtctagtaaacttttgttgcttcataacttcagaa

SEQ ID NO: 20690 - DNA, 695 bp, Homo sapiens
  ENST00000488088
ggtggccttccaggaggcgggaggcgcccgctgtcgaggcagctgagccccggcaaccgctgctctccgcctctcccctcgcggggccggctcatggagcgcagggaccgggctggctctcgccgagccccgggcctcttttagcctcgtccccagagagggaggagccggtgcccggcacagccccgccggccctagaagctccccacgcgccaccatgcctctgctggacgttttctggtcttgcttcaggaaggtgaagtgaaaagaccaaaacatctacatggagtcaagcccttcacctatctgagccacaacttgctagctgtgttgaccatgagaaagttacttcgcctttctcaaaagaagacatttatgccgccaaaagacacatgaaaaaatgctcatcatcactggccatcagagaaatgcaaatcaaaaccacagtgagataccatctcacaccagttagaatggcgatcattaaaaagtcaggaaacaacatcaggagagggtgtggagaaataggatcacttttacactgttggtgggactgtaaactagttcagccattgtggaagacagtgtggcgattcctcaaggatctagaagtagaaataccatttgacccagccatcccattactgggtatatacccaaaagattataaatcatgctgctaataaagacacatg

SEQ ID NO: 20691 - DNA, 4864 bp, Homo sapiens
  ENST00000523864
ggccttccaggaggcgggaggcgcccgctgtcgaggcagctgagccccggcaaccgctgctctccgcctctcccctcgcggggccggctcatggagcgcagggaccgggctggctctcgccgagccccgggcctcttttagcctcgtccccagagagggaggagccggtgcccggcacagccccgccggccctagaagctccccacgcgccaccatgcctctgctggacgttttctggtcttgcttcaggaaggtgaagtgcttcccattgctgcaggtgaagaagaacgctgaagccgaggccaaaagagcatgtgagtggcttcaagcaacaggattccctcagtatgtgcagctttttgaaggaggctgatgaccttgaataattgtgcctcgatgaaactggaggttcattttcaaagcaagcagaatgaagactcagaagaggaagagcagtgtaccatcagtagccactgggccttccagcaggaaagtaagtgctggtctcctatggggtcctctgatctgttggccccaccgagccctggcctgccagcgacctcaagctgtgagagcgtcctcaccgagcttagtgccacctctctgccagtcatcaccgtgagcctaccacccgagccagcagacttgcccttgccaggccgtgcccccagctcgagtgaccggcccctcctcagccccacccagggccaggagggtccccaggacaaagccaagaagcgccatcgtaaccgtagcttcctcaagcaccttgaatctctgaggcggaaggaaaagagtggcagccagcaagcagagcccaagcatagtccagccacctcagagaaggtctccaaagcctcatctttccgcagttgtcgtggcttcctctcagctggattttacagggccaagaactgggccgccacctcagccggtggcagtggtgccaatactcggaaggcctgggaggcctggcctgtggcctcgttccggcatcctcagtggacacaccggggtgattgcctggtgcacgttcctggggaccacaaaccaggcacattccctcgctccctgtccattgagagcctgtgtcctgaggatggacaccgcctggcagactggcagccaggtaggcggtggggctgtgaggggcgccggggctcctgtggctcaacgggcagccatgccagcacgtatgacaacttgcctgagctgtacccagctgagcctgtaatggttggggctgaggctgaagatgaagatgatgaggagagtgggggcagctatgctcacctagacgacatcctccagcacgtgtgggggctacagcaacgagtagagctgtggtctcgggccatgtacccagacctggggcctggagatgaggaagaggaggaggccacttcatcagtagaaatagccacagttgaggtcaaatgccaagctgaggctctcagccagatggaggttccggcccatggagagtccccagcctgggcccaggctgaagtccagccagcagtcctggctccggctcaggctccagctgaggctgaaccagtggcacaggaagaggctgaggccccggccccagccccggccccggccccagcccaggacagtgagcaggaggcacattcaggcggggaacccacctttgcctctagcctgtctgtggaagaaggacactccatttctgacactgtggcctcctccagcgaacttgacagtagtgggaactccatgaatgaggctgaggctgcggggcccctggctggactccaggcatcaatgccccgtgaacggcgcgattcaggtgttggggcctcacttaccagaccctgcaggaagctccgttggcatagcttccagaactcccatcgtcccagcctcaactcagagtcgctggagatcaaccggcagtttgcaggccagatcaacctcctgcacaagggctcactgctgcggcttaccgcgttcatggagaagtacactgtgccccacaagcagggctgggtctggtcaatgcccaagttcatgaggaggaacaagaccccagattaccggggacagcacgtatttggggtgccacccctcatccacgtgcagcgcacgggccagccactgccacagagcattcagcaagccatgcgctacttgcgcagccagtgcctggaccaagtaggcatcttccgcaagtctggggtcaagtccaggatccagaacctgcgtcaaatgaatgagacctcgcctgacaatgtctgctacgagggccagtcagcctacgacgtggctgacctgctaaagcagtatttccgggacctgcctgagcccatcttcaccagcaagctcaccaccactttcctccagatctaccagctcctccccaaggatcagtggttggcagcagcacaagccgccaccttgctgctccccgatgagaaccgagaggtgctacagaccctgctctacttcttaagtgacattgcctctgccgaggaaaaccagatgacagcaggcaacctggcagtgtgcctggcgccctccatcttccacctcaatgtctctaagaaggatagcccctctcccaggatcaagagcaaacgcagcctcattggcaggccaggccctagggacctgagtgacaacatggcagccacccagggcctgtcgcacatgatcagtgactgcaagaaacttttccaggtgccccaggacatggtgctgcagctgtgcagctcctacagcgcagctgagctcagccctcccggcccagccctggctgagctgcgtcaggcccaagctgcaggggtaagcctgagcctctacatggaagagaatatccaggacctgctgcgtgatgctgctgagcgcttcaagggctggatgagcgtgccagggccccagcacacggagctggcttgcaggaaggcaccggatgggcaccccctgcggctatggaaggcatccacagaggtggcagcccccccagctgtggtgctgcatcgtgttctccgggagcgggccctctgggatgaggatctgctgcgggcccaggtgctggaagccctgatgccgggtgtggagctgtaccactatgtcaccgacagcatggcaccccatccctgccgcgactttgtggtgcttcggatgtggcgctctgacctgcctcgtgggggttgcctgcttgtctcccagtccctggatccggaacaacctgtgccagagtcgggtgtgcgagccctcatgctcacatcccagtacctcatggagccttgcggcttgggccgctctcggctcacacacatctgccgggctgacctcaggggccgttctcctgactggtacaacaaagtctttggacacctgtgtgccatggaagtggcaaagatccgggactccttccccaccctgcaggcagcgggccctgagacaaagctgtgagccttgggctggtcccagggtggcaccacccaggccccctgggcaccaagggagcgagggggaataagagcagggcagccccctgggtgccgctgtcaggagcagagccaggcccaggtggctccagctgcctgtcctgtcccctttcctaaagctcctctgcacatagaggggagaaaaagagaatttaggcaactccactcccccttcacccccaaccctgtattctactctcccgaaaagagaagagaatcgcatgagtagcaagactgctgccaccagccacctgcttgtgaggccgccacttggcatgaagcctccacagctccccgcctgcaggggcaaagaggtcgacagcaatgtgtgatcccagctctctgccagactgagagggcaagccgtcttgtttgctgcaaggatgcttttgaggttggacaggaggttctggtcctgcctttggggccaacgctggctctgaagtgtctttttcagaggaattggactggagtgaatgggcacaggggtggagcgcagggcagccccagtcaccacgagctgtttcatttgtgtaaatacgatgctgaattttatgaggctgagttaagagtgggcactgacgggcccctaatatgtgacatgacgatttggcatagatagggatgtgagagtggagtaccttcctttctcaagtctcgagatgccagtgaaaccagtattccctgacttgggtttcacactttatcgaccaccccatggggtcctgtgtagcctttggccacgcactgacactgcccaggccaagcaaaagcagagtgtggttaagagacaagggtctatgtcatcatcccttttgcttatggtagtgggctaacataacagcccctttctcaagcagagacctggcccctgggccagccagatggaagggcctatcttagccagctggagcttaagccaaacctgttctgtcccactggccagccatctttgctcacatggaaattcaaatgccattcaaaggccactggtgctttatttttctatctgctgagtaaactgaaatgagatgggtcccaaccaccactgtaattttcaagcctattttatttgtacctgtaaatactgtacagctaatatatatatatatatatatatatgtgtgtgtgtgtgtgtgtgtatatgtgtttatagagatacacacacatatatatgtgtgtatatatatacacatacatatatatacacacacgcatttgcacagacacacacatatatcaattctcatgagtgtattataatctctggtgggggcaagtgtctggaaggcctgaggggcacttcagatgagaatggagaggtagggagccaggtgcagcaggatccctcaaatcaataaagcattaccagagatgcactttaa

SEQ ID NO: 20692 - DNA, 4841 bp, Homo sapiens
  ENST00000374599
agggaccgggctggctctcgccgagccccgggcctcttttagcctcgtccccagagagggaggagccggtgcccggcacagccccgccggccctagaagctccccacgcgccaccatgcctctgctggacgttttctggtcttgcttcaggaaggtgaagtgcttcccattgctgcaggtgaagaagaacgctgaagccgaggccaaaagagcatgtgagtggcttcaagcaacaggattccctcagtatgtgcagctttttgaagaaggttcgtttcccctggatattggctctgtgaagaaaaaccacggttttctggacgaggactctttgggggccctgtgtaggaggctgatgaccttgaataattgtgcctcgatgaaactggaggttcattttcaaagcaagcagaatgaagactcagaagaggaagagcagtgtaccatcagtagccactgggccttccagcaggaaagtaagtgctggtctcctatggggtcctctgatctgttggccccaccgagccctggcctgccagcgacctcaagctgtgagagcgtcctcaccgagcttagtgccacctctctgccagtcatcaccgtgagcctaccacccgagccagcagacttgcccttgccaggccgtgcccccagctcgagtgaccggcccctcctcagccccacccagggccaggagggtccccaggacaaagccaagaagcgccatcgtaaccgtagcttcctcaagcaccttgaatctctgaggcggaaggaaaagagtggcagccagcaagcagagcccaagcatagtccagccacctcagagaaggtctccaaagcctcatctttccgcagttgtcgtggcttcctctcagctggattttacagggccaagaactgggccgccacctcagccggtggcagtggtgccaatactcggaaggcctgggaggcctggcctgtggcctcgttccggcatcctcagtggacacaccggggtgattgcctggtgcacgttcctggggaccacaaaccaggcacattccctcgctccctgtccattgagagcctgtgtcctgaggatggacaccgcctggcagactggcagccaggtaggcggtggggctgtgaggggcgccggggctcctgtggctcaacgggcagccatgccagcacgtatgacaacttgcctgagctgtacccagctgagcctgtaatggttggggctgaggctgaagatgaagatgatgaggagagtgggggcagctatgctcacctagacgacatcctccagcacgtgtgggggctacagcaacgagtagagctgtggtctcgggccatgtacccagacctggggcctggagatgaggaagaggaggaggccacttcatcagtagaaatagccacagttgaggtcaaatgccaagctgaggctctcagccagatggaggttccggcccatggagagtccccagcctgggcccaggctgaagtccagccagcagtcctggctccggctcaggctccagctgaggctgaaccagtggcacaggaagaggctgaggccccggccccagccccggccccggccccagcccaggacagtgagcaggaggcacattcaggcggggaacccacctttgcctctagcctgtctgtggaagaaggacactccatttctgacactgtggcctcctccagcgaacttgacagtagtgggaactccatgaatgaggctgaggctgcggggcccctggctggactccaggcatcaatgccccgtgaacggcgcgattcaggtgttggggcctcacttaccagaccctgcaggaagctccgttggcatagcttccagaactcccatcgtcccagcctcaactcagagtcgctggagatcaaccggcagtttgcaggccagatcaacctcctgcacaagggctcactgctgcggcttaccgcgttcatggagaagtacactgtgccccacaagcagggctgggtctggtcaatgcccaagttcatgaggaggaacaagaccccagattaccggggacagcacgtatttggggtgccacccctcatccacgtgcagcgcacgggccagccactgccacagagcattcagcaagccatgcgctacttgcgcagccagtgcctggaccaagtaggcatcttccgcaagtctggggtcaagtccaggatccagaacctgcgtcaaatgaatgagacctcgcctgacaatgtctgctacgagggccagtcagcctacgacgtggctgacctgctaaagcagtatttccgggacctgcctgagcccatcttcaccagcaagctcaccaccactttcctccagatctaccagctcctccccaaggatcagtggttggcagcagcacaagccgccaccttgctgctccccgatgagaaccgagaggtgctacagaccctgctctacttcttaagtgacattgcctctgccgaggaaaaccagatgacagcaggcaacctggcagtgtgcctggcgccctccatcttccacctcaatgtctctaagaaggatagcccctctcccaggatcaagagcaaacgcagcctcattggcaggccaggccctagggacctgagtgacaacatggcagccacccagggcctgtcgcacatgatcagtgactgcaagaaacttttccaggtgccccaggacatggtgctgcagctgtgcagctcctacagcgcagctgagctcagccctcccggcccagccctggctgagctgcgtcaggcccaagctgcaggggtaagcctgagcctctacatggaagagaatatccaggacctgctgcgtgatgctgctgagcgcttcaagggctggatgagcgtgccagggccccagcacacggagctggcttgcaggaaggcaccggatgggcaccccctgcggctatggaaggcatccacagaggtggcagcccccccagctgtggtgctgcatcgtgttctccgggagcgggccctctgggatgaggatctgctgcgggcccaggtgctggaagccctgatgccgggtgtggagctgtaccactatgtcaccgacagcatggcaccccatccctgccgcgactttgtggtgcttcggatgtggcgctctgacctgcctcgtgggggttgcctgcttgtctcccagtccctggatccggaacaacctgtgccagagtcgggtgtgcgagccctcatgctcacatcccagtacctcatggagccttgcggcttgggccgctctcggctcacacacatctgccgggctgacctcaggggccgttctcctgactggtacaacaaagtctttggacacctgtgtgccatggaagtggcaaagatccgggactccttccccaccctgcaggcagcgggccctgagacaaagctgtgagccttgggctggtcccagggtggcaccacccaggccccctgggcaccaagggagcgagggggaataagagcagggcagccccctgggtgccgctgtcaggagcagagccaggcccaggtggctccagctgcctgtcctgtcccctttcctaaagctcctctgcacatagaggggagaaaaagagaatttaggcaactccactcccccttcacccccaaccctgtattctactctcccgaaaagagaagagaatcgcatgagtagcaagactgctgccaccagccacctgcttgtgaggccgccacttggcatgaagcctccacagctccccgcctgcaggggcaaagaggtcgacagcaatgtgtgatcccagctctctgccagactgagagggcaagccgtcttgtttgctgcaaggatgcttttgaggttggacaggaggttctggtcctgcctttggggccaacgctggctctgaagtgtctttttcagaggaattggactggagtgaatgggcacaggggtggagcgcagggcagccccagtcaccacgagctgtttcatttgtgtaaatacgatgctgaattttatgaggctgagttaagagtgggcactgacgggcccctaatatgtgacatgacgatttggcatagatagggatgtgagagtggagtaccttcctttctcaagtctcgagatgccagtgaaaccagtattccctgacttgggtttcacactttatcgaccaccccatggggtcctgtgtagcctttggccacgcactgacactgcccaggccaagcaaaagcagagtgtggttaagagacaagggtctatgtcatcatcccttttgcttatggtagtgggctaacataacagcccctttctcaagcagagacctggcccctgggccagccagatggaagggcctatcttagccagctggagcttaagccaaacctgttctgtcccactggccagccatctttgctcacatggaaattcaaatgccattcaaaggccactggtgctttatttttctatctgctgagtaaactgaaatgagatgggtcccaaccaccactgtaattttcaagcctattttatttgtacctgtaaatactgtacagctaatatatatatatatatatatatatgtgtgtgtgtgtgtgtgtgtatatgtgtttatagagatacacacacatatatatgtgtgtatatatatacacatacatatatatacacacacgcatttgcacagacacacacatatatcaattctcatgagtgtattataatctctggtgggggcaagtgtctggaaggcctgaggggcacttcagatgagaatggagaggtagggagccaggtgcagcaggatccctcaaatcaataaagcattaccagagatgca

SEQ ID NO: 20693 - DNA, 4820 bp, Homo sapiens
  ENST00000374597
ctcgggttgacaacggctaagcagccgcggcagctgctcttctggctggcaccgtcacccctgcccgaccccaggccccgcgtgtgtcccggacggagcagtccctcctgggctcgcctcctgcccgctcgctctgtgtcagcgcccgaacccaaaggggtggacgcggcctccagaagccgaggccaaaagagcatgtgagtggcttcaagcaacaggattccctcagtatgtgcagctttttgaagaaggttcgtttcccctggatattggctctgtgaagaaaaaccacggttttctggacgaggactctttgggggccctgtgtaggaggctgatgaccttgaataattgtgcctcgatgaaactggaggttcattttcaaagcaagcagaatgaagactcagaagaggaagagcagtgtaccatcagtagccactgggccttccagcaggaaagtaagtgctggtctcctatggggtcctctgatctgttggccccaccgagccctggcctgccagcgacctcaagctgtgagagcgtcctcaccgagcttagtgccacctctctgccagtcatcaccgtgagcctaccacccgagccagcagacttgcccttgccaggccgtgcccccagctcgagtgaccggcccctcctcagccccacccagggccaggagggtccccaggacaaagccaagaagcgccatcgtaaccgtagcttcctcaagcaccttgaatctctgaggcggaaggaaaagagtggcagccagcaagcagagcccaagcatagtccagccacctcagagaaggtctccaaagcctcatctttccgcagttgtcgtggcttcctctcagctggattttacagggccaagaactgggccgccacctcagccggtggcagtggtgccaatactcggaaggcctgggaggcctggcctgtggcctcgttccggcatcctcagtggacacaccggggtgattgcctggtgcacgttcctggggaccacaaaccaggcacattccctcgctccctgtccattgagagcctgtgtcctgaggatggacaccgcctggcagactggcagccaggtaggcggtggggctgtgaggggcgccggggctcctgtggctcaacgggcagccatgccagcacgtatgacaacttgcctgagctgtacccagctgagcctgtaatggttggggctgaggctgaagatgaagatgatgaggagagtgggggcagctatgctcacctagacgacatcctccagcacgtgtgggggctacagcaacgagtagagctgtggtctcgggccatgtacccagacctggggcctggagatgaggaagaggaggaggccacttcatcagtagaaatagccacagttgaggtcaaatgccaagctgaggctctcagccagatggaggttccggcccatggagagtccccagcctgggcccaggctgaagtccagccagcagtcctggctccggctcaggctccagctgaggctgaaccagtggcacaggaagaggctgaggccccggccccagccccggccccggccccagcccaggacagtgagcaggaggcacattcaggcggggaacccacctttgcctctagcctgtctgtggaagaaggacactccatttctgacactgtggcctcctccagcgaacttgacagtagtgggaactccatgaatgaggctgaggctgcggggcccctggctggactccaggcatcaatgccccgtgaacggcgcgattcaggtgttggggcctcacttaccagaccctgcaggaagctccgttggcatagcttccagaactcccatcgtcccagcctcaactcagagtcgctggagatcaaccggcagtttgcaggccagatcaacctcctgcacaagggctcactgctgcggcttaccgcgttcatggagaagtacactgtgccccacaagcagggctgggtctggtcaatgcccaagttcatgaggaggaacaagaccccagattaccggggacagcacgtatttggggtgccacccctcatccacgtgcagcgcacgggccagccactgccacagagcattcagcaagccatgcgctacttgcgcagccagtgcctggaccaagtaggcatcttccgcaagtctggggtcaagtccaggatccagaacctgcgtcaaatgaatgagacctcgcctgacaatgtctgctacgagggccagtcagcctacgacgtggctgacctgctaaagcagtatttccgggacctgcctgagcccatcttcaccagcaagctcaccaccactttcctccagatctaccagctcctccccaaggatcagtggttggcagcagcacaagccgccaccttgctgctccccgatgagaaccgagaggtgctacagaccctgctctacttcttaagtgacattgcctctgccgaggaaaaccagatgacagcaggcaacctggcagtgtgcctggcgccctccatcttccacctcaatgtctctaagaaggatagcccctctcccaggatcaagagcaaacgcagcctcattggcaggccaggccctagggacctgagtgacaacatggcagccacccagggcctgtcgcacatgatcagtgactgcaagaaacttttccaggtgccccaggacatggtgctgcagctgtgcagctcctacagcgcagctgagctcagccctcccggcccagccctggctgagctgcgtcaggcccaagctgcaggggtaagcctgagcctctacatggaagagaatatccaggacctgctgcgtgatgctgctgagcgcttcaagggctggatgagcgtgccagggccccagcacacggagctggcttgcaggaaggcaccggatgggcaccccctgcggctatggaaggcatccacagaggtggcagcccccccagctgtggtgctgcatcgtgttctccgggagcgggccctctgggatgaggatctgctgcgggcccaggtgctggaagccctgatgccgggtgtggagctgtaccactatgtcaccgacagcatggcaccccatccctgccgcgactttgtggtgcttcggatgtggcgctctgacctgcctcgtgggggttgcctgcttgtctcccagtccctggatccggaacaacctgtgccagagtcgggtgtgcgagccctcatgctcacatcccagtacctcatggagccttgcggcttgggccgctctcggctcacacacatctgccgggctgacctcaggggccgttctcctgactggtacaacaaagtctttggacacctgtgtgccatggaagtggcaaagatccgggactccttccccaccctgcaggcagcgggccctgagacaaagctgtgagccttgggctggtcccagggtggcaccacccaggccccctgggcaccaagggagcgagggggaataagagcagggcagccccctgggtgccgctgtcaggagcagagccaggcccaggtggctccagctgcctgtcctgtcccctttcctaaagctcctctgcacatagaggggagaaaaagagaatttaggcaactccactcccccttcacccccaaccctgtattctactctcccgaaaagagaagagaatcgcatgagtagcaagactgctgccaccagccacctgcttgtgaggccgccacttggcatgaagcctccacagctccccgcctgcaggggcaaagaggtcgacagcaatgtgtgatcccagctctctgccagactgagagggcaagccgtcttgtttgctgcaaggatgcttttgaggttggacaggaggttctggtcctgcctttggggccaacgctggctctgaagtgtctttttcagaggaattggactggagtgaatgggcacaggggtggagcgcagggcagccccagtcaccacgagctgtttcatttgtgtaaatacgatgctgaattttatgaggctgagttaagagtgggcactgacgggcccctaatatgtgacatgacgatttggcatagatagggatgtgagagtggagtaccttcctttctcaagtctcgagatgccagtgaaaccagtattccctgacttgggtttcacactttatcgaccaccccatggggtcctgtgtagcctttggccacgcactgacactgcccaggccaagcaaaagcagagtgtggttaagagacaagggtctatgtcatcatcccttttgcttatggtagtgggctaacataacagcccctttctcaagcagagacctggcccctgggccagccagatggaagggcctatcttagccagctggagcttaagccaaacctgttctgtcccactggccagccatctttgctcacatggaaattcaaatgccattcaaaggccactggtgctttatttttctatctgctgagtaaactgaaatgagatgggtcccaaccaccactgtaattttcaagcctattttatttgtacctgtaaatactgtacagctaatatatatatatatatatatatatgtgtgtgtgtgtgtgtgtgtatatgtgtttatagagatacacacacatatatatgtgtgtatatatatacacatacatatatatacacacacgcatttgcacagacacacacatatatcaattctcatgagtgtattataatctctggtgggggcaagtgtctggaaggcctgaggggcacttcagatgagaatggagaggtagggagccaggtgcagcaggatccctcaaatcaataaagcattaccagagat

SEQ ID NO: 20694 - DNA, 4862 bp, Homo sapiens
  ENST00000252336
ggccttccaggaggcgggaggcgcccgctgtcgaggcagctgagccccggcaaccgctgctctccgcctctcccctcgcggggccggctcatggagcgcagggaccgggctggctctcgccgagccccgggcctcttttagcctcgtccccagagagggaggagccggtgcccggcacagccccgccggccctagaagctccccacgcgccaccatgcctctgctggacgttttctggtcttgcttcaggaaggtgaagtgcttcccattgctgcaggtgaagaagaacgctgaagccgaggccaaaagagcatgtgagtggcttcaagcaacaggattccctcagtatgtgcagctttttgaaggaggctgatgaccttgaataattgtgcctcgatgaaactggaggttcattttcaaagcaagcagaatgaagactcagaagaggaagagcagtgtaccatcagtagccactgggccttccagcaggaaagtaagtgctggtctcctatggggtcctctgatctgttggccccaccgagccctggcctgccagcgacctcaagctgtgagagcgtcctcaccgagcttagtgccacctctctgccagtcatcaccgtgagcctaccacccgagccagcagacttgcccttgccaggccgtgcccccagctcgagtgaccggcccctcctcagccccacccagggccaggagggtccccaggacaaagccaagaagcgccatcgtaaccgtagcttcctcaagcaccttgaatctctgaggcggaaggaaaagagtggcagccagcaagcagagcccaagcatagtccagccacctcagagaaggtctccaaagcctcatctttccgcagttgtcgtggcttcctctcagctggattttacagggccaagaactgggccgccacctcagccggtggcagtggtgccaatactcggaaggcctgggaggcctggcctgtggcctcgttccggcatcctcagtggacacaccggggtgattgcctggtgcacgttcctggggaccacaaaccaggcacattccctcgctccctgtccattgagagcctgtgtcctgaggatggacaccgcctggcagactggcagccaggtaggcggtggggctgtgaggggcgccggggctcctgtggctcaacgggcagccatgccagcacgtatgacaacttgcctgagctgtacccagctgagcctgtaatggttggggctgaggctgaagatgaagatgatgaggagagtgggggcagctatgctcacctagacgacatcctccagcacgtgtgggggctacagcaacgagtagagctgtggtctcgggccatgtacccagacctggggcctggagatgaggaagaggaggaggccacttcatcagtagaaatagccacagttgaggtcaaatgccaagctgaggctctcagccagatggaggttccggcccatggagagtccccagcctgggcccaggctgaagtccagccagcagtcctggctccggctcaggctccagctgaggctgaaccagtggcacaggaagaggctgaggccccggccccagccccggccccggccccagcccaggacagtgagcaggaggcacattcaggcggggaacccacctttgcctctagcctgtctgtggaagaaggacactccatttctgacactgtggcctcctccagcgaacttgacagtagtgggaactccatgaatgaggctgaggctgcggggcccctggctggactccaggcatcaatgccccgtgaacggcgcgattcaggtgttggggcctcacttaccagaccctgcaggaagctccgttggcatagcttccagaactcccatcgtcccagcctcaactcagagtcgctggagatcaaccggcagtttgcaggccagatcaacctcctgcacaagggctcactgctgcggcttaccgcgttcatggagaagtacactgtgccccacaagcagggctgggtctggtcaatgcccaagttcatgaggaggaacaagaccccagattaccggggacagcacgtatttggggtgccacccctcatccacgtgcagcgcacgggccagccactgccacagagcattcagcaagccatgcgctacttgcgcagccagtgcctggaccaagtaggcatcttccgcaagtctggggtcaagtccaggatccagaacctgcgtcaaatgaatgagacctcgcctgacaatgtctgctacgagggccagtcagcctacgacgtggctgacctgctaaagcagtatttccgggacctgcctgagcccatcttcaccagcaagctcaccaccactttcctccagatctaccagctcctccccaaggatcagtggttggcagcagcacaagccgccaccttgctgctccccgatgagaaccgagaggtgctacagaccctgctctacttcttaagtgacattgcctctgccgaggaaaaccagatgacagcaggcaacctggcagtgtgcctggcgccctccatcttccacctcaatgtctctaagaaggatagcccctctcccaggatcaagagcaaacgcagcctcattggcaggccaggccctagggacctgagtgacaacatggcagccacccagggcctgtcgcacatgatcagtgactgcaagaaacttttccaggtgccccaggacatggtgctgcagctgtgcagctcctacagcgcagctgagctcagccctcccggcccagccctggctgagctgcgtcaggcccaagctgcaggggtaagcctgagcctctacatggaagagaatatccaggacctgctgcgtgatgctgctgagcgcttcaagggctggatgagcgtgccagggccccagcacacggagctggcttgcaggaaggcaccggatgggcaccccctgcggctatggaaggcatccacagaggtggcagcccccccagctgtggtgctgcatcgtgttctccgggagcgggccctctgggatgaggatctgctgcgggcccaggtgctggaagccctgatgccgggtgtggagctgtaccactatgtcaccgacagcatggcaccccatccctgccgcgactttgtggtgcttcggatgtggcgctctgacctgcctcgtgggggttgcctgcttgtctcccagtccctggatccggaacaacctgtgccagagtcgggtgtgcgagccctcatgctcacatcccagtacctcatggagccttgcggcttgggccgctctcggctcacacacatctgccgggctgacctcaggggccgttctcctgactggtacaacaaagtctttggacacctgtgtgccatggaagtggcaaagatccgggactccttccccaccctgcaggcagcgggccctgagacaaagctgtgagccttgggctggtcccagggtggcaccacccaggccccctgggcaccaagggagcgagggggaataagagcagggcagccccctgggtgccgctgtcaggagcagagccaggcccaggtggctccagctgcctgtcctgtcccctttcctaaagctcctctgcacatagaggggagaaaaagagaatttaggcaactccactcccccttcacccccaaccctgtattctactctcccgaaaagagaagagaatcgcatgagtagcaagactgctgccaccagccacctgcttgtgaggccgccacttggcatgaagcctccacagctccccgcctgcaggggcaaagaggtcgacagcaatgtgtgatcccagctctctgccagactgagagggcaagccgtcttgtttgctgcaaggatgcttttgaggttggacaggaggttctggtcctgcctttggggccaacgctggctctgaagtgtctttttcagaggaattggactggagtgaatgggcacaggggtggagcgcagggcagccccagtcaccacgagctgtttcatttgtgtaaatacgatgctgaattttatgaggctgagttaagagtgggcactgacgggcccctaatatgtgacatgacgatttggcatagatagggatgtgagagtggagtaccttcctttctcaagtctcgagatgccagtgaaaccagtattccctgacttgggtttcacactttatcgaccaccccatggggtcctgtgtagcctttggccacgcactgacactgcccaggccaagcaaaagcagagtgtggttaagagacaagggtctatgtcatcatcccttttgcttatggtagtgggctaacataacagcccctttctcaagcagagacctggcccctgggccagccagatggaagggcctatcttagccagctggagcttaagccaaacctgttctgtcccactggccagccatctttgctcacatggaaattcaaatgccattcaaaggccactggtgctttatttttctatctgctgagtaaactgaaatgagatgggtcccaaccaccactgtaattttcaagcctattttatttgtacctgtaaatactgtacagctaatatatatatatatatatatatatgtgtgtgtgtgtgtgtgtgtatatgtgtttatagagatacacacacatatatatgtgtgtatatatatacacatacatatatatacacacacgcatttgcacagacacacacatatatcaattctcatgagtgtattataatctctggtgggggcaagtgtctggaaggcctgaggggcacttcagatgagaatggagaggtagggagccaggtgcagcaggatccctcaaatcaataaagcattaccagagatgcacttt

SEQ ID NO: 20695 - DNA, 3278 bp, Homo sapiens
  ENST00000556539
tagctggcctgcttttagtccaaaggaacaggggttgggggaagttcccagggcttgagaggtcttgaagccaaacaggggttccagggacactagggtgcccactctggcattttctctccttcccttcaattcacagactctggtggagcaacgttcaggtggttcaggaaagggcagcaataaggggccactaggtgtgacagaggaactgcacatcatcagcttcacggtcaaatatacctaccagggtctgaagcaggagctgaaaacggacaccctccctgtggtgattatttccaacatgaaccagctctcaattgcctgggcttcagttctctggttcaatttgctcagcccaaaccttcagaaccagcagttcttctccaacccccccaaggccccctggagcttgctgggccctgctctcagttggcagttctcctcctatgttggccgaggcctcaactcagaccagctgagcatgctgagaaacaagctgttcgggcagaactgtaggactgaggatccattattgtcctgggctgacttcactaagcgagagagccctcctggcaagttaccattctggacatggctggacaaaattctggagttggtacatgaccacctgaaggatctctggaatgatggacgcatcatgggctttgtgagtcggagccaggagcgccggctgctgaagaagaccatgtctggcacctttctactgcgcttcagtgaatcgtcagaagggggcattacctgctcctgggtggagcaccaggatgatgacaaggtgctcatctactctgtgcaaccgtacacgaaggaggtgctgcagtcactcccgctgactgaaatcatccgccattaccagttgctcactgaggagaatatacctgaaaacccactgcgcttcctctatccccgaatcccccgggatgaagcttttgggtgctactaccaggagaaagttaatctccaggaacggaggaaatacctgaaacacaggctcattgtggtctctaatagacaggtggatgaactgcaacaaccgctggagcttaagccagagccagagctggagtcattagagctggaactagggctggtgccagagccagagctcagcctggacttagagccactgctgaaggcagggctggatctggggccagagctagagtctgtgctggagtccactctggagcctgtgatagagcccacactatgcatggtatcacaaacagtgccagagccagaccaaggacctgtatcacagccagtgccagagccagatttgccctgtgatctgagacatttgaacactgagccaatggaaatcttcagaaactgtgtaaagattgaagaaatcatgccgaatggtgacccactgttggctggccagaacaccgtggatgaggtttacgtctcccgccccagccacttctacactgatggacccttgatgccttctgacttctaggaaccacatttcctctgttcttttcatatctcttgcccttcctactcctcatagcatgatattgttctccaaggatgggaatcaggcatgtgtcccttccaagctgtgttaactgttcaaactcaggcctgtgtgactccattggggtgagaggtgaaagcataacatgggtacagaggggacaacaatgaatcagaacagatgctgagccataggtctaaataggatcctggaggctgcctgctgtgctgggaggtataggggtcctgggggcaggccagggcagttgacaggtacttggagggctcagggcagtggcttctttccagtatggaaggatttcaacattttaatagttggttaggctaaactggtgcatactggcattggcccttggtggggagcacagacacaggataggactccatttctttcttccattccttcatgtctaggataacttgctttcttctttcctttactcctggctcaagccctgaatttcttcttttcctgcaggggttgagagctttctgccttagcctaccatgtgaaactctaccctgaagaaagggatggataggaagtagacctctttttcttaccagtctcctcccctactctgcccctaagctggctgtacctgttcctcccccataaaatgatcctgccaatctaatgtgagtgtgaagctttgcacactagtttatgctacctagtctccactttctcaatgcttaggagacagatcactcctggaggctggggatggtaggattgctggggatttttttttttttaaacagggtctcactctgttgcccaggctagagtgcaatggtgcaatcacagctcactgcagcctcaacctcctgggttcaagcaatcctcctacctcagcctcctgggtagctagcaccatggcatgcgccaccatgccctattttttttttttaaagacagggtcttgctatattgcccaggctggtcttgaactgggctcaagtgatcctcacgccttggcctcccaaagtgctgggattataggcatgagccactgtgcttggccaggatttttttttttttttttttgagatggagtttctctcttgttgtccaggctggagtgcaatggtgtgatctcggctcactgcaacctccgccttccgggttcaagtgactctcctgcctcagcctccccagtagctgggattacagatctgcaccaccatgcccagctaattttgtatttttagtagagacggggtttctccatgttggtcaggctggtctcgaactcctgacctcaagtgatctgtccacctcggcctcccagagtgctgggattacaggcgtgagccactgttcccagcaggaatttcttttttatagtattggataaagtttggtgtttttacagaggagaagcaatgggtcttagctctttctctattatgttatcatcctcccttttttgtacaatatgttgtttacctgaaaggaaggtttctattcgttggttgtggacctggacaaagtccaagtctgtggaacttaaaaccttgaaggtctgtcataggactctggacaatctcacaccttagctattcccagggaaccccagggggcaactgacattgctccaagatgttctcctgatgtagcttgagatataaaggaaaggccctgcacaggtggctgtttcttgtctgttatgtcagaggaacagtcctgttcagaaaggggctcttctgagcagaaatggctaataaactttgtgctgatctggaaa

SEQ ID NO: 20696 - DNA, 3259 bp, Homo sapiens
  ENST00000314128
actgcaaccctaatcagagcccaaatggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcagcccttttcccaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggagaagctggtaaaatccatcagccaactgaaagaccagcaggatgtcttctgcttccgatataagatccaggccaaagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggaatcctcctcaattacaaggcttccggaagttcaacattctgacttcaaaccagaaaactttgacccccgagaaggggcagagtcagggtttgatttgggactttggttacctgactctggtggagcaacgttcaggtggttcaggaaagggcagcaataaggggccactaggtgtgacagaggaactgcacatcatcagcttcacggtcaaatatacctaccagggtctgaagcaggagctgaaaacggacaccctccctgtggtgattatttccaacatgaaccagctctcaattgcctgggcttcagttctctggttcaatttgctcagcccaaaccttcagaaccagcagttcttctccaacccccccaaggccccctggagcttgctgggccctgctctcagttggcagttctcctcctatgttggccgaggcctcaactcagaccagctgagcatgctgagaaacaagctgttcgggcagaactgtaggactgaggatccattattgtcctgggctgacttcactaagcgagagagccctcctggcaagttaccattctggacatggctggacaaaattctggagttggtacatgaccacctgaaggatctctggaatgatggacgcatcatgggctttgtgagtcggagccaggagcgccggctgctgaagaagaccatgtctggcacctttctactgcgcttcagtgaatcgtcagaagggggcattacctgctcctgggtggagcaccaggatgatgacaaggtgctcatctactctgtgcaaccgtacacgaaggaggtgctgcagtcactcccgctgactgaaatcatccgccattaccagttgctcactgaggagaatatacctgaaaacccactgcgcttcctctatccccgaatcccccgggatgaagcttttgggtgctactaccaggagaaagttaatctccaggaacggaggaaatacctgaaacacaggctcattgtggtctctaatagacaggtggatgaactgcaacaaccgctggagcttaagccagagccagagctggagtcattagagctggaactagggctggtgccagagccagagctcagcctggacttagagccactgctgaaggcagggctggatctggggccagagctagagtctgtgctggagtccactctggagcctgtgatagagcccacactatgcatggtatcacaaacagtgccagagccagaccaaggacctgtatcacagccagtgccagagccagatttgccctgtgatctgagacatttgaacactgagccaatggaaatcttcagaaactgtgtaaagattgaagaaatcatgccgaatggtgacccactgttggctggccagaacaccgtggatgaggtttacgtctcccgccccagccacttctacactgatggacccttgatgccttctgacttctaggaaccacatttcctctgttcttttcatatctcttgcccttcctactcctcatagcatgatattgttctccaaggatgggaatcaggcatgtgtcccttccaagctgtgttaactgttcaaactcaggcctgtgtgactccattggggtgagaggtgaaagcataacatgggtacagaggggacaacaatgaatcagaacagatgctgagccataggtctaaataggatcctggaggctgcctgctgtgctgggaggtataggggtcctgggggcaggccagggcagttgacaggtacttggagggctcagggcagtggcttctttccagtatggaaggatttcaacattttaatagttggttaggctaaactggtgcatactggcattggcccttggtggggagcacagacacaggataggactccatttctttcttccattccttcatgtctaggataacttgctttcttctttcctttactcctggctcaagccctgaatttcttcttttcctgcaggggttgagagctttctgccttagcctaccatgtgaaactctaccctgaagaaagggatggataggaagtagacctctttttcttaccagtctcctcccctactctgcccctaagctggctgtacctgttcctcccccataaaatgatcctgccaatctaa

SEQ ID NO: 20697 - DNA, 3073 bp, Homo sapiens
  ENST00000557235
agctcatactagggacgggaagtcgcgaccagagccattggagggcgcggggactgcaaccctaatcagagcccaaatggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggagaagctggtaaaatccatcagccaactgaaagaccagcaggatgtcttctgcttccgatataagatccaggccaaagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggaatcctcctcaattacaaggcttccggaagttcaacattctgacttcaaaccagaaaactttgacccccgagaaggggcagagtcagggtttgatttgggactttggttacctgactctggtggagcaacgttcaggtggttcaggaaagggcagcaataaggggccactaggtgtgacagaggaactgcacatcatcagcttcacggtcaaatatacctaccagggtctgaagcaggagctgaaaacggacaccctccctgtggtgattatttccaacatgaaccagctctcaattgcctgggcttcagttctctggttcaatttgctcagcccaaaccttcagaaccagcagttcttctccaacccccccaaggccccctggagcttgctgggccctgctctcagttggcagttctcctcctatgttggccgaggcctcaactcagaccagctgagcatgctgagaaacaagctgttcgggcagaactgtaggactgaggatccattattgtcctgggctgacttcactaagcgagagagccctcctggcaagttaccattctggacatggctggacaaaattctggagttggtacatgaccacctgaaggatctctggaatgatggacgcatcatgggctttgtgagtcggagccaggagcgccggctgctgaagaagaccatgtctggcacctttctactgcgcttcagtgaatcgtcagaagggggcattacctgctcctgggtggagcaccaggatgatgacaaggtgctcatctactctgtgcaaccgtacacgaaggaggtgctgcagtcactcccgctgactgaaatcatccgccattaccagttgctcactgaggagaatatacctgaaaacccactgcgcttcctctatccccgaatcccccgggatgaagcttttgggtgctactaccaggagaaagttaatctccaggaacggaggaaatacctgaaacacaggctcattgtggtctctaatagacaggtggatgaactgcaacaaccgctggagcttaagccagagccagagctggagtcattagagctggaactagggctggtgccagagccagagctcagcctggacttagagccactgctgaaggcagggctggatctggggccagagctagagtctgtgctggagtccactctggagcctgtgatagagcccacactatgcatggtatcacaaacagtgccagagccagaccaaggacctgtatcacagccagtgccagagccagatttgccctgtgatctgagacatttgaacactgagccaatggaaatcttcagaaactgtgtaaagattgaagaaatcatgccgaatggtgacccactgttggctggccagaacaccgtggatgaggtttacgtctcccgccccagccacttctacactgatggacccttgatgccttctgacttctaggaaccacatttcctctgttcttttcatatctcttgcccttcctactcctcatagcatgatattgttctccaaggatgggaatcaggcatgtgtcccttccaagctgtgttaactgttcaaactcaggcctgtgtgactccattggggtgagaggtgaaagcataacatgggtacagaggggacaacaatgaatcagaacagatgctgagccataggtctaaataggatcctggaggctgcctgctgtgctgggaggtataggggtcctgggggcaggccagggcagttgacaggtacttggagggctcagggcagtggcttctttccagtatggaaggatttcaacattttaatagttggttaggctaaactggtgcatactggcattggcccttggtggggagcacagacacaggataggactccatttctttcttccattccttcatgtct

SEQ ID NO: 20698 - DNA, 536 bp, Homo sapiens
  ENST00000555488
atcgtcagaagggggcattacctgctcctgggtggagcaccaggatgatggtcagctgctctgccctgccattcccacagcctctcctttctgcctggctcccctcttgcccctctgcctgcccttggcttccctggctctgaactgaatccctcagctggtttgggactgggcagccagagcagagagctccaaggcccggcctcttccctcaagcccgcctgttcctgcattcactctccagacaaggtgctcatctactctgtgcaaccgtacacgaaggaggtgctgcagtcactcccgctgactgaaatcatccgccattaccagttgctcactgaggagaatatacctgaaaacccactgcgcttcctctatccccgaatcccccgggatgaagcttttgggtgctactaccaggagaaagttaatctccaggaacggaggaaatacctgaaacacaggctcattgtggtctctaatagacaggtggatgaactgcaacaaccgctggagcttaagccagagccagagct

SEQ ID NO: 20699 - DNA, 662 bp, Homo sapiens
  ENST00000557199
cttttctctcagcctttccccagccttagtcttttctgtccctctgtcctatctatcccaggacccctggcttccctcatcatctgtctgtggctatctgtcccacagggcagaactgtaggactgaggatccattattgtcctgggctgacttcactaaggtaactccctgaatcctgtggagctgctggatctagcccacattccaaatactggccttcccacgtccctccttccctacaccagaggcaactcctcagcttttgctacctttccattcctcctccagcgagagagccctcctggcaagttaccattctggacatggctggacaaaattctggagttggtacatgaccacctgaaggatctctggaatgatggacgcatcatgggctttgtgagtcggagccaggagcgccggctgctgaagaagaccatgtctggcacctttctactgcgcttcagtgaatcgtcagaagggggcattacctgctcctgggtggagcaccaggatgatggtcagctgctctgccctgccattcccacagcctctcctttctgcctggctcccctcttgcccctctgcctgcccttggcttccctggctctgaactgaatccctcagctggtttgggactgggcagccagagcagagagct

SEQ ID NO: 20700 - DNA, 1548 bp, Homo sapiens
  ENST00000418572
agctcatactagggacgggaagtcgcgaccagagccattggagggcgcggggactgcaaccctaatcagagcccaaatggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggagaagctggtaaaatccatcagccaactgaaagaccagcaggatgtcttctgcttccgatataagatccaggccaaagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggaatcctcctcaattacaaggcttccggaagttcaacattctgacttcaaaccagaaaactttgacccccgagaaggggcagagtcagggtttgatttgggactttggttacctgactctggtggagcaacgttcaggtggttcaggaaagggcagcaataaggggccactaggtgtgacagaggaactgcacatcatcagcttcacggtcaaatatacctaccagggtctgaagcaggagctgaaagtgagtgaaaatggagggcaaggagagagaaagcagctttggaagaaggcataagaaggggataaacagaagcctcttgggaaccagcagttcttctccaacccccccaaggccccctggagcttgctgggccctgctctcag

SEQ ID NO: 20701 - DNA, 588 bp, Homo sapiens
  ENST00000555519
cagagctcccattgaccacgggttggaacagctggagacatgagcctttgtggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggaatcctcctcaattacaagggtaggtgcttgacaaggacactgcaaacatctgtacagtgtatgacctgcagaaccacattcggcagccctggtggcacaaacaaggaagagggggatttgggatatggacaaagggagatggcgagatctgaaatgaagtggaacttctgtttttttttttctgctgagtttttagaataattccattccttgtctccatgtatcttcctcctggaacagcttccggaagttcaacattctgacttcaaaccagaaaactttgacccccgagaaggggcagagtcagggtttgatttgggactttggttacctgactctggtggagcaacgttcaggtggttcaggaaagggcagcaataaggggccacta

SEQ ID NO: 20702 - DNA, 717 bp, Homo sapiens
  ENST00000557252
ggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggaatcctcctcaattacaagggtaggtgcttgacaaggacactgcaaacatctgtacagtgtatgacctgcagaaccacattcggcagccctggtggcacaaacaaggaagagggggatttgggatatggacaaagggagatggcgagatctgaaatgaagtggaacttctgtttttttttttctgctgagtttttagaataattccattccttgtctccatgtatcttcctcctggaacagcttccggaagttcaacattctgacttcaaaccagaaaactttgacccccgagaaggggcagagtcagggtttgatttgggactttggttacctggtaagaatagtttgtgacctatgcttttattactatttttatttttttgagacggagtctcactctgtcccccaggctggagtgcagtggtgccatcttggctcacagcaacctccgcctcccgggttcaagcaattcttctgtctcagcctcctgagtagctgagactataggcacacaccaccatgcccggctaatttttgtatttttagtagagatagggtttcaccatattgg

SEQ ID NO: 20703 - DNA, 1454 bp, Homo sapiens
  ENST00000556140
tctagtacccgagctcatactagggacgggaagtcgcgaccagagccattggagggcgcggggactgcaaccctaatcagagcccaaatggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcagcccttttcccaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggagaagctggtaaaatccatcagccaactgaaagaccagcaggatgtcttctgcttccgatataagatccaggccaaaggtaggaagcacattgaggggctggagaaagataagtgcctgctgagaagccggagctggaagtgaacaggagaaagctccgatgagcagtagtcactgtcagacacaccccactgactacagtcctgctgccgtgcaaagctggaagtgctttgtggaggctgagctggaggtgcagctgagagacagtaaatgttgaggaaatgcatggaaaactaacagtgttttatttgagggggtgtctggtccaagcatgaccattcagaatttgcctgagggtcccacaggtgcctgtgctttgcttggtttccctttcttcctccacaaaattcctccttcctgactctgactgagaccccagtcaggaaggagaggaaagaacccctggactgactcctgttcccaccatccagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtag

SEQ ID NO: 20704 - DNA, 539 bp, Homo sapiens
  ENST00000557156
accatccagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggtgagaggtaccaccccaaccctcgtcctcgccatgcgctgtgatttgttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacaggtctagaggccaggcaggaaccctgggggaaagaaggaacaagggaagccattcttacagatactgagctatatattctctccacacct

SEQ ID NO: 20705 - DNA, 1063 bp, Homo sapiens
  ENST00000557417
gtaggcggggcgcgaggttctagtacccgagctcatactagggacgggaagtcgcgaccagagccattggagggcgcggggactgcaaccctaatcagagcccaaatggcgcagtgggaaatgctgcagaatcttgacagcccctttcaggatcagctgaactatgagtgtggccgttgcagccaggacccagagtccttgttgctgcagcacaatttgcggaaattctgccgggacattcagcccttttcccaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggagaagctggtaaaatccatcagccaactgaaagaccagcaggatgtcttctgcttccgatataagatccaggccaaaggtaggaagcacattgaggggctggagaaagataagtgcctgctgagaagccggagctggaagtgaacaggagaaagctccgatgagcagtagtcactgtcagacacaccccactgactacagtcctgctgccgtgcaaagctggaagtgctttgtggaggctgagctggaggtgcagctgagagacagtaaatgttgaggaaatgcatggaaaactaacagtgttttatttgagggggtgtctggtccaagcatgaccattcagaatttgcctgagggtcccacaggtgcctgtgctttgcttggtttccctttcttcctccacaaaattcctccttcctgactctgactgagaccccagtcaggaaggagaggaaagaacccctggactgactcctgttcccaccatccagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactg

SEQ ID NO: 20706 - DNA, 603 bp, Homo sapiens
  ENST00000555646
aagtcgcgaccagagccattggagggcgcggggactgcaaccctaatcagagcccaaatggcgcagtgggaaatgctgcagaatcttgacagcccctttcaggatcagctgcaccagctttactcgcacagcctcctgcctgtggacattcgacagtacttggctgtctggattgaagaccagaactggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcagcccttttcccaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggagaagctggtaaaatccatcagccaactgaaagaccagcaggatgtcttctgcttccgatataagatccaggccaaaggta

SEQ ID NO: 20707 - DNA, 4301 bp, Homo sapiens
  ENST00000345506
agacaggatattcactgctgtggcaaggcctgtagagagtttcgaagttaggaggactcaagacggtccctccctggacttttctgaaggggctcaaaagatgacacgcgccagagctggaaggcgtcgccaattggtccacttttccctcctccctttttgcggatgagaaaactgaggcccaggtttgggatttccagagcccgggatttcccggcaacgcccgacaaccacattcccccggctattctgacccgccccggttccgggacgctccctgggagccgccgccgagggcctgctgggactcccgggggaccccgccgtcggggcagcccccacgcccggcgccgcccgccgggaacggccgccgctgttgcgcacttgcaggggagccggcgactgagggcgaggcagggagggagcaagcggggctgggagggctgctggcgcgggctcgcgcgctgtgtatggtctatcgcaggcagctgacctttgaggaggaaatcgctgctctccgctccttcctgtagtaacagccgccgctgccgccgccgccaggaaccccggccgggagcgagagccgcggggcgcagagccggcccggctgccggacggtgcggccccaccaggtgaacggccatggcgggctggatccaggcccagcagctgcagggagacgcgctgcgccagatgcaggtgctgtacggccagcacttccccatcgaggtccggcactacttggcccagtggattgagagccagccatgggatgccattgacttggacaatccccaggacagagcccaagccacccagctcctggagggcctggtgcaggagctgcagaagaaggcggagcaccaggtgggggaagatgggtttttactgaagatcaagctggggcactacgccacgcagctccagaaaacatatgaccgctgccccctggagctggtccgctgcatccggcacattctgtacaatgaacagaggctggtccgagaagccaacaattgcagctctccggctgggatcctggttgacgccatgtcccagaagcaccttcagatcaaccagacatttgaggagctgcgactggtcacgcaggacacagagaatgagctgaagaaactgcagcagactcaggagtacttcatcatccagtaccaggagagcctgaggatccaagctcagtttgcccagctggcccagctgagcccccaggagcgtctgagccgggagacggccctccagcagaagcaggtgtctctggaggcctggttgcagcgtgaggcacagacactgcagcagtaccgcgtggagctggccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctggtgtgagaagttggccgagatcatctggcagaaccggcagcagatccgcagggctgagcacctctgccagcagctgcccatccccggcccagtggaggagatgctggccgaggtcaacgccaccatcacggacattatctcagccctggtgaccagcacattcatcattgagaagcagcctcctcaggtcctgaagacccagaccaagtttgcagccaccgtacgcctgctggtgggcgggaagctgaacgtgcacatgaatcccccccaggtgaaggccaccatcatcagtgagcagcaggccaagtctctgcttaaaaatgagaacacccgcaacgagtgcagtggtgagatcctgaacaactgctgcgtgatggagtaccaccaagccacgggcaccctcagtgcccacttcaggaacatgtcactgaagaggatcaagcgtgctgaccggcggggtgcagagtccgtgacagaggagaagttcacagtcctgtttgagtctcagttcagtgttggcagcaatgagcttgtgttccaggtgaagactctgtccctacctgtggttgtcatcgtccacggcagccaggaccacaatgccacggctactgtgctgtgggacaatgcctttgctgagccgggcagggtgccatttgccgtgcctgacaaagtgctgtggccgcagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtccgtgtcctggtcccagttcaacagggagaacttgccgggctggaactacaccttctggcagtggtttgacggggtgatggaggtgttgaagaagcaccacaagccccactggaatgatggggccatcctaggttttgtgaataagcaacaggcccacgacctgctcatcaacaagcccgacgggaccttcttgttgcgctttagtgactcagaaatcgggggcatcaccatcgcctggaagtttgactccccggaacgcaacctgtggaacctgaaaccattcaccacgcgggatttctccatcaggtccctggctgaccggctgggggacctgagctatctcatctatgtgtttcctgaccgccccaaggatgaggtcttctccaagtactacactcctgtgctggctaaagctgttgatggatatgtgaaaccacagatcaagcaagtggtccctgagtttgtgaatgcatctgcagatgctgggggcagcagcgccacgtacatggaccaggccccctccccagctgtgtgcccccaggctccctataacatgtacccacagaaccctgaccatgtactcgatcaggatggagaattcgacctggatgagaccatggatgtggccaggcacgtggaggaactcttacgccgaccaatggacagtcttgactcccgcctctcgccccctgccggtcttttcacctctgccagaggctccctctcatgaatgtttgaatcccacgcttctctttggaaacaatatgcaatgtgaagcggtcgtgttgtgagtttagtaaggctgtgtacactgacacctttgcaggcatgcatgtgcttgtgtgtgtgtgtgtgtgtgtgtccttgtgcatgagctacgcctgcctcccctgtgcagtcctgggatgtggctgcagcagcggtggcctcttttcagatcatggcatccaagagtgcgccgagtctgtctctgtcatggtagagaccgagcctctgtcactgcaggcactcaatgcagccagacctattcctcctgggcccctcatctgctcagcagctatttgaatgagatgattcagaaggggaggggagacaggtaacgtctgtaagctgaagtttcactccggagtgagaagctttgccctcctaagagagagagacagagagacagagagagagaaagagagagtgtgtgggtctatgtaaatgcatctgtcctcatgtgttgatgtaaccgattcatctctcagaagggaggctggggttcattttcgagtagtattttatactttagtgaacgtggactccagactctctgtgaaccctatgagagcgcgtctgggcccggccatgtccttagcacaggggggccgccggtttgagtgagggtttctgagctgctctgaattagtccttgcttggctgcttggccttgggcttcattcaagtctatgatgctgttgcccacgtttcccgggatatatattctctcccctccgttgggccccagccttctttgcttgcctctctgtttgtaaccttgtcgacaaagaggtagaaaagattgggtctaggatatggtgggtggacaggggccccgggacttggagggttggtcctcttgcctcctggaaaaaacaaaaacaaaaaactgcagtgaaagacaagctgcaaatcagccatgtgctgcgtgcctgtggaatctggagtgaggggtaaaagctgatctggtttgactccgctggaggtggggcctggagcaggccttgcgctgttgcgtaactggctgtgttctggtgaggccttgctcccaaccccacacgctcctccctctgaggctgtaggactcgcagtcaggggcagctgaccatggaagattgagagcccaaggtttaaacttctctgaagggaggtggggatgagaagaggggtttttttgtactttgtacaaagaccacacatttgtgtaaacagtgttttggaataaaatatttttttcataaa

SEQ ID NO: 20708 - DNA, 3318 bp, Homo sapiens
  ENST00000590949
agatggccggagtaaaagaaggagggaggtgctgcggtggtgggggtgatcttggcttcactagaatccccagttcttcccctctctacagttttgtctctgaggtcacaaaacctgtggcccccaagacacacatgcgcacacacgcgcgtgcacacacacaccccacacatttattttttaatctaggggctcaaaagatgacacgcgccagagctggaaggcgtcgccaattggtccacttttccctcctccctttttgcggatgagaaaactgaggcccaggtttgggatttccagagcccgggatttcccggcaacgcccgacaaccacattcccccggctattctgacccgccccggttccgggacgctccctgggagccgccgccgagggcctgctgggactcccgggggaccccgccgtcggggcagcccccacgcccggcgccgcccgccgggaacggccgccgctgttgcgcacttgcaggggagccggcgactgagggcgaggcagggagggagcaagcggggctgggagggctgctggcgcgggctcgcgcgctgtgtatggtctatcgcaggcagctgacctttgaggaggaaatcgctgctctccgctccttcctgtagtaacagccgccgctgccgccgccgccaggaaccccggccgggagcgagagccgcggggcgcagagccggcccggctgccggacggtgcggccccaccaggtgaacggccatggcgggctggatccaggcccagcagctgcagggagacgcgctgcgccagatgcaggtgctgtacggccagcacttccccatcgaggtccggcactacttggcccagtggattgagagccagccatgggatgccattgacttggacaatccccaggacagagcccaagccacccagctcctggagggcctggtgcaggagctgcagaagaaggcggagcaccaggtgggggaagatgggtttttactgaagatcaagctggggcactacgccacgcagctccagaaaacatatgaccgctgccccctggagctggtccgctgcatccggcacattctgtacaatgaacagaggctggtccgagaagccaacaattgcagctctccggctgggatcctggttgacgccatgtcccagaagcaccttcagatcaaccagacatttgaggagctgcgactggtcacgcaggacacagagaatgagctgaagaaactgcagcagactcaggagtacttcatcatccagtaccaggagagcctgaggatccaagctcagtttgcccagctggcccagctgagcccccaggagcgtctgagccgggagacggccctccagcagaagcaggtgtctctggaggcctggttgcagcgtgaggcacagacactgcagcagtaccgcgtggagctggccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctggtgtgagaagttggccgagatcatctggcagaaccggcagcagatccgcagggctgagcacctctgccagcagctgcccatccccggcccagtggaggagatgctggccgaggtcaacgccaccatcacggacattatctcagccctggtgaccagcacattcatcattgagaagcagcctcctcaggtcctgaagacccagaccaagtttgcagccaccgtacgcctgctggtgggcgggaagctgaacgtgcacatgaatcccccccaggtgaaggccaccatcatcagtgagcagcaggccaagtctctgcttaaaaatgagaacacccgcaacgagtgcagtggtgagatcctgaacaactgctgcgtgatggagtaccaccaagccacgggcaccctcagtgcccacttcaggaacatgtcactgaagaggatcaagcgtgctgaccggcggggtgcagagtccgtgacagaggagaagttcacagtcctgtttgagtctcagttcagtgttggcagcaatgagcttgtgttccaggtgaagactctgtccctacctgtggttgtcatcgtccacggcagccaggaccacaatgccacggctactgtgctgtgggacaatgcctttgctgagccgggcagggtgccatttgccgtgcctgacaaagtgctgtggccgcagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtccgtgtcctggtcccagttcaacagggagaacttgccgggctggaactacaccttctggcagtggtttgacggggtgatggaggtgttgaagaagcaccacaagccccactggaatgatggggccatcctaggttttgtgaataagcaacaggcccacgacctgctcatcaacaagcccgacgggaccttcttgttgcgctttagtgactcagaaatcgggggcatcaccatcgcctggaagtttgactccccggaacgcaacctgtggaacctgaaaccattcaccacgcgggatttctccatcaggtccctggctgaccggctgggggacctgagctatctcatctatgtgtttcctgaccgccccaaggatgaggtcttctccaagtactacactcctgtgctggctaaagctgttgatggatatgtgaaaccacagatcaagcaagtggtccctgagtttgtgaatgcatctgcagatgctgggggcagcagcgccacgtacatggaccaggccccctccccagctgtgtgcccccaggctccctataacatgtacccacagaaccctgaccatgtactcgatcaggatggagaattcgacctggatgagaccatggatgtggccaggcacgtggaggaactcttacgccgaccaatggacagtcttgactcccgcctctcgccccctgccggtcttttcacctctgccagaggctccctctcatgaatgtttgaatcccacgcttctctttggaaacaatatgcaatgtgaagcggtcgtgttgtgagtttagtaaggctgtgtacactgacacctttgcaggcatgcatgtgcttgtgtgtgtgtgtgtgtgtgtgtccttgtgcatgagctacgcctgcctcccctgtgcagtcctgggatgtggctgcagcagc

SEQ ID NO: 20709 - DNA, 3086 bp, Homo sapiens
  ENST00000546010
gccagagctggaaggcgtcgccaattggtccacttttccctcctccctttttgcggatgagaaaactgaggcccaggtttgggatttccagagcccgggatttcccggcaacgcccgacaaccacattcccccggctattctgacccgccccggttccgggacgctccctgggagccgccgccgagggcctgctgggactcccgggggaccccgccgtcggggcagcccccacgcccggcgccgcccgccgggaacggccgccgctgttgcgcacttgcaggggagccggcgactgagggcgaggcagggagggagcaagcggggctgggagggctgctggcgcgggctcgcgcgctgtgtatggtctatcgcaggcagctgacctttgaggaggaaatcgctgctctccgctccttcctgtagtaacagccgccgctgccgccgccgccaggaaccccggccgggagcgagagccgcggggcgcagagccggcccggctgccggacggtgcggccccaccaggtgaacggccatggcgggctggatccaggcccagcagctgcagggagacgcgctgcgccagatgcaggtgctgtacggccagcacttccccatcgaggtccggcactacttggcccagtggattgagagccagccatgggatgccattgacttggacaatccccaggacagagcccaagccacccagctcctggagggcctggtgcaggagctgcagaagaaggcggagcaccaggtgggggaagatgggtttttactgaagatcaagctggggcactacgccacgcagctccagtgcagctctccggctgggatcctggttgacgccatgtcccagaagcaccttcagatcaaccagacatttgaggagctgcgactggtcacgcaggacacagagaatgagctgaagaaactgcagcagactcaggagtacttcatcatccagtaccaggagagcctgaggatccaagctcagtttgcccagctggcccagctgagcccccaggagcgtctgagccgggagacggccctccagcagaagcaggtgtctctggaggcctggttgcagcgtgaggcacagacactgcagcagtaccgcgtggagctggccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctggtgtgagaagttggccgagatcatctggcagaaccggcagcagatccgcagggctgagcacctctgccagcagctgcccatccccggcccagtggaggagatgctggccgaggtcaacgccaccatcacggacattatctcagccctggtgaccagcacattcatcattgagaagcagcctcctcaggtcctgaagacccagaccaagtttgcagccaccgtacgcctgctggtgggcgggaagctgaacgtgcacatgaatcccccccaggtgaaggccaccatcatcagtgagcagcaggccaagtctctgcttaaaaatgagaacacccgcaacgagtgcagtggtgagatcctgaacaactgctgcgtgatggagtaccaccaagccacgggcaccctcagtgcccacttcaggaacatgtcactgaagaggatcaagcgtgctgaccggcggggtgcagagtccgtgacagaggagaagttcacagtcctgtttgagtctcagttcagtgttggcagcaatgagcttgtgttccaggtgaagactctgtccctacctgtggttgtcatcgtccacggcagccaggaccacaatgccacggctactgtgctgtgggacaatgcctttgctgagccgggcagggtgccatttgccgtgcctgacaaagtgctgtggccgcagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtccgtgtcctggtcccagttcaacagggagaacttgccgggctggaactacaccttctggcagtggtttgacggggtgatggaggtgttgaagaagcaccacaagccccactggaatgatggggccatcctaggttttgtgaataagcaacaggcccacgacctgctcatcaacaagcccgacgggaccttcttgttgcgctttagtgactcagaaatcgggggcatcaccatcgcctggaagtttgactccccggaacgcaacctgtggaacctgaaaccattcaccacgcgggatttctccatcaggtccctggctgaccggctgggggacctgagctatctcatctatgtgtttcctgaccgccccaaggatgaggtcttctccaagtactacactcctgtgctggctaaagctgttgatggatatgtgaaaccacagatcaagcaagtggtccctgagtttgtgaatgcatctgcagatgctgggggcagcagcgccacgtacatggaccaggccccctccccagctgtgtgcccccaggctccctataacatgtacccacagaaccctgaccatgtactcgatcaggatggagaattcgacctggatgagaccatggatgtggccaggcacgtggaggaactcttacgccgaccaatggacagtcttgactcccgcctctcgccccctgccggtcttttcacctctgccagaggctccctctcatgaatgtttgaatcccacgcttctctttggaaacaatatgcaatgtgaagcggtcgtgttgtgagtttagtaaggctgtgtacactgacacctttgcaggcatgcatgtgcttgtgtgtgtgtgtgtgtgtgtgtccttgtgcatgagctacgcctgcctcccctgtgcagtcctgggatgtggctgcagcagcggtggcctcttttcagatcatggcatccaagagtgcgccgagtctgtctctgtcatggtagagaccg

SEQ ID NO: 20710 - DNA, 835 bp, Homo sapiens
  ENST00000590726
ggaaatcgctgctctccgctccttcctgtagtaacagccgccgctgccgccgccgccaggaaccccggccgggagcgagagccgcggggcgcagagccggcccggctgccggacggtgcggccccaccagggatgccattgacttggacaatccccaggacagagcccaagccacccagctcctggagggcctggtgcaggagctgcagaagaaggcggagcaccaggtgggggaagatgggtttttactgaagatcaagctggggcactacgccacgcagctccagaaaacatatgaccgctgccccctggagctggtccgctgcatccggcacattctgtacaatgaacagaggctggtccgagaagccaacaattgcagctctccggctgggatcctggttgacgccatgtcccagaagcaccttcagatcaaccagacatttgaggagctgcgactggtcacgcaggacacagagaatgagctgaagaaactgcagcagactcaggagtacttcatcatccagtaccaggagagcctgaggatccaagctcagtttgcccagctggcccagctgagcccccaggagcgtctgagccgggagacggccctccagcagaagcaggtgtctctggaggcctggttgcagcgtgaggcacagacactgcagcagtaccgcgtggagctggccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctg

SEQ ID NO: 20711 - DNA, 562 bp, Homo sapiens
  ENST00000469124
ccttcctgtagtaacagccgccgctgccgccgccgccaggaaccccggccgggagcgagagccgcggggcgcagagccggcccggctgccggacggtgcggccccaccaggtgaacggccatggcgggctggatccaggcccagcagctgcagggagacgcgctgcgccagatgcaggtgctgtacggccagcacttccccatcgaggtccggcactacttggcccagtggattgagagccagccatgggatgccattgacttggacaatccccaggacagagcccaagccacccagctcctggagggcctggtgcaggagctgcagaagaaggcggagcaccaggtgggggaagatgggtttttactgaagatcaagctggggcactacgccacgcagctccaggtgggtgtaggctctgggccacctacggggaggaagcatcatcttgttccagcatcagaacccctgggttttttcctggcctggccactgactcaccatgtgaccacgaacttattgggaacttttcttcgatttcccccaccccctctttctaaat

SEQ ID NO: 20712 - DNA, 515 bp, Homo sapiens
  ENST00000444283
aacagccgccgctgccgccgccgccaggaaccccggccgggagcgagagccgcggggcgcagagccggcccggctgccggacggtgcggccccaccagaggagagcgcttcagcgctcggctcgccctaggtgaacggccatggcgggctggatccaggcccagcagctgcagggagacgcgctgcgccagatgcaggtgctgtacggccagcacttccccatcgaggtccggcactacttggcccagtggattgagagccagccatgggatgccattgacttggacaatccccaggacagagcccaagccacccagctcctggagggcctggtgcaggagctgcagaagaaggcggagcaccaggtgggggaagatgggtttttactgaagatcaagctggggcactacgccacgcagctccagaaaacatatgaccgctgccccctggagctggtccgctgcatccggcacattctgtacaatgaacagaggctggtccgagaagccaacaat

SEQ ID NO: 20713 - DNA, 3629 bp, Homo sapiens
  ENST00000588868
gcgagagccgcggggcgcagagccggcccggctgccggacggtgcggccccaccaggtgaacggccatggcgggctggatccaggcccagcagctgcagggagacgcgctgcgccagatgcaggtgctgtacggccagcacttccccatcgaggtccggcactacttggcccagtggattgagagccagccatgggatgccattgacttggacaatccccaggacagagcccaagccacccagctcctggagggcctggtgcaggagctgcagaagaaggcggagcaccaggtgggggaagatgggtttttactgaagatcaagctggggcactacgccacgcagctccagaaaacatatgaccgctgccccctggagctggtccgctgcatccggcacattctgtacaatgaacagaggctggtccgagaagccaacaattgcagctctccggctgggatcctggttgacgccatgtcccagaagcaccttcagatcaaccagacatttgaggagctgcgactggtcacgcaggacacagagaatgagctgaagaaactgcagcagactcaggagtacttcatcatccagtaccaggagagcctgaggatccaagctcagtttgcccagctggcccagctgagcccccaggagcgtctgagccgggagacggccctccagcagaagcaggtgtctctggaggcctggttgcagcgtgaggcacagacactgcagcagtaccgcgtggagctggccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctggtgtgagaagttggccgagatcatctggcagaaccggcagcagatccgcagggctgagcacctctgccagcagctgcccatccccggcccagtggaggagatgctggccgaggtcaacgccaccatcacggacattatctcagccctggtgaccagcacattcatcattgagaagcagcctcctcaggtcctgaagacccagaccaagtttgcagccaccgtacgcctgctggtgggcgggaagctgaacgtgcacatgaatcccccccaggtgaaggccaccatcatcagtgagcagcaggccaagtctctgcttaaaaatgagaacacccgcaacgagtgcagtggtgagatcctgaacaactgctgcgtgatggagtaccaccaagccacgggcaccctcagtgcccacttcaggaacatgtcactgaagaggatcaagcgtgctgaccggcggggtgcagagtccgtgacagaggagaagttcacagtcctgtttgagtctcagttcagtgttggcagcaatgagcttgtgttccaggtgaagggcagggtgccatttgccgtgcctgacaaagtgctgtggccgcagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtccgtgtcctggtcccagttcaacagggagaacttgccgggctggaactacaccttctggcagtggtttgacggggtgatggaggtgttgaagaagcaccacaagccccactggaatgatggggccatcctaggttttgtgaataagcaacaggcccacgacctgctcatcaacaagcccgacgggaccttcttgttgcgctttagtgactcagaaatcgggggcatcaccatcgcctggaagtttgactccccggaacgcaacctgtggaacctgaaaccattcaccacgcgggatttctccatcaggtccctggctgaccggctgggggacctgagctatctcatctatgtgtttcctgaccgccccaaggatgaggtcttctccaagtactacactcctgtgctggctaaagctgttgatggatatgtgaaaccacagatcaagcaagtggtccctgagtttgtgaatgcatctgcagatgctgggggcagcagcgccacgtacatggaccaggccccctccccagctgtgtgcccccaggctccctataacatgtacccacagaaccctgaccatgtactcgatcaggatggagaattcgacctggatgagaccatggatgtggccaggcacgtggaggaactcttacgccgaccaatggacagtcttgactcccgcctctcgccccctgccggtcttttcacctctgccagaggctccctctcatgaatgtttgaatcccacgcttctctttggaaacaatatgcaatgtgaagcggtcgtgttgtgagtttagtaaggctgtgtacactgacacctttgcaggcatgcatgtgcttgtgtgtgtgtgtgtgtgtgtgtccttgtgcatgagctacgcctgcctcccctgtgcagtcctgggatgtggctgcagcagcggtggcctcttttcagatcatggcatccaagagtgcgccgagtctgtctctgtcatggtagagaccgagcctctgtcactgcaggcactcaatgcagccagacctattcctcctgggcccctcatctgctcagcagctatttgaatgagatgattcagaaggggaggggagacaggtaacgtctgtaagctgaagtttcactccggagtgagaagctttgccctcctaagagagagagacagagagacagagagagagaaagagagagtgtgtgggtctatgtaaatgcatctgtcctcatgtgttgatgtaaccgattcatctctcagaagggaggctggggttcattttcgagtagtattttatactttagtgaacgtggactccagactctctgtgaaccctatgagagcgcgtctgggcccggccatgtccttagcacaggggggccgccggtttgagtgagggtttctgagctgctctgaattagtccttgcttggctgcttggccttgggcttcattcaagtctatgatgctgttgcccacgtttcccgggatatatattctctcccctccgttgggccccagccttctttgcttgcctctctgtttgtaaccttgtcgacaaagaggtagaaaagattgggtctaggatatggtgggtggacaggggccccgggacttggagggttggtcctcttgcctcctggaaaaaacaaaaacaaaaaactgcagtgaaagacaagctgcaaatcagccatgtgctgcgtgcctgtggaatctggagtgaggggtaaaagctgatctggtttgactccgctggaggtggggcctggagcaggccttgcgctgttgcgtaactggctgtgttctggtgaggccttgctcccaaccccacacgctcctccctctgaggctgtaggactcgcagtcaggggcagctgaccatggaagattgagagcccaaggtttaaacttctctgaagggaggtggggatgagaagaggggtttttttgtactttgtacaaagaccacacatttgtgtaaacagtgttttggaataaaatatttttttcat

SEQ ID NO: 20714 - DNA, 550 bp, Homo sapiens
  ENST00000478897
ccttgttggaggggatgggcggccctccactcctcaccatctctgttcccgcacaggaaagctatctgtgggaggggaggggcctggcctggccgcggtccagggataggtaggcatggcaaggccaggggcaggcccggttccttggcctctgcagaggagagcgcttcagcgctcggctcgccctaggtgaacggccatggcgggctggatccaggcccagcagctgcagggagacgcgctgcgccagatgcaggtgctgtacggccagcacttccccatcgaggtccggcactacttggcccagtggattgagagccagccatgggatgccattgacttggacaatccccaggacagagcccaagccacccagctcctggagggcctggtgcaggagctgcagaagaaggcggagcaccaggtgggggaagatgggtttttactgaagatcaagctggggcactacgccacgcagctccagaaaacatatgaccgctgccccctggagctggtccgctgcatccggcacattctgtacaatgaacag

SEQ ID NO: 20715 - DNA, 553 bp, Homo sapiens
  ENST00000479417
gaagtcagtaacccagaaagacgccaagaaacactcttaggggatacggggcaggggctgctggcagggctgacctgagcgaagaccccagcccgaggtgtggacaggaccatgctcctggcctggggcccatgtggagctgggacccccctctcctttgcagcgagtgcagtggtgagatcctgaacaactgctgcgtgatggagtaccaccaagccacgggcaccctcagtgcccacttcaggaacatgtcactgaagaggatcaagcgtgctgaccggcggggtgcagagtccgtgacagaggagaagttcacagtcctgtttgagtctcagttcagtgttggcagcaatgagcttgtgttccaggtgaagactctgtccctacctgtggttgtcatcgtccacggcagccaggaccacaatgccacggctactgtgctgtgggacaatgcctttgctgagccgggcagggtgccatttgccgtgcctgacaaagtgctgtggccgcagctgtgtgaggcgctcaacatgaaattcaaggccgaagtgca

SEQ ID NO: 20716 - DNA, 893 bp, Homo sapiens
  ENST00000468096
gcatttgtgtcacctttctggatctgtctcagtctcctctgtctctaggtgtctgtgtatcttgtgtgtgtgtgaatatttccaactccctcaatctaccttttcccctctcttgtctccctctcagggcagggtgccatttgccgtgcctgacaaagtgctgtggccgcagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtccgtgtcctggtcccagttcaacagggagaacttgccgggctggaactacaccttctggcagtggtttgacggggtgatggaggtgttgaagaagcaccacaagccccactggaatgatggggccatcctaggttttgtgaataagcaacaggcccacgacctgctcatcaacaagcccgacgggaccttcttgttgcgctttagtgactcagaaatcgggggcatcaccatcgcctggaagtttgactccccggaacgcaacctgtggaacctgaaaccattcaccacgcgggatttctccatcaggtccctggctgaccggctgggggacctgagctatctcatctatgtgtttcctgaccgccccaaggatgaggtcttctccaagtactacactcctgtgctggctaaagctgttgatggatatgtgaaaccacagatcaagcaagtggtccctgagtttgtgaatgcatctgcagatgctgggggcagcagcgccacgtacatggaccaggccccctccccagctgtgtgcccccaggctccctataacatgtacccacagaaccctgaccatgtactcg

SEQ ID NO: 20717 - DNA, 1140 bp, Homo sapiens
  ENST00000591556
atttgtgtcacctttctggatctgtctcagtctcctctgtctctaggtgtctgtgtatcttgtgtgtgtgtgaatatttccaactccctcaatctaccttttcccctctcttgtctccctctcagggcagggtgccatttgccgtgcctgacaaagtgctgtggccgcagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtccgtgtcctggtcccagttcaacagggagaacttgccgggctggaactacaccttctggcagtggtttgacggggtgatggaggtgttgaagaagcaccacaagccccactggaatgatggggccatcctaggttttgtgaataagcaacaggcccacgacctgctcatcaacaagcccgacgggaccttcttgttgcgctttagtgactcagaaatcgggggcatcaccatcgcctggaagtttgactccccggaacgcaacctgtggaacctgaaaccattcaccacgcgggatttctccatcaggtccctggctgaccggctgggggacctgagctatctcatctatgtgtttcctgaccgccccaaggatgaggtcttctccaagtactacactcctgtgctgggtgggtactgccccaggaccctgccggctgactcccccgggctcttccccagcccatagacaaagccttgggctgcgccgtggggacttccccaggaggagcctaggggccatgtcccctgtgggttttggcccatggggtggtggagaggatttcagggctcacaaatgaggagagggaacgagaaacccgtcccagctctcttctctgcaaagtgaaagctgcatggattctcacttctgcaccctcggaggaaggggtggcagcactgtagggagtggccgggatcattcgagcccacagatagtgctccgctccccacctcaccagctgctctccacaccctgctcacaaaccttcccccgagtggagtgcaggcagcaaaagggagaagtctctcttcttccagctgccccaaatccattg

SEQ ID NO: 20718 - DNA, 1022 bp, Homo sapiens
  ENST00000587646
gtatcttgtgtgtgtgtgaatatttccaactccctcaatctaccttttcccctctcttgtctccctctcagggcagggtgccatttgccgtgcctgacaaagtgctgtggccgcagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtccgtgtcctggtcccagttcaacagggagaacttgccgggctggaactacaccttctggcagtggtttgacggggtgatggaggtgttgaagaagcaccacaagccccactggaatgatggggccatcctaggttttgtgaataagcaacaggcccacgacctgctcatcaacaagcccgacgggaccttcttgttgcgctttagtgactcagaaatcgggggcatcaccatcgcctggaagtttgactccccggaacgcaacctgtggaacctgaaaccattcaccacgcgggatttctccatcaggtccctggctgaccggctgggggacctgagctatctcatctatgtgtttcctgaccgccccaaggatgaggtcttctccaagtactacactcctgtgctggctaaagctgttgatggatatgtgaaaccacagatcaagcaagtggtccctgagtttgtgaatgcatctgcagatgctgggggcagcagcgccacgtacatggaccaggccccctccccagctgtgtgcccccaggctccctataacatgtacccacagaagtaggtggtgttctcatggggtccgcaggggaagaactggggacttggccccaggctggactcctggagggctggcgggcaaaggatccagagctctggttaggcccaagtccaggaggagtgagatcagccaggaaaacagagcattttgaagctagacatagcagggtcaagtcctcactctagtactaactgtgtgatc

SEQ ID NO: 20719 - DNA, 5353 bp, Homo sapiens
  ENST00000265087
tttctccttccctccacgggccgggtgagaaagtagccgggggctatcccgacccggcggttcttggggagggggccgaacaagaaaagggaggagatggagataacttccccggatttagcttttttgtctttgtttttgttctcaccacttccatcggatgactggagagtaaaagggaacccggagcggggtggcgagcagcgctttgagaaaatgcaggagtgtgtttggagacgcgtaaagttgcctttcaagctctggcctccgggcacgcgatgctccgcggcgggctgactcagggctgccttgggcctccctgccaccctcctggaaatgatgcaagtcctgactgtcacctggatccctgcagcccagcctggaatgcgtctggattaggggaaagacgagaaacgacactccaggtgttgcacggcccaccaaagcgggaagatagggcagttgctcagaccaaatactgtatctagtgcttctgctcctatcttcaatcgtggggttctttttaatgcaaagtgtcacaaggccaggaattcccatgtgtgctcagttggcccacagcatcattgtgcctaggaaactgcttcaatttatcaagtcctctgggctgggaatctcactgaattccaaacggcggaaagaggaaactttcccaacccgatgtgggtgtgacgcgagccaggggccccagggacactgtcccagagcacaccgtccccctttaacagcaactggagcttggattcgctcttatattgtacagtcctttcgaccattgccctggagcacccgcacacgcgcacgcatctccggccgcgctcacacacactcatacacacgcacgcaaacgcgtggccgccgccaggtcggcaactttgtccggcgctcccagcggcgctcggcttcctcctgtagtagttgagcgcaggccccgcctcccggccgtgttgtcaaaagggccggggtctcggattggtccagccgccgggacaacacctgctcgactccttcattcaagtgacaccagagcttccagggatatttgaggcaccatccctgccattgccgggcactcgcggcgctgctaacggcctggtcacatgctctccggagagctacgggagggcgctgggtaacctctatccgagccgcggccgcgaggaggagggaaaaggcgagcaaaaaggaagagtgggaggaggaggggaagcggcgaaggaggaagaggaggaggaggaagaggggagcacaaaggatccaggtctcccgacgggaggttaataccaagaaccatgtgtgccgagcggctgggccagttcatgaccctggctttggtgttggccacctttgacccggcgcgggggaccgacgccaccaacccacccgagggtccccaagacaggagctcccagcagaaaggccgcctgtccctgcagaatacagcggagatccagcactgtttggtcaacgctggcgatgtggggtgtggcgtgtttgaatgtttcgagaacaactcttgtgagattcggggcttacatgggatttgcatgacttttctgcacaacgctggaaaatttgatgcccagggcaagtcattcatcaaagacgccttgaaatgtaaggcccacgctctgcggcacaggttcggctgcataagccggaagtgcccggccatcagggaaatggtgtcccagttgcagcgggaatgctacctcaagcacgacctgtgcgcggctgcccaggagaacacccgggtgatagtggagatgatccatttcaaggacttgctgctgcacgaaccctacgtggacctcgtgaacttgctgctgacctgtggggaggaggtgaaggaggccatcacccacagcgtgcaggttcagtgtgagcagaactggggaagcctgtgctccatcttgagcttctgcacctcggccatccagaagcctcccacggcgccccccgagcgccagccccaggtggacagaaccaagctctccagggcccaccacggggaagcaggacatcacctcccagagcccagcagtagggagactggccgaggtgccaagggtgagcgaggtagcaagagccacccaaacgcccatgcccgaggcagagtcgggggccttggggctcagggaccttccggaagcagcgagtgggaagacgaacagtctgagtattctgatatccggaggtgaaatgaaaggcctggccacgaaatctttcctccacgccgtccattttcttatctatggacattccaaaacatttaccattagagaggggggatgtcacacgcaggattctgtggggactgtggacttcatcgaggtgtgtgttcgcggaacggacaggtgagatggagacccctggggccgtggggtctcaggggtgcctggtgaattctgcacttacacgtactcaagggagcgcgcccgcgttatcctcgtacctttgtcttctttccatctgtggagtcagtgggtgtcggccgctctgttgtgggggaggtgaaccagggaggggcagggcaaggcagggcccccagagctgggccacacagtgggtgctgggcctcgccccgaagcttctggtgcagcagcctctggtgctgtctccgcggaagtcagggcggctggattccaggacaggagtgaatgtaaaaataaatatcgcttagaatgcaggagaagggtggagaggaggcaggggccgagggggtgcttggtgccaaactgaaattcagtttcttgtgtggggccttgcggttcagagctcttggcgagggtggagggaggagtgtcatttctatgtgtaatttctgagccattgtactgtctgggctgggggggacactgtccaagggagtggcccctatgagtttatattttaaccactgcttcaaatctcgatttcactttttttatttatccagttatatctacatatctgtcatctaaataaatggctttcaaacaaagcaactgggtcattaaaaccagctcaaagggggtttaaaaaaaaaaaaccagcccatcctttgaggctgatttttcttttttttaagttctattttaaaagctatcaaacagcgacatagccatacatctgactgcctgacatggactcctgcccacttgggggaaaccttatacccagaggaaaatacacacctggggagtacatttgacaaatttcccttaggatttcgttatctcaccttgaccctcagccaagattggtaaagctgcgtcctggcgattccaggagacccagctggaaacctggcttctccatgtgaggggatgggaaaggaaagaagagaatgaagactacttagtaattcccatcaggaaatgctgaccttttacataaaatcaaggagactgctgaaaatctctaagggacaggattttccagatcctaattggaaatttagcaataaggagaggagtccaaggggacaaataaaggcagagagaagagacagaactaaaaatacgaggaaaggagagtgaggattttcattaaaagtctcagcagtgggtttcttgggttatttaaaacatcacctaaataggccttttcttcctaattggccatcaaattaaagcctatcctttctcaagcaggagctggtattgtagggagtggccgggtattctgggctgggctcttctggagtagggggtcagcaaacattgtctgcaaagggccagatactgaatccagtactttcagtttggcgagccgtgaggtctctgtcgaaactactcaactctgccgtcctagcacaaaagcagccatagacaacacacaaacgagagggcttggctcccttccaggaagatttatttaacaggctcccagctgaatttcactcacaggacacagtttactgatctctgttctagtgagtgggtcaaaaagcatatgcatccttatccgtcaactcatcagctcttcctcaaggcaacctgaggccagacaccaagaaaccaagcgtatctgctctaaaatgacttgttcctggggaatgccttcaaccaaaacacagctagtatttctatgccccaaatccaatcccagtctttcatgatccatgccggcggttgggtggggaggggaatcattggttgggggaagggaggaaaccccacctccagcccccgccaccgggctccctgggcacccagcaagatctggggctgcagagaacagaagagctggtgcacttaatccagctctgcccttggggggaggaggacctgtgtgtcaggctctgccatgggaacgagtgtaaaccgtggctgtctcctgcagtgagccaccgcggcaggcacgttgactgttttactgacatcactcaaaagctaaagcaataacattctcctgcgttgctgagtcagctgttcatttgtccgccagctcctggactggatgtgtgaaaggcatcacatttccattttcctccgtgtaaatgttttatgtgttcgcctactgatcccattcgttgcttctattgtaaatatttgtcatttgtatttattatctctgtgttttccccctaaggcataaaatggtttactgtgttcatttgaacccatttactgatctctgttgtatatttttcatgccactgctttgttttctcctcagaagtcgggtagatagcatttctatcccatccctcacgttattggaagcatgcaacagtatttattgctcagggtcttctgcttaaaactgaggaaggtccacattcctgcaagcattgattgagacatttgcacaatctaaaatgtaagcaaagtagtcattaaaaatacaccctctacttgggctttatactgcatacaaatttactcatgagccttcctttgaggaaggatgtggatctccaaataaagatttagtgtttattttgagctctgcatcttaacaagatgatctgaacacctctcctttgtatcaataaatagccctgttattctgaagtgagaggaccaagtatagtaaaatgctgacatctaaaactaaataaatagaaaacaccaggccagaactatagtcatactcacacaaagggagaaatttaaactcgaaccaagcaaaaggcttcacggaaatagcatggaaaaacaatgcttccagtggccacttcctaaggaggaacaaccccgtctgatctcagaattggcaccacgtgagcttgctaagtgataatatctgtttctactacggatttaggcaacaggacctgtacattgtcacattgcattatttttcttcaagcgttaataaaagttttaaataaatggcttccacttga

SEQ ID NO: 20720 - DNA, 566 bp, Homo sapiens
  ENST00000520593
aagggagcagcaccgagctcgcctccacacccccaacagctgtctcctttctaggataagcacaatcagacggggttgccaggaaagagaactgcaggccagatgtatgcctggctgccttcgccactcggaggcagggagcgtgggggaggggccgccagtgcggcagttcagactccagatgctgccaggcagggtgccaggccagccttttagaggcaataatccgaacagtttaaaggagtagagtcattttcaaaaaggaaaagagcgctcttcctgggcaagtcattcatcaaagacgccttgaaatgtaaggcccacgctctgcggcacaggttcggctgcataagccggaagtgcccggccatcagggaaatggtgtcccagttgcagcgggaatgctacctcaagcacgacctgtgcgcggctgcccaggagaacacccgggtgatagtggagatgatccatttcaaggacttgctgctgcacgaaccctacgtggacctcgtgaacttgctgctgacctgtggggaggaggtgaaggaggccatcacccacagcgt

SEQ ID NO: 20721 - DNA, 616 bp, Homo sapiens
  ENST00000520648
gcagaatacagcggagatccagcactgtttggtcaacgctggcgatgtggggtgtggcgtgtttgaatgtttcgagaacaactcttgtgagattcggggcttacatgggatttgcatgacttttctgcacaacgctggaaaatttgatgcccagggcaagtcattcatcaaagacgccttgaaatgtaaggcccacgctctgcggcacaggttcggctgcataagccggaagtgcccggccatcagggaaatggtgtcccagttgcagcgggaatgctacctcaagcacgacctgtgcgcggctgcccaggagaacacccgggtgatagtggagatgatccatttcaaggacttgctgctgcacgagtgagtactgccccgcagagggcctgggtgaaggggccacccagcaaggatggcaatgtgtatgggaggagagccgcgttgcttctagaggctgaatgcctgtcaaatggagaaggcttccatttacttcagaaagctacactgactctactaaaaggcccctttcctgctggcttttaggaaaagagagaattccctcatcagtctcaaaatcacaagcaacagaaatgggaaatcgttttactaagaa

SEQ ID NO: 20722 - DNA, 473 bp, Homo sapiens
  ENST00000518455
tgccccttccgagagaggactgggggccacattcggtgaagggctgcaagcttcctcccgggctgcgggaattctaggggattgggtgatacctcacccggatccctaattaaaaggagcctgcaacctctgatagtggcgtttctgaaggctcgcccccagctgactccactcctaagcctgctcgccaaccgcagcttccctagctgcggagatccagcactgtttggtcaacgctggcgatgtggggtgtggcgtgtttgaatgtttcgagaacaactcttgtgagattcggggcttacatgggatttgcatgacttttctgcacaacgctggaaaatttgatgcccagggcaagtcattcatcaaagacgccttgaaatgtaaggcccacgctctgcggcacaggttcggctgcataagccggaagtgcccggccatcagggaaatggtgtcccagttgcagcgggaat

SEQ ID NO: 20723 - DNA, 582 bp, Homo sapiens
  ENST00000519511
atatttgaggcaccatccctgccattgccgggcactcgcggcgctgctaacggcctggtcacatgctctccggagagctacgggagggcgctgggtaacctctatccgagccgcggccgcgaggaggagggaaaaggcgagcaaaaaggaagagtgggaggaggaggggaagcggcgaaggaggaagaggaggaggaggaagaggggagcacaaaggatccaggtctcccgacgggaggttaataccaagaaccatgtgtgccgagcggctgggccagttcatgaccctggctttggtgttggccacctttgacccggcgcgggggaccgacgccaccaacccacccgagggtccccaagacaggagctcccagcagaaaggccgcctgtccctgcagaatacagcggagatccagcactgtttggtcaacgctggcgatgtggggtgtggcgtgtttgaatgtttcgagaacaactcttgtgagattcggggcttacatgggatttgcatgacttttctgcacaacgctggaaaatttgatgcccaggtaaaaatccatccagagcatgaagaatgtttgg

SEQ ID NO: 20724 - DNA, 4262 bp, Homo sapiens
  ENST00000393110
accgccttcgccgcggaccttcagctgccgcggtcgctccgagcggcgggccgcagagatgacatttattcattttatgcatcctgggttctactggtcgtcccacctcagttcctgtagcaaagagacttgagtctgagccactaattatcacccgtgaggtttcctccccgagcaggaagcagcaggccagagctgcgctctctcagtgcactctccaaccaagcatcagtcaccactcccggtccagcccctgtggccaagagctggcgtgcaggctgcgggaggcagctggctgtgcaagaccctggcagggccctcgcctcctgagaaaccgagagtcagaaccaaagccaggctgtcctggttggagactgagccagaaagggtggctcacctcacggtgaggctgtcgagtgacctgagagcctcagaccctcacgtcagccggatgtcgcaccagcctgctgttgccaccaaaatgccagaagagatggacaagccactgatcagcctccacctggtggacagcgatagtagccttgccaaggtccccgatgaggcccccaaagtgggcatcctgggtagcggggactttgcccgctccctggccacacgcctggtgggctctggcttcaaagtggtggtggggagccgcaaccccaaacgcacagccaggctgtttccctcagcggcccaagtgactttccaagaggaggcagtgagctccccggaggtcatctttgtggctgtgttccgggagcactactcttcactgtgcagtctcagtgaccagctggcgggcaagatcctggtggatgtgagcaaccctacagagcaagagcaccttcagcatcgtgagtccaatgctgagtacctggcctccctcttccccacttgcacagtggtcaaggccttcaatgtcatctctgcctggaccctgcaggctggcccaagggatggtaacaggcaggtgcccatctgcggtgaccagccagaagccaagcgtgctgtctcggagatggcgctcgccatgggcttcatgcccgtggacatgggatccctggcgtcagcctgggaggtggaggccatgcccctgcgcctcctcccggcctggaaggtgcccaccctgctggccctggggctcttcgtctgcttctatgcctacaacttcgtccgggacgttctgcagccctatgtgcaggaaagccagaacaagttcttcaagctgcccgtgtccgtggtcaacaccacactgccgtgcgtggcctacgtgctgctgtcactcgtgtacttgcccggcgtgctggcggctgccctgcagctgcggcgcggcaccaagtaccagcgcttccccgactggctggaccactggctacagcaccgcaagcagatcgggctgctcagcttcttctgcgccgccctgcacgccctctacagcttctgcttgccgctgcgccgcgcccaccgctacgacctggtcaacctggcagtcaagcaggtcttggccaacaagagccacctctgggtggaggaggaggtctggcggatggagatctacctctccctgggagtgctggccctcggcacgttgtccctgctggccgtgacctcactgccgtccattgcaaactcgctcaactggagggagttcagcttcgttcagtcctcactgggctttgtggccctcgtgctgagcacactgcacacgctcacctacggctggacccgcgccttcgaggagagccgctacaagttctacctgcctcccaccttcacgctcacgctgctggtgccctgcgtcgtcatcctggccaaagccctgtttctcctgccctgcatcagccgcagactcgccaggatccggagaggctgggagagggagagcaccatcaagttcacgctgcccacagaccacgccctggccgagaagacgagccacgtatgaggtgcctgccctgggctctggaccccgggcacacgagggacggtgccctgagcccgttaggttttcttttcttggtggtgcaaagtggtataactgtgtgcaaataggaggtttgaggtccaaattcctgggactcaaatgtatgcagtactattcagaatgatatacacacatatgtgtatatgtatttacatatattccacatatataacaggatttgcaattatacatagctagctaaaaagttgggtctctgagatttcaacttgtagatttaaaaacaagtgccgtacgttaagagaagagcagatcatgctattgtgacatttgcagagatatacacacactttttgtacagaagaggcttgtgctgtggtgggttcgatttatccctgcccaccccacccccacaacttcccttttgctacttccccaaggctcttgcagagctagggctctgaaggggagggaaggcaacggctctgcccagagccatccctggagcatgtgagcagcggctggtctcttccctccacctggggcagcagcaggaggcctggggaggaggaaaatcaggcagtcggcctggagtctgtgcctggtcctttgcccggtggtgggaggatggagggattgggctgaagctgctccacctcatccttgctgagtgggggagacattttccctgaaagtcagaagtcaccatagagcctgcaaatggatcctcctgtgagagtgacgtcacctcctttccagagccattagtgagcctggcttgggaacaagtgtaatttccttccctcctttaacctggcgatgagcgtcctttaaaccactgtgccttctcaccctttccatcttcagtttgaatgactcccaggaaggcctagagcagaccctttagaaatcagcccaagggggagagcaagagaaaacactctagggagtaaagctccccgggcgtcagagttgagccctgcctgggctgaaggactgtcttcacgaagtcagtcctgaggaaaaatattggggactccaaatgtcctctggcagaggacccagaaaaccacactggctccaacttcctcctcatggggcattacacttcaaaacagtggggagcaacttttccaccaaagctacaaacctaaaatgctgctgccccaaagcacaagagggaagagcaccgccggggccacaggacgtctgtcctccagtcacaggccatccttgctgctccctactgactctagcttacttcccctgtgaagaaacaggtgttctcggctgagcccccaaccctctgcagaaccaggttgatctgccacagaaaaagcatctttgaagacaaagagggtgaggtcttcatgagtctcctgggcccaaagccatcttctgatggaaggaagagagtagggccagtgaaggctgcccagagagaatgtcacagatgaggctgcccctgccccccccccgccagggaggtttcatgagctcatgtctatgcagcacataagggttcttcagtgaaaagcaggagaagagcccactgcaaggatagctcattaggcacatgaccgatgcagggaaggccatgccggggaagctcttcctgcaggtattttccatctgctgtgccaaggctgagcggcagaaacttgtctcataaattggcactgatggagcatcagctgtggcccacagagagccttgctgagaagggggcaggtaaagcagagattttagcattgccttggcataacaagggcccatcgattccctactaatgagaggcagggagagcatgggcaatggagacccaccaatgatccccaaccccggtgggtactggctgcctgccctgggccagggaatggctccttataccaaagatgctggcacatagcagaacccagtgcacgtcctccccttcccacccacctctggctgaaggtgctcaagagggaagcaattataaggtgggtggcaggagggaacaggtgccacctgctggacaatcacacgaaaggcaggcgggctgtgtactgggccctgactgtgcgtccactgctgtcttccctacctcaccaggctactggcagcagcatcccgagagcacatcatctccacagcctggtaaattccatgtgcctctgggtacaaaagtgcctcaacgacatgctctggaaatcccaaatgccacagtctgaggttgatatctaaaatctatgccttcaaaagagtctctgttttttttttttaacctggtagacagtataaaagcagtgcaaataaacacctaaccttctgcaaa

SEQ ID NO: 20725 - DNA, 3915 bp, Homo sapiens
  ENST00000393106
accgccttcgccgcggaccttcagctgccgcggtcgctccgagcggcgggccgcagaggttcaagcgattctcctgcttcagcctccggagtagctgggattacaggcacgtgccaacacacccagccaccaaaatgccagaagagatggacaagccactgatcagcctccacctggtggacagcgatagtagccttgccaaggtccccgatgaggcccccaaagtgggcatcctgggtagcggggactttgcccgctccctggccacacgcctggtgggctctggcttcaaagtggtggtggggagccgcaaccccaaacgcacagccaggctgtttccctcagcggcccaagtgactttccaagaggaggcagtgagctccccggaggtcatctttgtggctgtgttccgggagcactactcttcactgtgcagtctcagtgaccagctggcgggcaagatcctggtggatgtgagcaaccctacagagcaagagcaccttcagcatcgtgagtccaatgctgagtacctggcctccctcttccccacttgcacagtggtcaaggccttcaatgtcatctctgcctggaccctgcaggctggcccaagggatggtaacaggcaggtgcccatctgcggtgaccagccagaagccaagcgtgctgtctcggagatggcgctcgccatgggcttcatgcccgtggacatgggatccctggcgtcagcctgggaggtggaggccatgcccctgcgcctcctcccggcctggaaggtgcccaccctgctggccctggggctcttcgtctgcttctatgcctacaacttcgtccgggacgttctgcagccctatgtgcaggaaagccagaacaagttcttcaagctgcccgtgtccgtggtcaacaccacactgccgtgcgtggcctacgtgctgctgtcactcgtgtacttgcccggcgtgctggcggctgccctgcagctgcggcgcggcaccaagtaccagcgcttccccgactggctggaccactggctacagcaccgcaagcagatcgggctgctcagcttcttctgcgccgccctgcacgccctctacagcttctgcttgccgctgcgccgcgcccaccgctacgacctggtcaacctggcagtcaagcaggtcttggccaacaagagccacctctgggtggaggaggaggtctggcggatggagatctacctctccctgggagtgctggccctcggcacgttgtccctgctggccgtgacctcactgccgtccattgcaaactcgctcaactggagggagttcagcttcgttcagtcctcactgggctttgtggccctcgtgctgagcacactgcacacgctcacctacggctggacccgcgccttcgaggagagccgctacaagttctacctgcctcccaccttcacgctcacgctgctggtgccctgcgtcgtcatcctggccaaagccctgtttctcctgccctgcatcagccgcagactcgccaggatccggagaggctgggagagggagagcaccatcaagttcacgctgcccacagaccacgccctggccgagaagacgagccacgtatgaggtgcctgccctgggctctggaccccgggcacacgagggacggtgccctgagcccgttaggttttcttttcttggtggtgcaaagtggtataactgtgtgcaaataggaggtttgaggtccaaattcctgggactcaaatgtatgcagtactattcagaatgatatacacacatatgtgtatatgtatttacatatattccacatatataacaggatttgcaattatacatagctagctaaaaagttgggtctctgagatttcaacttgtagatttaaaaacaagtgccgtacgttaagagaagagcagatcatgctattgtgacatttgcagagatatacacacactttttgtacagaagaggcttgtgctgtggtgggttcgatttatccctgcccaccccacccccacaacttcccttttgctacttccccaaggctcttgcagagctagggctctgaaggggagggaaggcaacggctctgcccagagccatccctggagcatgtgagcagcggctggtctcttccctccacctggggcagcagcaggaggcctggggaggaggaaaatcaggcagtcggcctggagtctgtgcctggtcctttgcccggtggtgggaggatggagggattgggctgaagctgctccacctcatccttgctgagtgggggagacattttccctgaaagtcagaagtcaccatagagcctgcaaatggatcctcctgtgagagtgacgtcacctcctttccagagccattagtgagcctggcttgggaacaagtgtaatttccttccctcctttaacctggcgatgagcgtcctttaaaccactgtgccttctcaccctttccatcttcagtttgaatgactcccaggaaggcctagagcagaccctttagaaatcagcccaagggggagagcaagagaaaacactctagggagtaaagctccccgggcgtcagagttgagccctgcctgggctgaaggactgtcttcacgaagtcagtcctgaggaaaaatattggggactccaaatgtcctctggcagaggacccagaaaaccacactggctccaacttcctcctcatggggcattacacttcaaaacagtggggagcaacttttccaccaaagctacaaacctaaaatgctgctgccccaaagcacaagagggaagagcaccgccggggccacaggacgtctgtcctccagtcacaggccatccttgctgctccctactgactctagcttacttcccctgtgaagaaacaggtgttctcggctgagcccccaaccctctgcagaaccaggttgatctgccacagaaaaagcatctttgaagacaaagagggtgaggtcttcatgagtctcctgggcccaaagccatcttctgatggaaggaagagagtagggccagtgaaggctgcccagagagaatgtcacagatgaggctgcccctgccccccccccgccagggaggtttcatgagctcatgtctatgcagcacataagggttcttcagtgaaaagcaggagaagagcccactgcaaggatagctcattaggcacatgaccgatgcagggaaggccatgccggggaagctcttcctgcaggtattttccatctgctgtgccaaggctgagcggcagaaacttgtctcataaattggcactgatggagcatcagctgtggcccacagagagccttgctgagaagggggcaggtaaagcagagattttagcattgccttggcataacaagggcccatcgattccctactaatgagaggcagggagagcatgggcaatggagacccaccaatgatccccaaccccggtgggtactggctgcctgccctgggccagggaatggctccttataccaaagatgctggcacatagcagaacccagtgcacgtcctccccttcccacccacctctggctgaaggtgctcaagagggaagcaattataaggtgggtggcaggagggaacaggtgccacctgctggacaatcacacgaaaggcaggcgggctgtgtactgggccctgactgtgcgtccactgctgtcttccctacctcaccaggctactggcagcagcatcccgagagcacatcatctccacagcctggtaaattccatgtgcctctgggtacaaaagtgcctcaacgacatgctctggaaatcccaaatgccacagtctgaggttgatatctaaaatctatgccttcaaaagagtctctgttttttttttttaacctggtagacagtataaaagcagtgcaaataaacacctaaccttctgcaaa

SEQ ID NO: 20726 - DNA, 2103 bp, Homo sapiens
  ENST00000409811
agctgccgcggtcgctccgagcggcgggccgcagagccaccaaaatgccagaagagatggacaagccactgatcagcctccacctggtggacagcgatagtagccttgccaaggtccccgatgaggcccccaaagtgggcatcctgggtagcggggactttgcccgctccctggccacacgcctggtgggctctggcttcaaagtggtggtggggagccgcaaccccaaacgcacagccaggctgtttccctcagcggcccaagtgactttccaagaggaggcagtgagctccccggaggtcatctttgtggctgtgttccgggagcactactcttcactgtgcagtctcagtgaccagctggcgggcaagatcctggtggatgtgagcaaccctacagagcaagagcaccttcagcatcgtgagtccaatgctgagtacctggcctccctcttccccacttgcacagtggtcaaggccttcaatgtcatctctgcctggaccctgcaggctggcccaagggatggtaacaggcaggtgcccatctgcggtgaccagccagaagccaagcgtgctgtctcggagatggcgctcgccatgggcttcatgcccgtggacatgggatccctggcgtcagcctgggaggtggaggccatgcccctgcgcctcctcccggcctggaaggtgcccaccctgctggccctggggctcttcgtctgcttctatgcctacaacttcgtccgggacgttctgcagccctatgtgcaggaaagccagaacaagttcttcaagctgcccgtgtccgtggtcaacaccacactgccgtgcgtggcctacgtgctgctgtcactcgtgtacttgcccggcgtgctggcggctgccctgcagctgcggcgcggcaccaagtaccagcgcttccccgactggctggaccactggctacagcaccgcaagcagatcgggctgctcagcttcttctgcgccgccctgcacgccctctacagcttctgcttgccgctgcgccgcgcccaccgctacgacctggtcaacctggcagtcaagcaggtcttggccaacaagagccacctctgggtggaggaggaggtctggcggatggagatctacctctccctgggagtgctggccctcggcacgttgtccctgctggccgtgacctcactgccgtccattgcaaactcgctcaactggagggagttcagcttcgttcagtgtgtggcaacttccagtgcaggaaacacaggcagtggaacccgaagacctgaatctcagtcccaagacccccacttacctgccccgcatcatcagacaagtttcctaggccctcggagcttctgctgctcacttgtgcctgtgtccaccccatatggtcatcaagaggatttgagctggacacgttaaatgcaggatgcgtgcagccaacagtggcatgctggcttttgagtcctcactgggctttgtggccctcgtgctgagcacactgcacacgctcacctacggctggacccgcgccttcgaggagagccgctacaagttctacctgcctcccaccttcacgctcacgctgctggtgccctgcgtcgtcatcctggccaaagccctgtttctcctgccctgcatcagccgcagactcgccaggatccggagaggctgggagagggagagcaccatcaagttcacgctgcccacagaccacgccctggccgagaagacgagccacgtatgaggtgcctgccctgggctctggaccccgggcacacgagggacggtgccctgagcccgttaggttttcttttcttggtggtgcaaagtggtataactgtgtgcaaataggaggtttgaggtccaaattcctgggactcaaatgtatgcagtactattcagaatgatatacacacatatgtgtatatgtatttacatatattccacatatataacaggatttgcaattatacatagctagctaaaaagttgggtctctgagatttcaacttgtagatttaaaaacaagtgccgtacgttaagagaagagcagatcatgctattgtgacatttgcagagatatacacacactttttgtacagaa

SEQ ID NO: 20727 - DNA, 1871 bp, Homo sapiens
  ENST00000393107
agctgccgcggtcgctccgagcggcgggccgcagagccaccaaaatgccagaagagatggacaagccactgatcagcctccacctggtggacagcgatagtagccttgccaaggtccccgatgaggcccccaaagtgggcatcctgggtagcggggactttgcccgctccctggccacacgcctggtgggctctggcttcaaagtggtggtggggagccgcaaccccaaacgcacagccaggctgtttccctcagcggcccaagtgactttccaagaggaggcagtgagctccccggaggtcatctttgtggctgtgttccgggagcactactcttcactgtgcagtctcagtgaccagctggcgggcaagatcctggtggatgtgagcaaccctacagagcaagagcaccttcagcatcgtgagtccaatgctgagtacctggcctccctcttccccacttgcacagtggtcaaggccttcaatgtcatctctgcctggaccctgcaggctggcccaagggatggtaacaggcaggtgcccatctgcggtgaccagccagaagccaagcgtgctgtctcggagatggcgctcgccatgggcttcatgcccgtggacatgggatccctggcgtcagcctgggaggtggaggccatgcccctgcgcctcctcccggcctggaaggtgcccaccctgctggccctggggctcttcgtctgcttctatgcctacaacttcgtccgggacgttctgcagccctatgtgcaggaaagccagaacaagttcttcaagctgcccgtgtccgtggtcaacaccacactgccgtgcgtggcctacgtgctgctgtcactcgtgtacttgcccggcgtgctggcggctgccctgcagctgcggcgcggcaccaagtaccagcgcttccccgactggctggaccactggctacagcaccgcaagcagatcgggctgctcagcttcttctgcgccgccctgcacgccctctacagcttctgcttgccgctgcgccgcgcccaccgctacgacctggtcaacctggcagtcaagcaggtcttggccaacaagagccacctctgggtggaggaggaggtctggcggatggagatctacctctccctgggagtgctggccctcggcacgttgtccctgctggccgtgacctcactgccgtccattgcaaactcgctcaactggagggagttcagcttcgttcagtcctcactgggctttgtggccctcgtgctgagcacactgcacacgctcacctacggctggacccgcgccttcgaggagagccgctacaagttctacctgcctcccaccttcacgctcacgctgctggtgccctgcgtcgtcatcctggccaaagccctgtttctcctgccctgcatcagccgcagactcgccaggatccggagaggctgggagagggagagcaccatcaagttcacgctgcccacagaccacgccctggccgagaagacgagccacgtatgaggtgcctgccctgggctctggaccccgggcacacgagggacggtgccctgagcccgttaggttttcttttcttggtggtgcaaagtggtataactgtgtgcaaataggaggtttgaggtccaaattcctgggactcaaatgtatgcagtactattcagaatgatatacacacatatgtgtatatgtatttacatatattccacatatataacaggatttgcaattatacatagctagctaaaaagttgggtctctgagatttcaacttgtagatttaaaaacaagtgccgtacgttaagagaagagcagatcatgctattgtgacatttgcagagatatacacacactttttgtacagaa

SEQ ID NO: 20728 - DNA, 2743 bp, Homo sapiens
  ENST00000358794
gaattcccctcggccctacaggaccaaacgaccggcgcgctgagaaagggtgtgcggttccactgaggacgcccaagcgggacagccgggcccgccgcggtgagatccccggcctgtccagcccaagcccaagcgccctcgcggtcacgtggcatttccggaacattcagaacctaacagccaggaggcaggagggccgggccgaggccggagcgctggacaacgcgggtagctggcgctcgagggacaggcagctcccaccggctaggacccccatcccgatgcgcgggcgaagggctggggccctgtgccgctggcgatcccggggaccgcctggaactcgcggcactcgggagcgagagggaaagcaacccagaggccccgcagccgccggcgacacagctacagaccccgactgcagccggtactcccatatatcaggggcggggcgaaacccggccttttgaagggcagcgatttaaaccaatcagcgcaaagagttggcaaccctccgcccaattggaatcgctctcattctgaaggcggttccgacatggagtccggcagcccaatgggagaggtggaaatttccagaacgatcagaaccaatgggcgcggccagcgcggctacgattggcagtgcaaaagaccaatccgtgtcgcagaagttcgctcctccctccattcgtggagcctgagatgggtcaatgagctgaaggagaaaggcaacaaggccctgagcgtgggtaacatcgatgatgccttacagtgctactccgaagctattaagctggatccccacaaccacgtgctgtacagcaaccgttctgctgcctatgccaagaaaggagactaccagaaggcttatgaggatggctgcaagactgtcgacctaaagcctgactggggcaagggctattcacgaaaagcagcagctctagagttcttaaaccgctttgaagaagccaagcgaacctatgaggagggcttaaaacacgaggcaaataaccctcaactgaaagagggtttacagaatatggaggccaggttggcagagagaaaattcatgaaccctttcaacatgcctaatctgtatcagaagttggagagtgatcccaggacaaggacactactcagtgatcctacctaccgggagctgatagagcagctacgaaacaagccttctgacctgggcacgaaactacaagatccccggatcatgaccactctcagcgtcctccttggggtcgatctgggcagtatggatgaggaggaagagattgcaacacctccaccaccaccccctcccaaaaaggagaccaagccagagccaatggaagaagatcttccagagaataagaagcaggcactgaaagaaaaagagctggggaacgatgcctacaagaagaaagactttgacacagccttgaagcattacgacaaagccaaggagctggaccccactaacatgacttacattaccaatcaagcagcggtatactttgaaaagggcgactacaataagtgccgggagctttgtgagaaggccattgaagtggggagagaaaaccgagaagactatcgacagattgccaaagcatatgctcgaattggcaactcctacttcaaagaagaaaagtacaaggatgccatccatttctataacaagtctctggcagagcaccgaaccccagatgtgctcaagaaatgccagcaggcagagaaaatcctgaaggagcaagagcggctggcctacataaaccccgacctggctttggaggagaagaacaaaggcaacgagtgttttcagaaaggggactatccccaggccatgaagcattatacagaagccatcaaaaggaacccgaaagatgccaaattatacagcaatcgagctgcctgctacaccaaactcctggagttccagctggcactcaaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggagagaaggcctcatctctctatatttatacataaccccggggaagacacagagactcgtacctgcgctgtttgtgccgccgctgcctctgggccctcccagcacacgcatggtctcttcaccgctgccctcgagttccatgtctctttcccctgcccctagttgctgtctcggctgctctcccatagttggttttttttttatttggggcagtgggcatgttatggggaggggagggggttcttccagcctcaggtcccagctgtctcacgttgtttattctgcgtccccttctccaataaaacaagccagttgggcgtggttata

SEQ ID NO: 20729 - DNA, 2196 bp, Homo sapiens
  ENST00000305218
ctagaagaactcgaccagtgagcaggcgaggaaggggcgggagccggggtcccggtagcttctagtaggttccagaaggcggcgcgtgcggttgggaacgcggagcggacggattcgattcaacggggttccggaccgcgctgcgctatggagcaggtcaatgagctgaaggagaaaggcaacaaggccctgagcgtgggtaacatcgatgatgccttacagtgctactccgaagctattaagctggatccccacaaccacgtgctgtacagcaaccgttctgctgcctatgccaagaaaggagactaccagaaggcttatgaggatggctgcaagactgtcgacctaaagcctgactggggcaagggctattcacgaaaagcagcagctctagagttcttaaaccgctttgaagaagccaagcgaacctatgaggagggcttaaaacacgaggcaaataaccctcaactgaaagagggtttacagaatatggaggccaggttggcagagagaaaattcatgaaccctttcaacatgcctaatctgtatcagaagttggagagtgatcccaggacaaggacactactcagtgatcctacctaccgggagctgatagagcagctacgaaacaagccttctgacctgggcacgaaactacaagatccccggatcatgaccactctcagcgtcctccttggggtcgatctgggcagtatggatgaggaggaagagattgcaacacctccaccaccaccccctcccaaaaaggagaccaagccagagccaatggaagaagatcttccagagaataagaagcaggcactgaaagaaaaagagctggggaacgatgcctacaagaagaaagactttgacacagccttgaagcattacgacaaagccaaggagctggaccccactaacatgacttacattaccaatcaagcagcggtatactttgaaaagggcgactacaataagtgccgggagctttgtgagaaggccattgaagtggggagagaaaaccgagaagactatcgacagattgccaaagcatatgctcgaattggcaactcctacttcaaagaagaaaagtacaaggatgccatccatttctataacaagtctctggcagagcaccgaaccccagatgtgctcaagaaatgccagcaggcagagaaaatcctgaaggagcaagagcggctggcctacataaaccccgacctggctttggaggagaagaacaaaggcaacgagtgttttcagaaaggggactatccccaggccatgaagcattatacagaagccatcaaaaggaacccgaaagatgccaaattatacagcaatcgagctgcctgctacaccaaactcctggagttccagctggcactcaaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggagagaaggcctcatctctctatatttatacataaccccggggaagacacagagactcgtacctgcgctgtttgtgccgccgctgcctctgggccctcccagcacacgcatggtctcttcaccgctgccctcgagttccatgtctctttcccctgcccctagttgctgtctcggctgctctcccatagttggttttttttttatttggggcagtgggcatgttatggggaggggagggggttcttccagcctcaggtcccagctgtctcacgttgtttattctgcgtccccttctccaataaaacaagccagttgggcgtggttata

SEQ ID NO: 20730 - DNA, 738 bp, Homo sapiens
  ENST00000536973
tccagaaggcggcgcgtgcggttgggaacgcggagcggacggattcgattcaacggggttccggaccgcgctgcgctatggagcaggtcaatgagctgaaggagaaaggcaacaaggccctgagcgtgggtaacatcgatgatgccttacagtgctactccgaagctattaagctggatccccacaaccacgtgctgtacagcaaccgttctgctgcctatgccaagaaaggagactaccagaaggcttatgaggatggctgcaagactgtcgacctaaagcctgactggggcaagggctattcacgaaaagcagcagctctagagttcttaaaccgctttgaagaagccaagcgaacctatgaggagggcttaaaacacgaggcaaataaccctcaactgaaagagggtttacagaatatggaggccaggttggcagtacaaccggcacgacagccccgaagatgtgaagcgacgagccatggccgaccctgaggtgcagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggag

SEQ ID NO: 20731 - DNA, 1900 bp, Homo sapiens
  ENST00000538945
ggttgggaacgcggagcggacggattcgattcaacggggttccggaccgcgctgcgctatggagcaggtcaatgagctgaaggagaaaggcaacaaggccctgagcgtgggtaacatcgatgatgccttacagtgctactccgaagctattaagctggatccccacaaccacgtgctgtacagcaaccgttctgctgcctatgccaagaaaggagactaccagaaggcttatgaggatggctgcaagactgtcgacctaaagcctgactggggcaagggcttaaaacacgaggcaaataaccctcaactgaaagagggtttacagaatatggaggccaggttggcagagagaaaattcatgaaccctttcaacatgcctaatctgtatcagaagttggagagtgatcccaggacaaggacactactcagtgatcctacctaccgggagctgatagagcagctacgaaacaagccttctgacctgggcacgaaactacaagatccccggatcatgaccactctcagcgtcctccttggggtcgatctgggcagtatggatgaggaggaagagattgcaacacctccaccaccaccccctcccaaaaaggagaccaagccagagccaatggaagaagatcttccagagaataagaagcaggcactgaaagaaaaagagctggggaacgatgcctacaagaagaaagactttgacacagccttgaagcattacgacaaagccaaggagctggaccccactaacatgacttacattaccaatcaagcagcggtatactttgaaaagggcgactacaataagtgccgggagctttgtgagaaggccattgaagtggggagagaaaaccgagaagactatcgacagattgccaaagcatatgctcgaattggcaactcctacttcaaagaagaaaagtacaaggatgccatccatttctataacaagtctctggcagagcaccgaaccccagatgtgctcaagaaatgccagcaggcagagaaaatcctgaaggagcaagagcggctggcctacataaaccccgacctggctttggaggagaagaacaaaggcaacgagtgttttcagaaaggggactatccccaggccatgaagcattatacagaagccatcaaaaggaacccgaaagatgccaaattatacagcaatcgagctgcctgctacaccaaactcctggagttccagctggcactcaaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggagagaaggcctcatctctctatatttatacataaccccggggaagacacagagactcgtacctgcgctgtttgtgccgccgctgcctctgggccctcccagcacacgcatggtctcttcaccgctgccctcgagttccatgtctctttcccctgcccctagttgctgtctcggctgctctcccatagttgg

SEQ ID NO: 20732 - DNA, 772 bp, Homo sapiens
  ENST00000543847
ggattcgattcaacggggttccggaccgcgctgcgctatggagcaggtcaatgagctgaaggagaaaggcaacaaggccctgagcgtgggtaacatcgatgatgccttacagtgctactccgaagctattaagctggatccccacaaccacgtgctgtacagcaaccgttctgctgcctatgccaagaaaggagactaccagaaggcttatgaggatggctgcaagactgtcgacctaaagcctgactggggcaagggctattcacgaaaagcagcagctctagagttcttaaaccgctttgaagaagccaagcgaacctatgaggagggcttaaaacacgaggcaaataaccctcaactgaaagagggtttacagaatatggaggccaggttggcagagagaaaattcatgaaccctttcaacatgcctaatctgtatcagaagttggagagtgatcccaggacaaggacactactcagtgatcctacctaccgggagctgatagagcagctacgaaacaagccttctgacctgggcacgaaactacaagatccccggatcatgaccactctcagcgtcctccttggggtcgatctgggcagtatggatgaggaggaagagattgcaacacctccaccaccaccccctcccaaaaaggagaccaagccagagccaatggaagaagatcttccagagaataagaagcaggtcttgtttttttctctcctcactgtcacctatctataaacaactagaaatctttatgttgaa

SEQ ID NO: 20733 - DNA, 399 bp, Homo sapiens
  ENST00000540736
tcaacggggttccggaccgcgctgcgctatggagcaggtcaatgagctgaaggagaaaggcaacaaggccctgagcgtgggtaacatcgatgatgccttacagtgctactccgaagctattaagctggatccccacaaccacgtgctgtacagcaaccgttctgctgcctatgccaagaaaggagactaccagaaggcttatgaggatggctgcaagactgtcgacctaaagcctgactggggcaaggtcagctgtgggcagtggagggagagaggcccttcagacccttccagaaatgccttttggtggcctgaggtttacctgtcctgatacactgatagttacctacccacctccctgtttgagtatcctcctcagaaatggcatttttcatcaaa

SEQ ID NO: 20734 - DNA, 880 bp, Homo sapiens
  ENST00000540501
cctgctcggggaccggcggtggccaggccgcggtaggggggcggggcgggcgccggatccaggagaccggagctcggcgctggggccggacggggcggcggcggggaggtgagggccgcgggcggcgggcgggagcgggatctttagcgaggccggccgcggggagcgcccatcgccccctggttgggcgaggagggcccggcggaggccacagcttgggtcaatgagctgaaggagaaaggcaacaaggccctgagcgtgggtaacatcgatgatgccttacagtgctactccgaagctattaagctggatccccacaaccacgtgctgtacagcaaccgttctgctgcctatgccaagaaaggagactaccagaaggcttatgaggatggctgcaagactgtcgacctaaagcctgactggggcaagggctattcacgaaaagcagcagctctagagttcttaaaccgctttgaagaagccaagcgaacctatgaggagggcttaaaacacgaggcaaataaccctcaactgaaagagggtttacagaatatggaggccaggttggcagagagaaaattcatgaaccctttcaacatgcctaatctgtatcagaagttggagagtgatcccaggacaaggacactactcagtgatcctacctaccgggagctgatagagcagctacgaaacaagccttctgacctgggcacgaaactacaagatccccggatcatgaccactctcagcgtcctccttggggtcgatctgggcagtatggatgaggaggaagagattgcaacacctccaccaccaccccctcccaaaaaggagaccaagccagagccaatggaagaagatcttccagagaataagaagc

SEQ ID NO: 20735 - DNA, 562 bp, Homo sapiens
  ENST00000544739
actcagccgcttctcatcctctcaccaccccctctgctatggttccctgacaactaagaccctgaggcaaccacaagactgacaccagatctgctgcagcctcagaataaagcctggtccaaaactctgctgtcctcaccggttgcttcaagtcgaagggatttcctctcccctaaagaagcgctctgcttcctgacaaagatctaggagagcactgaaagaaaaagagctggggaacgatgcctacaagaagaaagactttgacacagccttgaagcattacgacaaagccaaggagctggaccccactaacatgacttacattaccaatcaagcagcggtatactttgaaaagggcgactacaataagtgccgggagctttgtgagaaggccattgaagtggggagagaaaaccgagaagactatcgacagattgccaaagcatatgctcgaattggcaactcctacttcaaagaagaaaagtacaaggatgccatccatttctataacaagtctctggcagagcaccgaaccccagatgtgctcaagaaatgccagcag

SEQ ID NO: 20736 - DNA, 601 bp, Homo sapiens
  ENST00000537479
atttcctctcccctaaagaagcgctctgcttcctgacaaagatctaggagagtaggtggaaaagggggagtttcagagcaagcaaagatgaagttagttttcattctaacggctgatactttattgtctatagctgactgatgaagaggccttcaggagaacttgatagaattctattcatgcactgaaagaaaaagagctggggaacgatgcctacaagaagaaagactttgacacagccttgaagcattacgacaaagccaaggagctggaccccactaacatgacttacattaccaatcaagcagcggtatactttgaaaagggcgactacaataagtgccgggagctttgtgagaaggccattgaagtggggagagaaaaccgagaagactatcgacagattgccaaagcatatgctcgaattggcaactcctacttcaaagaagaaaagtacaaggatgccatccatttctataacaagtctctggcagagcaccgaaccccagatgtgctcaagaaatgccagcaggcagagaaaatcctgaaggagcaagagcggctggcctacataaaccccgacctggctttggaggagaag

SEQ ID NO: 20737 - DNA, 582 bp, Homo sapiens
  ENST00000538497
cagaacttgtgacagatcatagattcttgctttgtcacctgagttagatttgctcagcactcacttctaaacctcatctaggcactgaaagaaaaagagctggggaacgatgcctacaagaagaaagactttgacacagccttgaagcattacgacaaagccaaggagctggaccccactaacatgacttacattaccaatcaagcagcggtatactttgaaaagggcgactacaataagtgccgggagctttgtgagaaggccattgaagtggggagagaaaaccgagaagactatcgacagattgccaaagcatatgctcgaattggcaactcctacttcaaagaagaaaagtacaaggatgccatccatttctataacaagtctctggcagagcaccgaaccccagatgtgctcaagaaatgccagcaggcagagaaaatcctgaaggagcaagagcggctggcctacataaaccccgacctggctttggaggagaagaacaaaggcaacgagtgttttcagaaaggggactatccccaggccatgaagcattatacagaagccatcaaaaggaacccg

SEQ ID NO: 20738 - DNA, 877 bp, Homo sapiens
  ENST00000540887
gcctgctacaccaaactcctggagttccagctggcactcaaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgagtacgtagagtcagagaggcggccttgctggaaatggagaacaaaagcaggcagatgagtgcacgcggctggggggtggtatgctcagtctgcgaggaagaggaattctgtcattcttcctaaacttaaggagattggcagtgggtggcgagctggaagggctttgttagtcgtgatagcttaagcagtcatttggaaaggcccatttagctgggagaaaggtcttgactggaagctgtgtcgtgggctcaagagtaggactggcaagttctgcgaagtggagcaggcctctgcagctcggcgccccgggcctcgccaggacccctccctgccggggccttctgtagagggggttgaattggggcttgctctgagagcaagtaagactttaaaggttgtctcatttcaagtaactgcgtcttcctctgtagacacttaaagaatcctgtaatagcacagaagatccagaagctgatggatgtgggtctgattgcaattcggtgatgacttgttcatccccc

SEQ ID NO: 20739 - DNA, 528 bp, Homo sapiens
  ENST00000355603
tttttttttttttttttttttttagtagagatggggtttcaccatgttggccaggctggtgtcaaactcctgacctcaggtgatccacccaccttggccttccagagtgctgggattacaggcatgagccaccgcacccagcgttgttttgttttttagtcagcaatggttttggattccaaagctctcaggaccaaggcccacgcattttgtctagttgtcatgtactcttcagtttctcaaactggaattgtcccccgctatgtgtttttcataacatcagcctcttgcagagtccaggcagtttgtcttgtgtgggatgatccatcatctggagttgtctttcctgatgttgtcccctctgtttggtgctgggtgaggcattagagttggaagtccacatgcttgagttgcctgtactgagcttgtccaagggaatgagcctaatttctttctgttgcttcattctaggactgtgaggaatgtatccagctggagccgaccttcatcaagggttatacacggaaa

SEQ ID NO: 20740 - DNA, 5287 bp, Homo sapiens
  ENST00000263955
ccgcgactgcaagcttcggtagtcctctccgctgctgtcgccaggagtcacttcacgagaagccaggtcacaaccgtcggcccttgtctggaaaagtaaaagtggatcctgccacgttcggagctccctggcgcctcgcccggctggagctagagaactcgtcctgtggcggcccccggcgtggggcgggacagcggccccctggagggggcagtcccgggagaacctgcggcggccggagcggtaaaaataagtgactaaagaagcagacctgggaatcacctaacatgtcgaggaggagatttgattgccgaagtatttcaggcctactaactacaactcctcaaattccaataaaaatggaaaactttaataatttctatatacttacatctaaagagctagggagaggaaaatttgctgtggttagacaatgtatatcaaaatctactggccaagaatatgctgcaaaatttctaaaaaagagaagaagaggacaggattgtcgagcagaaattttacacgagattgctgtgcttgaattggcaaagtcttgtccccgtgttattaatcttcatgaggtctatgaaaatacaagtgaaatcattttgatattggaatatgctgcaggtggagaaattttcagcctgtgtttacctgagttggctgaaatggtttctgaaaatgatgttatcagactcattaaacaaatacttgaaggagtttattatctacatcagaataacattgtacaccttgatttaaagccacagaatatattactgagcagcatataccctctcggggacattaaaatagtagattttggaatgtctcgaaaaatagggcatgcgtgtgaacttcgggaaatcatgggaacaccagaatatttagctccagaaatcctgaactatgatcccattaccacagcaacagatatgtggaatattggtataatagcatatatgttgttaactcacacatcaccatttgtgggagaagataatcaagaaacatacctcaatatttctcaagttaatgtagattattcggaagaaactttttcatcagtttcacagctggccacagactttattcagagccttttagtaaaaaatccagagaaaagaccaacagcagagatatgcctttctcattcttggctacagcagtgggactttgaaaacttgtttcaccctgaagaaacttccagttcctctcaaactcaggatcattctgtaaggtcctctgaagacaagacttctaaatcctcctgtaatggaacctgtggtgatagagaagacaaagagaatatcccagaggatagcagcatggtttccaaaagatttcgtttcgatgactcattacccaatccccatgaacttgtttcagatttgctctgttagcacttttttctttgactcatttggactgaatttgaaattttatatccactccagtgagattatgatttgtagcttcatatatgacatgtttatattgtaaatgcacttttccatggaataatttagggaagtgttttaatgttaaattactagttgctagcatgttatgatttcatatcctgagatagctctgcagataagaaaatatttaaatatatgacaaaaagtaaaattgtacatgtgagtttacatgttaatgaaataattcaacttcaaatgaacttaccagaatgttttgcatatcaacaaaaaaagtggcttgagttttattatagttggtgtaaactgaacacagtgaagacattggaatttaataggttctctctctaaggtgactcttataccatgcctctatcaacataatttgtttaggaaagcagtatgaagtttaagccaaaataatttctactttatagatgctcaagagacattttacaattgaaaatgtctttcaattacaaatattttgaaacttcgtaagattttcattctctgtggtctgttatatgagagagatcctttaactagagcaaagagggagttagaaacctgatcagggatattctttacaagttggagcagaggaaagagtagcatgccttcgtattttaacgcaaatgtctttttcctcctcccaacctacttgagatctgataaggtctggaagatggagatatttggtatgcaagtgtagagttttttaatcctccagaatttctagagtagaagatacttaggtatagttaaatattctgtatttttagtcaaacatatttattaattgaatatagaagaaaatgttgacacactcagacagcttactgaattttagatgtcttctgcatcttagaatacaagccagtcattcagagttctaaaagtatgcataaaaaattacagcaccggtaggtctattaacacagtgcccgagtcagcggtagcaagactgatgtgatcataaaacatgacatcaggctcgtctgaagttcttgtgtgaaattcctagtgagtgaggaggctcagcttaaagccatctgcagagtggcccctcattgtggtcttttgctgggaccaatgcaagagactagggagagcaaaatgtttgcttatggctagagactatatccagccctaatgatggggaaagttagtccttttcgggtaatcttttatgaattttcacctgatgaccgttatattggtctgttatcatgttacgataactgtgatctcatgaccatgttgctgtatcagaagaaatagtttgacaaatggtaacaacaacctgatgttccccctttagacctttaacttctcaaaattttggtaagtttccaaattctttaataataacttaaaactttttgaataactatcaggtcactttatttgaccacatggtgaattcctttaatgtcttcagcatttgttaaggaaaagttttctctacttgtgtgtgtatgtgtgcacatgtgtgtatgtacaggtgtatgtatatatctatagatagatacaatacattctttagacacttttcaagattctttgctgtggtatattgtgctcaactcaggtgccaaaggagctttttttttttttttttttttttgagatggagttttgctctgtctctcaggctggagtgcagtggcatgatctcagctcacggcaacctctgcctcccgggttcaagcaattctcctgtctcagcctcctgagtagttgggattacaggcgcatgccaccgtgcccagctaatttttgtatttttagtagagacggggtttcaccatgttggccaggctggtcacaaactcctgacttcaagtgatccacccgcctcggcctcccaaagtgctgggattacaggcgtgagccactgcgcccccgcccaggagctcttttcttatgacatataaattatgacatttatattctttatatgactttatgttctcttcttatgacatttaaattctttaagtagtttgttggtccaataaactagacgttgtataatctaaattgagcccttgtatatctaaaactgatgagttgtttctaaattgttgattgtccatttacttgcctttggtattaagataatgcaagtaaagtttagtaagtcattggataatgaaatgattatgtttctgaagaccatattatatttttaatttttagaggaatcatgccatcccccaaaaaatcaagaaatatttgaattttaaattataagttcatttgttaaaagacatttttacaaatgtctgaaaatcttaaaatactttacatctacctttaagtagtagaatacagagctgtaaatttccatgccttttttcctgatattaagttttatagtaaaaaagcaactagtgattgcacaaagaatataaaaatccactctttttacaaaggtgtgaatttaaataacgttattgattggaatatgaaaatagaccaatcatttaagagctttttagcaaatgattcaattcttactctttttctcccaagattgaaaagcataatgtatttctctaaagtaggaatctagagagcccctgtgagtggacaaatgtcagtaacacttgaacacatgagaagataagtgttatgttgtgataatttaaagttaaatttgctttttgggtaggatccctaaatagatgggatttttaaatagatgatatatagatgacaattgcaattgtcattttaattattttccctacagtaaagaacctagctctgagcagtgaaattgtaatggcactttaaaggaagtaagccgttaactgttctctagtggagcgatctccaactgttttggcactagggacgggttttgtggaagaaaatttttccacaggactgggggtttagggggatggtttcaggatgattcaagtacattacatttatcattagattctcataaggagcatgcaacctagatctcttgcacgtgtggttcacagcaggattcgagctcctttgagaatctaatgccatggctgatctaacaggaaactgagctcaggcagtaatgcttggcaccgccccccaccttctatgcagcccggtcgtggcctggggactggggacccctgctctagtcagtaataaggtacttgtgccagaatataaatcaacacattgcttcctttatcaaagaagtcttgttatttaaaaaaagtcaactgagccagtatgattagtgatgtaattgattttcattctggcacaagcctctttcattctggacagctcacaaatagttaatggaccatgctttgaatagccttcctctaagcaacatttataaatactgatattttagaactgtttacatttcttctgtttatttttgaattttcagtttgatatcttgtccttattcattgttgtataaacaactgtactttaatttcaagtagtattaaaagtatttcacttcagtttggggggattattatcaatttataattttataaaagtattttaaagaataattgtaaattttccataaattacaacttcctgccatattttattaaataataatcttgcttaaggcatatagacagacattattatgagtattccagtaaaaaaaatctacatcaacttgaccattctggctaaaaattaaaaagcacttttttatatctgtggttgtcatttgtttcaaagcatttctaaatttattgttcttaaaagtatgtctgcatgttctagcctttgacctaggtcatctatgaaccctctttgtgtctaataaacatatctgtaaaggcatataaatctgaaaacaa

SEQ ID NO: 20741 - DNA, 1441 bp, Homo sapiens
  ENST00000409228
ctctttctctctcacagcttctcacgaggtagaactttagagcctggtgtgtttgtggctggagcatagcagctcttctacaactttactgtagtttctactgaatattttggtttgcaaatataaaggattctctgaagcacaaccttaaataacgtgtggtagacacctgggagaggaaaactgcagacagaaaaatgtggccggatgctctgtgggcgggcggcagcgatgttcggccaggtggctccaaggagaggaagcagtgatgcattgaggtaaaaataagtgactaaagaagcagacctgggaatcacctaacatgtcgaggaggagatttgattgccgaagtatttcaggcctactaactacaactcctcaaattccaataaaaatggaaaactttaataatttctatatacttacatctaaagagctagggagaggaaaatttgctgtggttagacaatgtatatcaaaatctactggccaagaatatgctgcaaaatttctaaaaaagagaagaagaggacaggattgtcgagcagaaattttacacgagattgctgtgcttgaattggcaaagtcttgtccccgtgttattaatcttcatgaggtctatgaaaatacaagtgaaatcattttgatattggaatatgctgcaggtggagaaattttcagcctgtgtttacctgagttggctgaaatggtttctgaaaatgatgttatcagactcattaaacaaatacttgaaggagtttattatctacatcagaataacattgtacaccttgatttaaagccacagaatatattactgagcagcatataccctctcggggacattaaaatagtagattttggaatgtctcgaaaaatagggcatgcgtgtgaacttcgggaaatcatgggaacaccagaatatttagctccagaaatcctgaactatgatcccattaccacagcaacagatatgtggaatattggtataatagcatatatgttgttaactcacacatcaccatttgtgggagaagataatcaagaaacatacctcaatatttctcaagttaatgtagattattcggaagaaactttttcatcagtttcacagctggccacagactttattcagagccttttagtaaaaaatccagagaaaagaccaacagcagagatatgcctttctcattcttggctacagcagtgggactttgaaaacttgtttcaccctgaagaaacttccagttcctctcaaactcaggatcattctgtaaggtcctctgaagacaagacttctaaatcctcctgtaatggaacctgtggtgatagagaagacaaagagaatatcccagaggatagcagcatggtttccaaaagatttcgtttcgatgactcattacccaatccccatgaacttgtttcagatttgctctgttag

SEQ ID NO: 20742 - DNA, 562 bp, Homo sapiens
  ENST00000606789
aaatttgctgtggttagacaatgtatatcaaaatctactggccaagaatatgctgcaaaatttctaaaaaagagaagaagaggacaggattgtcgagcagaaattttacacgagattgctgtgcttgaattggcaaagtcttgtccccgtgttattaatcttcatgaggtctatgaaaatacaagtgaaatcattttgatattggaatagtaagtatatactaaatagtacctattttagttggtatgaaaagatgattaaaatgtcaagaataagaatgataaaggtgtgacaagaacttgtaaagattcctgttaataaaatgtaaaagggacctaatttatattcagatattttcataagactaaatgtatagcctcgggcacatacacaaaaactaacagcacagaataagcaaatgacaaatacaacatttgaggaatgtggagaaatgaatatacattattttcttaatggctaattgattgaatttttctggaacacaatctgatgggcagatagaattgaagtaatttgtatattttcttcatctatttgaaaa

SEQ ID NO: 20743 - DNA, 507 bp, Homo sapiens
  ENST00000420683
aggaaaactgcagacagaaaaatgtggccggatgctctgtgggcgggcggcagcgatgttcggccaggtggctccaaggagaggaagcagtgatgcattgagggagtaaacatggaatcggtgagaatcactttccttgatcattatgtggtcagtatgcggtgactgacttgatgtgactggggaaggtcccttccctggacagaatatggtgagtgtcgtgccattaccggagaggatcaccttccctggccacatgtggtaaaaataagtgactaaagaagcagacctgggaatcacctaacatgtcgaggaggagatttgattgccgaagtatttcaggcctactaactacaactcctcaaattccaataaaaatggaaaactttaataatttctatatacttacatctaaagagctagggagaggaaaatttgctgtggttagacaatgtatatcaaaatctactggccaagaatatgctgcaaaatttctaaaaaagagaa

SEQ ID NO: 20744 - DNA, 567 bp, Homo sapiens
  ENST00000449152
aggtcgcgccaggcagggcccccttcgcggcgggcccgcgcgggtcccttccacagcaaggccacgcggtccccctagcctctcccgagtcccagctgcggcgtgggcgcgttcccatcgggactcgtggacgcgtcctgctcccagctgcctttcgtctagagaaaggcaaccagatgtttgaggagggcttggtggacaaaggtgacattcatgctccactatatgcaaaactggccaaaggagaggaaatggaaaaatatcttggctctgacaattggttcagatgcagtaaataaaaggaaaatgaacttaagaaatgcttaatggatgcctaaagcagcttgtgatcactggaagatcaattcttttatcatccatactttagaggcagcaaaatcgaagctttcttcaccagtaaaagggaatgcgaagtaaatcacaacaaaattccatttcaccttcatcacactagaatagccaaacttaaaagtctgaattgggtaaaaataagtgactaaagaagcagacctgggaatcacctaacatgtcgaggaggagatttga

SEQ ID NO: 20745 - DNA, 988 bp, Homo sapiens
  ENST00000497732
gtctgacacaagcattagtgagatgctcccctcgaagaatagtcttgtttcttctaaggactgattctcaccccggctttggctctcctaattttagagggtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggtatgtgcgtcgccaccgcccctcccagcactgacgggcctgagggacgacaagttgacgctcctttcgtcatcacctggtctaggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtatgtgactgt

SEQ ID NO: 20746 - DNA, 1620 bp, Homo sapiens
  ENST00000426802
gtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtga

SEQ ID NO: 20747 - DNA, 1557 bp, Homo sapiens
  ENST00000452688
cttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtatgtgactgtgtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtga

SEQ ID NO: 20748 - DNA, 2131 bp, Homo sapiens
  ENST00000466867
ccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgtgagacttgtggaaccaaccaaagtcaggcatctggtgcttccctgcctccctccagttccatccagcctgtcctcctgtttttttggtgaacctgccagaaaagctgccaaaaagctgactcttctttttaataaaatgacccaagtttgtattcctccccacaagagaggaggcctatcttacctgggccttagaaagagccctgaaatagaattcagttcttggtggcttatcaaaagcacacaggggcctggcaggaagtgtaaaagcttgatgttaatcatactgggactaagaggatagagaatggtaggagctgggatacccctaaacattcacattaaaacaaaaaaaacccaaagctaaaaaacaactgggcaggagctaaataaaaatctaattttgagaggctgtatctggctcaggcctcctactttgtaacccatggaatatgtgaaagcatttgaaaaactatagcactgatctcacatgggcagacacactctcagagagatgtggtgggagccatggcgcagtctgcctaggcagtggcaggagcgcagaagactctgattcctctcctcggtcctaagaccgaatgtgtgtcaggacatgtggtcagggaagagaagctatttaactgaaccagtaatagtagcaggaaaagaaaaagtggagggagggcagtccaggtagggggcctggaacaagcaactgcaccaacagaggcagttggtgcgagcacagaaccaccccaggctgggattttgttatccagtctctcttgcatggttgcccgtgtttctggagacttgtgtaaacattaatggatgaggaggagagatggttctcagagcccagccctcatctctgctggcttcccactgccctcaggcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtga

SEQ ID NO: 20749 - DNA, 682 bp, Homo sapiens
  ENST00000478799
ttttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtga

SEQ ID NO: 20750 - DNA, 1101 bp, Homo sapiens
  ENST00000520138
ccccttccccggtaccataaaatcccgggatatgagctggaagaggcatcacctgatcccggagacctttggagttaagaggcggcggaagcgagggcctgtggagtcggatcctcttcggggtgagccagaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccag

SEQ ID NO: 20751 - DNA, 1049 bp, Homo sapiens
  ENST00000486358
cccggtaccataaaatcccgggatatgagctggaagaggcatcacctgatcccggagacctttggagttaagaggcggcggaagcgagggcctgtggagtcggatcctcttcggggtgagccagaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtga

SEQ ID NO: 20752 - DNA, 919 bp, Homo sapiens
  ENST00000468899
ggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctggtgaggggcgtcggtgcgaccgccggaagcccctttcctaactcctggaattccctgtcactcagtcactccgccagccgttcagcaagcattaggcctttcaggcgagggcactgtgccaggcactggggtgccacagagaccctgttaaaagtcccgcaggtagtacagggcatttcaaatcatggaggtagaagaacgaggcttttggggaaaccgagtcatggggcatggttcgaacatacagcgctgggagtgcagtcagacgtcagatcatgacaggccttgtacatcagtgttgtttccatcttacactgaggcgatgggctggtagagaatatcatagagagagggaatggtgtattggagatagtggatgaggcagggaggtcagctaagaagatactgcatctgagaagtggtgaaggcctaaattaggtcagtgcagtagggagggagaggagagtgaggaagagggaggagtccaggacaactcagactttccagatgactgcgtggctggtggtattaggagcacatttagttgttggactacagataatgtgtttaattttatacaagttgagttgatggtgcatgtggagcatccaaagacaaaggtattagacagttggatatgagagttggagagaattctggg

SEQ ID NO: 20753 - DNA, 1128 bp, Homo sapiens
  ENST00000460232
cgagagttttgttagaaccgcgtccccgccccagttccctgtccgtgagccgatttatctgcccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtga

SEQ ID NO: 20754 - DNA, 725 bp, Homo sapiens
  ENST00000464694
ccccgccccagttccctgtccgtgagccgatttatctgcccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgtgagacttgtggaaccaaccaaagtcaggcatctggtgcttccctgcctccctccagttccatccagcctgtcctcctgtttttttggtgaacctgccagaaaagctgccaaaaagctgactcttctttttaataaaatgacccaagtttgtattcctccccacaagagaggaggcctatcttacctgggccttagaaagagccctgaaatagaattcagttcttggtggcttatcaaaagcacacaggggcctggcaggaagtgtaaaagcttgatgttaatcatactgggactaagaggatagaga

SEQ ID NO: 20755 - DNA, 820 bp, Homo sapiens
  ENST00000473747
gccccagttccctgtccgtgagccgatttatctgcccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctggtgaggggcgtcggtgcgaccgccggaagcccctttcctaactcctggaattccctgtcactcagtcactccgccagccgttcagcaagcattaggcctttcaggcgagggcactgtgccaggcactggggtgccacagagaccctgttaaaagtcccgcagaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactg

SEQ ID NO: 20756 - DNA, 854 bp, Homo sapiens
  ENST00000447249
ggaggagagatggttctcagagcccagccctcatctctgctggcttcccactgccctcaggcatctggtgaatgctggagtcctcaccgtccgagatgctgggagctggtggctagctgtgcctggagctgggagattcatcaagtactttgttaaaggtatcccatctgcagctcaagcctgcagcccctcaccttttggtggctcctcaggcctctaggccttattcacctttcccctttcctgtgccacttctcctctagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtga

SEQ ID NO: 20757 - DNA, 1804 bp, Homo sapiens
  ENST00000549310
gtctgacacaagcattagtgagatgctcccctcgaagaatagtcttgtttcttctaaggactgattctcaccccggctttggctctcctaattttagagggtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggtatgtgcgtcgccaccgcccctcccagcactgacgggcctgagggacgacaagttgacgctcctttcgtcatcacctggtctaggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtg

SEQ ID NO: 20758 - DNA, 988 bp, Homo sapiens; identical to SEQ ID NO: 20745
  ENST00000459769

SEQ ID NO: 20759 - DNA, 1620 bp, Homo sapiens; identical to SEQ ID NO: 20746
  ENST00000425138

SEQ ID NO: 20760 - DNA, 1557 bp, Homo sapiens; identical to SEQ ID NO: 20747
  ENST00000433397

SEQ ID NO: 20761 - DNA, 2131 bp, Homo sapiens
  ENST00000483467
ccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgtgagacttgtggaaccaaccaaagtcaggcatctggtgcttccctgcctccctccagttccatccagcctgtcctcctgtttttttggtgaacctgccagaaaagctgccaaaaagctgactcttcttgttaataaaatgacccaagtttgtattcctccccacaagagaggaggcctatcttacctgggccttagaaagagccctgaaatagaattcagttcttggtggcttatcaaaagcacacaggggcctggcaggaagtgtaaaagcttgatgttaatcatactgggactaagaggatagagaatggtaggagctgggatacccctaaacattcacattaaaacaaaaaaaacccaaagctaaaaaacaactgggcaggagctaaataaaaatctaattttgagaggctgtatctggctcaggcctcctactttgtaacccatggaatatgtgaaagcatttgaaaaactatagcactgatctcacatgggcagacacactctcagagagatgtggtgggagccatggcgcagtctgcctaggcagtggcaggagcgcagaagactctgattcctctcctcggtcctaagaccgaatgtgtgtcaggacatgtggtcagggaagagaagctatttaactgaaccagtaatagtagcaggaaaagaaaaagtggagggagggcagtccaggtagggggcctggaacaagcaactgcaccaacagaggcagttggtgcgagcacagaaccaccccaggctgggattttgttatccagtctctcttgcatggttgcccgtgtttctggagacttgtgtaaacattaatggatgaggaggagagatggttctcagagcccagccctcatctctgctggcttcccactgccctcaggcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtga

SEQ ID NO: 20762 - DNA, 682 bp, Homo sapiens; identical to SEQ ID NO: 20749
  ENST00000487912

SEQ ID NO: 20763 - DNA, 1049 bp, Homo sapiens; identical to SEQ ID NO: 20751
  ENST00000461093

SEQ ID NO: 20764 - DNA, 919 bp, Homo sapiens
  ENST00000462407
ggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctggtgaggggcgtcggtgcgaccgccggaagcccctttcctaactcctggaattccctgtcactcagtcactccgccagccgttcagcaagcattaggcctttcaggcgagggcactgtgccaggcactggggtgccacagagaccctgttaaaagtcccgcaggtagtacagggcatttcaaatcatggaggtagaagaacgaggcttttggggaaaccgagtcatggggcatggttcgaacatacagcgctgggagtgcagtcagacgtcagatcatgacaggccttgtacatcagtgttgtttccatcttacactgaggcgatgggctggtagagaatatcatagagagagggaatggtgtgttggagatagtggatgaggcagggaggtcagctaagaagatactgcatctgagaagtggtgaaggcctaaattaggtcagtgcagtagggagggagaggagagtgaggaagagggaggagtccaggacaactcagactttccagatgactgcgtggctggtggtattaggagcacatttagttgttggactacagataatgtgtttaattttatacaagttgagttgatggtgcatgtggagcatccaaagacaaaggtattagacagttggatatgagagttggagagaattctggg

SEQ ID NO: 20765 - DNA, 1128 bp, Homo sapiens; identical to SEQ ID NO: 20753
  ENST00000490195

SEQ ID NO: 20766 - DNA, 725 bp, Homo sapiens
  ENST00000490429
ccccgccccagttccctgtccgtgagccgatttatctgcccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgtgagacttgtggaaccaaccaaagtcaggcatctggtgcttccctgcctccctccagttccatccagcctgtcctcctgtttttttggtgaacctgccagaaaagctgccaaaaagctgactcttcttgttaataaaatgacccaagtttgtattcctccccacaagagaggaggcctatcttacctgggccttagaaagagccctgaaatagaattcagttcttggtggcttatcaaaagcacacaggggcctggcaggaagtgtaaaagcttgatgttaatcatactgggactaagaggatagaga

SEQ ID NO: 20767 - DNA, 820 bp, Homo sapiens; identical to SEQ ID NO: 20755
  ENST00000479148

SEQ ID NO: 20768 - DNA, 854 bp, Homo sapiens; identical to SEQ ID NO: 20756
  ENST00000474087

SEQ ID NO: 20769 - DNA, 1804 bp, Homo sapiens; identical to SEQ ID NO: 20757
  ENST00000551718

SEQ ID NO: 20770 - DNA, 1889 bp, Homo sapiens
  ENST00000466132
agttttgtcaggtgcccccgccacgtcactatggcctctgccagccagcctggacccctgagaggcaggagttacaggctgaaggtctgacacaagcattagtgagatgctcccctcgaagaatagtcttgtttcttctaaggactgattctcaccccggctttggctctcctaattttagagggtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggtatgtgcgtcgccaccgcccctcccagcactgacgggcctgagggacgacaagttgacgctcctttcgtcatcacctggtctaggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtga

SEQ ID NO: 20771 - DNA, 575 bp, Homo sapiens
  ENST00000460018
aggctgaaggtctgacacaagcattagtgagatgctcccctcgaagaatagtcttgtttcttctaaggactgattctcaccccggctttggctctcctaattttagagggtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggagggacgcccggggagaccgtacgtcactgctctgcgccggaagaccctattttcaggttctcttccctccattcctaccccttccccggtaccataaaatcccgggatatgagctg

SEQ ID NO: 20772 - DNA, 1352 bp, Homo sapiens
  ENST00000479644
ctgcctctttccttgcccttcacccaccctccctccaggtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctggtgaggggcgtcggtgcgaccgccggaagcccctttcctaactcctggaattccctgtcactcagtcactccgccagccgttcagcaagcattaggcctttcaggcgagggcactgtgccaggcactggggtgccacagagaccctgttaaaagtcccgcaggtagtacagggcatttcaaatcatggaggtagaagaacgaggcttttggggaaaccgagtcatggggcatggttcgaacatacagcgctgggagtgcagtcagacgtcagatcatgacaggccttgtacatcagtgttgtttccatcttacactgaggcgatgggctggtagagaatatcatagagagagggaatggtgtattggagatagtggatgaggcagggaggtcagctaagaagatactgcatctgagaagtggtgaaggcctaaattaggtcagtgcagtagggagggagaggagagtgaggaagagggaggagtccaggacaactcagactttccagatgactgcgtggctggtggtattaggagcacatttagttgttggactacagataatgtgtttaattttatacaagttgagttgatggtgcatgtggagcatccaaagacaaa

SEQ ID NO: 20773 - DNA, 1663 bp, Homo sapiens
  ENST00000375331
ctgcctctttccttgcccttcacccaccctccctccaggtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtgatattt

SEQ ID NO: 20774 - DNA, 1405 bp, Homo sapiens
  ENST00000492583
cgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggtatgtgcgtcgccaccgcccctcccagcactgacgggcctgagggacgacaagttgacgctcctttcgtcatcacctggtctaggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtatgtgactgtgtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagt

SEQ ID NO: 20775 - DNA, 1557 bp, Homo sapiens; identical to SEQ ID NO: 20747
  ENST00000375333

SEQ ID NO: 20776 - DNA, 1894 bp, Homo sapiens
  ENST00000473983
ccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgtgagacttgtggaaccaaccaaagtcaggcatctggtgcttccctgcctccctccagttccatccagcctgtcctcctgtttttttggtgaacctgccagaaaagctgccaaaaagctgactcttcttgttaataaaatgacccaagtttgtattcctccccacaagagaggaggcctatcttacctgggccttagaaagagccctgaaatagaattcagttcttggtggcttatcaaaagcacacaggggcctggcaggaagtgtaaaagcttgatgttaatcatactgggactaagaggatagagaatggtaggagctgggatacccctaaacattcacattaaaacaaaaaaaacccaaagctaaaaaacaactgggcaggagctaaataaaaatctaattttgagaggctgtatctggctcaggcctcctactttgtaacccatggaatatgtgaaagcatttgaaaaactatagcactgatctcacatgggcagacacactctcagagagatgtggtgggagccatggcgcagtctgcctaggcagtggcaggagcgcagaagactctgattcctctcctcggtcctaagaccgaatgtgtgtcaggacatgtggtcagggaagagaagctatttaactgaaccagtaatagtagcaggaaaagaaaaagtggagggagggcagtccaggtagggggcctggaacaagcaactgcaccaacagaggcagttggtgcgagcacagaaccaccccaggctgggattttgttatccagtctctcttgcatggttgcccgtgtttctggagacttgtgtaaacattaatggatgaggaggagagatggttctcagagcccagccctcatctctgctggcttcccactgccctcaggcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgt

SEQ ID NO: 20777 - DNA, 759 bp, Homo sapiens
  ENST00000478486
attttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctggtgaggggcgtcggtgcgaccgccggaagcccctttcctaactcctggaattccctgtcactcagtcactccgccagccgttcagcaagcattaggcctttcaggcgagggcactgtgccaggcactggggtgccacagagaccctgttaaaagtcccgcagaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgtgagacttgtggaaccaaccaaagtcaggcatctggtgcttccctgcctccctccagttccat

SEQ ID NO: 20778 - DNA, 543 bp, Homo sapiens
  ENST00000463823
attcctaccccttccccggtaccataaaatcccgggatatgagctggaagaggcatcacctgatcccggagacctttggagttaagaggcggcggaagcgagggcctgtggagtcggatcctcttcggggtgagccagaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgtgagacttgtggaaccaaccaaagtcaggcatctggtgcttccctgcctccctccagttccatccagcctgtcctcctgtttttttggtgaacctgccagaaaagctgccaaaaagctgactcttcttgttaataaaatgacccaagtttgtattcctccccacaaga

SEQ ID NO: 20779 - DNA, 1039 bp, Homo sapiens
  ENST00000483801
ccccttccccggtaccataaaatcccgggatatgagctggaagaggcatcacctgatcccggagacctttggagttaagaggcggcggaagcgagggcctgtggagtcggatcctcttcggggtgagccagaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataa

SEQ ID NO: 20780 - DNA, 1101 bp, Homo sapiens; identical to SEQ ID NO: 20750
  ENST00000519179

SEQ ID NO: 20781 - DNA, 517 bp, Homo sapiens
  ENST00000466336
ataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggc

SEQ ID NO: 20782 - DNA, 529 bp, Homo sapiens
  ENST00000471028
ggggcctcgcttccggtagccgagagttttgttagaaccgcgtccccgccccagttccctgtccgtgagccgatttatctgcccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtatgtgactgtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgtgagacttgtggaaccaaccaaagtcaggcatctggtgcttccctgcctccctccagtt

SEQ ID NO: 20783 - DNA, 1128 bp, Homo sapiens; identical to SEQ ID NO: 20753
  ENST00000491861

SEQ ID NO: 20784 - DNA, 725 bp, Homo sapiens; identical to SEQ ID NO: 20766
  ENST00000484540

SEQ ID NO: 20785 - DNA, 1006 bp, Homo sapiens
  ENST00000469907
gccccagttccctgtccgtgagccgatttatctgcccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctggtgaggggcgtcggtgcgaccgccggaagcccctttcctaactcctggaattccctgtcactcagtcactccgccagccgttcagcaagcattaggcctttcaggcgagggcactgtgccaggcactggggtgccacagagaccctgttaaaagtcccgcagaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaagg

SEQ ID NO: 20786 - DNA, 854 bp, Homo sapiens; identical to SEQ ID NO: 20756
  ENST00000490822

SEQ ID NO: 20787 - DNA, 1620 bp, Homo sapiens; identical to SEQ ID NO: 20746
  ENST00000424104

SEQ ID NO: 20788 - DNA, 1557 bp, Homo sapiens; identical to SEQ ID NO: 20747
  ENST00000438256

SEQ ID NO: 20789 - DNA, 1049 bp, Homo sapiens; identical to SEQ ID NO: 20751
  ENST00000469677

SEQ ID NO: 20790 - DNA, 988 bp, Homo sapiens; identical to SEQ ID NO: 20745
  ENST00000478011

SEQ ID NO: 20791 - DNA, 2131 bp, Homo sapiens; identical to SEQ ID NO: 20748
  ENST00000460069

SEQ ID NO: 20792 - DNA, 682 bp, Homo sapiens; identical to SEQ ID NO: 20749
  ENST00000464830

SEQ ID NO: 20793 - DNA, 919 bp, Homo sapiens; identical to SEQ ID NO: 20752
  ENST00000472631

SEQ ID NO: 20794 - DNA, 1128 bp, Homo sapiens; identical to SEQ ID NO: 20753
  ENST00000493840

SEQ ID NO: 20795 - DNA, 725 bp, Homo sapiens; identical to SEQ ID NO: 20754
  ENST00000486636

SEQ ID NO: 20796 - DNA, 820 bp, Homo sapiens; identical to SEQ ID NO: 20755
  ENST00000491132

SEQ ID NO: 20797 - DNA, 854 bp, Homo sapiens; identical to SEQ ID NO: 20756
  ENST00000468547

SEQ ID NO: 20798 - DNA, 1804 bp, Homo sapiens; identical to SEQ ID NO: 20757
  ENST00000550656

SEQ ID NO: 20799 - DNA, 988 bp, Homo sapiens; identical to SEQ ID NO: 20745
  ENST00000478304

SEQ ID NO: 20800 - DNA, 1620 bp, Homo sapiens
  ENST00000383328
gtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttggcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtga

SEQ ID NO: 20801 - DNA, 1557 bp, Homo sapiens
  ENST00000383327
cttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtatgtgactgtgtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttggcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtga

SEQ ID NO: 20802 - DNA, 2131 bp, Homo sapiens
  ENST00000497879
ccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgtgagacttgtggaaccaaccaaagtcaggcatctggtgcttccctgcctccctccagttccatccagcctgtcctcctgtttttttggtgaacctgccagaaaagctgccaaaaagctgactcttctttttaataaaatgacccaagtttgtattcctccccacaagagaggaggcctatcttacctgggccttagaaagagccctgaaatagaattcagttcttggtggcttatcaaaagcacacaggggcctggcaggaagtgtaaaagcttgatgttaatcatactgggactaagaggatagagaatggtaggagctgggatacccctaaacattcacattaaaacaaaaaaaacccaaagctaaaaaacaactgggcaggagctaaataaaaatctaattttgagaggctgtatctggctcaggcctcctactttgtaacccatggaatatgtgaaagcatttgaaaaactatagcactgatctcacatgggcagacacactctcagagagatgtggtgggagccatggcgcagtctgcctaggcagtggcaggagcgcagaagactctgattcctctcctcggtcctaagaccgaatgtgtgtcaggacatgtggtcagggaagagaagctatttaactgaaccagtaatagtagcaggaaaagaaaaagtggagggagggcagtccaggtagggggcctggaacaagcaactgcaccaacagaggcagttggtgcgagcacagaaccaccccaggctgggattttgttatccagtctctcttgcatggttgcccgtgtttctggagacttgtgtaaacattaatggatgaggaggagagatggttctcagagcccagccctcatctctgctggcttcccactgccctcaggcatctggtgaatgctggagtcctcaccgtccgagatgctgggagctggtggctagctgtgcctggagctgggagattcatcaagtactttgttaaagggcgccaggctgtccttggcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtga

SEQ ID NO: 20803 - DNA, 682 bp, Homo sapiens; identical to SEQ ID NO: 20749
  ENST00000469629

SEQ ID NO: 20804 - DNA, 1049 bp, Homo sapiens
  ENST00000481181
cccggtaccataaaatcccgggatatgagctggaagaggcatcacctgatcccggagacctttggagttaagaggcggcggaagcgagggcctgtggagtcggatcctcttcggggtgagccagaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttggcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtga

SEQ ID NO: 20805 - DNA, 919 bp, Homo sapiens; identical to SEQ ID NO: 20752
  ENST00000468702

SEQ ID NO: 20806 - DNA, 1128 bp, Homo sapiens
  ENST00000490657
cgagagttttgttagaaccgcgtccccgccccagttccctgtccgtgagccgatttatctgcccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttggcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtga

SEQ ID NO: 20807 - DNA, 725 bp, Homo sapiens; identical to SEQ ID NO: 20754
  ENST00000465945

SEQ ID NO: 20808 - DNA, 820 bp, Homo sapiens
  ENST00000460304
gccccagttccctgtccgtgagccgatttatctgcccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctggtgaggggcgtcggtgcgaccgccggaagcccctttcctaactcctggaattccctgtcactcagtcactccgccagccgttcagcaagcattaggcctttcaggcgagggcactgtgccaggcactggggtgccacagagaccctgttaaaagtcccgcagaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttggcatggtccggaaggcaaagtaccgggaactgctcctatcagagctcctgggccggcgggcgcctgtcgtggtgcggcttggcctcacctaccatgtgcacgacctcattggggcccagctagtggactg

SEQ ID NO: 20809 - DNA, 854 bp, Homo sapiens
  ENST00000469343
ggaggagagatggttctcagagcccagccctcatctctgctggcttcccactgccctcaggcatctggtgaatgctggagtcctcaccgtccgagatgctgggagctggtggctagctgtgcctggagctgggagattcatcaagtactttgttaaaggtatcccatctgcagctcaagcctgcagcccctcaccttttggtggctcctcaggcctctaggccttattcacctttcccctttcctgtgccacttctcctctagggcgccaggctgtccttggcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtga

SEQ ID NO: 20810 - DNA, 1804 bp, Homo sapiens
  ENST00000547578
gtctgacacaagcattagtgagatgctcccctcgaagaatagtcttgtttcttctaaggactgattctcaccccggctttggctctcctaattttagagggtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggtatgtgcgtcgccaccgcccctcccagcactgacgggcctgagggacgacaagttgacgctcctttcgtcatcacctggtctaggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttggcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtg

SEQ ID NO: 20811 - DNA, 988 bp, Homo sapiens; identical to SEQ ID NO: 20745
  ENST00000496606

SEQ ID NO: 20812 - DNA, 1620 bp, Homo sapiens; identical to SEQ ID NO: 20746
  ENST00000444147

SEQ ID NO: 20813 - DNA, 1557 bp, Homo sapiens; identical to SEQ ID NO: 20747
  ENST00000431383

SEQ ID NO: 20814 - DNA, 2131 bp, Homo sapiens; identical to SEQ ID NO: 20748
  ENST00000481637

SEQ ID NO: 20815 - DNA, 682 bp, Homo sapiens; identical to SEQ ID NO: 20749
  ENST00000478362

SEQ ID NO: 20816 - DNA, 798 bp, Homo sapiens
  ENST00000523972
ccccttccccggtaccataaaatcccgggatatgagctggaagaggcatcacctgatcccggagacctttggagttaagaggcggcggaagcgagggcctgtggagtcggatcctcttcggggtgagccagaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaag

SEQ ID NO: 20817 - DNA, 1049 bp, Homo sapiens; identical to SEQ ID NO: 20751
  ENST00000472138

SEQ ID NO: 20818 - DNA, 919 bp, Homo sapiens; identical to SEQ ID NO: 20752
  ENST00000480096

SEQ ID NO: 20819 - DNA, 1128 bp, Homo sapiens; identical to SEQ ID NO: 20753
  ENST00000465050

SEQ ID NO: 20820 - DNA, 725 bp, Homo sapiens; identical to SEQ ID NO: 20754
  ENST00000465734

SEQ ID NO: 20821 - DNA, 820 bp, Homo sapiens; identical to SEQ ID NO: 20755
  ENST00000480672

SEQ ID NO: 20822 - DNA, 854 bp, Homo sapiens; identical to SEQ ID NO: 20756
  ENST00000463291

SEQ ID NO: 20823 - DNA, 1804 bp, Homo sapiens; identical to SEQ ID NO: 20757
  ENST00000549916

SEQ ID NO: 20824 - DNA, 594 bp, Homo sapiens
  ENST00000517832
ttacctaaggaaatgcaacctcaccacaagtacaaagaccatctttcatggactactttgataagcaagacttcaagaataagagtcacgaaaactgtaatcagaacatgcatgaacccttccctatgtccaaaaacgtttttcctgataactggaaagttcctcaagatggagactttgactttatagagccttactgggcccgtgcagattttccacttcctcggctgtggcccttggcatctgcggttatattcaacaggagcaccaacggtggccaagaagtcactaggatggtggctaaaggggaggagctgagctacaccccacttgatggaacgcaaagactgtggtgaggttggagagcagtgctgtgcgtccttcctcagccttaacgagtgcggggcaaggttaacacagatttctacacccttttgctgcatacacagacgaggccacctgcagatgccaccactgctcagtgaatcagcagaagccttggaaagccttgtgagttccacaggacacagaattgcttgagcttgagccaaattgtctctgttatccattgctacattaaaaaaacacttcaaa

SEQ ID NO: 20825 - DNA, 2826 bp, Homo sapiens
  ENST00000419617
ccgcggagttacgggaaagttggtccgagttcccagagtttccctctgtggtgccctaggctcggccggccggtgccccggctcctttcctcctttcggccttcgccgtccaccaggtccctctctctgtccccggccgccatggagcagccgccggcgcctaagagtaaactaaaaaagctgagtgaagacagtttgactaagcagcctgaagaagtttttgatgtattagagaagcttggagaagggtcttatggaagtgtatttaaagcaatacacaaggaatccggtcaagttgtcgcaattaaacaagtacctgttgaatcagatcttcaggaaataatcaaagaaatttccataatgcagcaatgtgacagcccatatgttgtaaagtactatggcagttattttaagaatacagacctctggattgttatggagtactgtggcgctggctctgtctcagacataattagattacgaaacaagacattaatagaagatgaaattgcaaccattcttaaatctacattgaaaggactagaatatttgcactttatgagaaaaatacacagagatataaaagctggaaatattctcctcaatacagaaggacatgcaaaattggcagattttggagtggctggtcagttaacagatacaatggcaaaacgcaatactgtaataggaactccattttggatggctcctgaggtgattcaagaaataggctataactgtgtggccgacatctggtcccttggcattacttctatagaaatggctgaaggaaaacctccttatgctgatatacatccaatgagggctatttttatgattcccacaaatccaccaccaacattcagaaagccagaactttggtccgatgatttcaccgattttgttaaaaagtgtttggtgaagaatcctgagcagagagctactgcaacacaacttttacagcatccttttatcaagaatgccaaacctgtatcaatattaagagacctgatcacagaagctatggagatcaaagctaaaagacatgaggaacagcaacgagaattggaagaggaagaagaaaattcggatgaagatgagctggattcccacaccatggtgaagactagtgtggagagtgtgggcaccatgcgggccacaagcacgatgagtgaaggggcccagaccatgattgaacataatagcacgatgttggaatccgacttggggaccatggtgataaacagtgaggatgaggaagaagaagatggaactatgaaaagaaatgcaacctcaccacaagtacaaagaccatctttcatggactactttgataagcaagacttcaagaataagagtcacgaaaactgtaatcagaacatgcatgaacccttccctatgtccaaaaacgtttttcctgataactggaaagttcctcaagatggagactttgactttttgaaaaatctaagtttagaagaactacagatgcggttaaaagcactggaccccatgatggaacgggagatagaagaacttcgtcagagatacactgcgaaaagacagcccattctggatgcgatggatgcaaagaaaagaaggcagcaaaacttttgagtctaatttcctctctgtttttaactattctggagaccaagaaaccactaggaattgaaggaatatttggatatttttaatcctaagattttgccctacaattaggcagaggtcaaaaagtgacaatggtacatgcccaggtaaattcccaaaaggcagaattgacagttgtatctgctgtgcattcactctaagatgaggagaacaaaagaagtgtattctcttgttctgtcagctgcataccagtaataaaactgttatgaaatggattttcaaggtctctaaaccttgaaaatccaaagctattgttgcattgtacagcactgaagggctttatgttacaatattctttattcctatctagtatactaggctatttattgtatccccttaggtaaacttatttatttatgctattttgctttgtttcattttttaaggacaagatcaggatagctttggtgaaggtagggtcatattaatatgatgataatgtgcaaccaatttatactttctgcagggagctatggggtacattccttgatttccaggatagtttttcaaataggaaagcaataatggcagtagttctcaaatgggctaggccttttttatattgaagcaataattccatttttaccctttgaaattttgtttttttgatttttgatgtttggtacaaatagaactatatatatttaggtaaaatagatctatcgtgtttaaaaccaaagaaatcaatggaacccttgcacaaaaaagtgtgataaatatttttaaataaaaacttaatacaaatgtaatttgttaatattgtttcatgttttatgtgtagatctaatagctgaactgattcaaactgtaataagctcatcaatttcatttctatgaaaatgtgctctgttgtcacaggatgtttctgttgattttattcatttcctgggaattggtaaacatcatgttcctgatgataacccagtagcaaaaacatttgtactgagtggtacaagccttggggactgaaaaaaaaaagattaaaaccattaaaaagaaactcatttttacgctgaatgaacatttatatgattgcattgggaccagtcatttcctaagctacatatggccatcttgacagtgttttttcttttgtgtgtttaattattatgtgtaaatcataaagacaaataaatttcactgtgccacccagca

SEQ ID NO: 20826 - DNA, 3107 bp, Homo sapiens
  ENST00000523601
gtgcagaaccgtttggttttcccgaggggtaggcagaatttccaaccccacgagctgctccctctttccgcaaacctcctaaccccggggtttttccataaatgtgtttacttcgtccacgccagcctgcgaagttccaaaatggagtctgggccacgccggcgttctgggcacgactacggtctcttgaaaagatttggaattgaccatgtagataatctctgagagcagttcttaaagtgtaatccagaaccggtggaacttgctagaaacgcatattcttcggaccccctccaaatctgctgaatctgagattgtggaggccattcaatgtcccttcttcaggaatttggaaaaaggatggagagatctctctgagctagactcttcagtggaggaaatgttacaactcatggacagtggcattaccatctgccttaggaacggagcagcctctgtcttcaagaaaaaagaatggagcacacaaggagaagaaaacaagcaagacagtaaactaaaaaagctgagtgaagacagtttgactaagcagcctgaagaagtttttgatgtattagagaagcttggagaagggtcttatggaagtgtatttaaagcaatacacaaggaatccggtcaagttgtcgcaattaaacaagtacctgttgaatcagatcttcaggaaataatcaaagaaatttccataatgcagcaatgtgacagcccatatgttgtaaagtactatggcagttattttaagaatacagacctctggattgttatggagtactgtggcgctggctctgtctcagacataattagattacgaaacaagacattaatagaagatgaaattgcaaccattcttaaatctacattgaaaggactagaatatttgcactttatgagaaaaatacacagagatataaaagctggaaatattctcctcaatacagaaggacatgcaaaattggcagattttggagtggctggtcagttaacagatacaatggcaaaacgcaatactgtaataggaactccattttggatggctcctgaggtgattcaagaaataggctataactgtgtggccgacatctggtcccttggcattacttctatagaaatggctgaaggaaaacctccttatgctgatatacatccaatgagggctatttttatgattcccacaaatccaccaccaacattcagaaagccagaactttggtccgatgatttcaccgattttgttaaaaagtgtttggtgaagaatcctgagcagagagctactgcaacacaacttttacagcatccttttatcaagaatgccaaacctgtatcaatattaagagacctgatcacagaagctatggagatcaaagctaaaagacatgaggaacagcaacgagaattggaagaggaagaagaaaattcggatgaagatgagctggattcccacaccatggtgaagactagtgtggagagtgtgggcaccatgcgggccacaagcacgatgagtgaaggggcccagaccatgattgaacataatagcacgatgttggaatccgacttggggaccatggtgataaacagtgaggatgaggaagaagaagatggaactatgaaaagaaatgcaacctcaccacaagtacaaagaccatctttcatggactactttgataagcaagacttcaagaataagagtcacgaaaactgtaatcagaacatgcatgaacccttccctatgtccaaaaacgtttttcctgataactggaaagttcctcaagatggagactttgactttttgaaaaatctaagtttagaagaactacagatgcggttaaaagcactggaccccatgatggaacgggagatagaagaacttcgtcagagatacactgcgaaaagacagcccattctggatgcgatggatgcaaagaaaagaaggcagcaaaacttttgagtctaatttcctctctgtttttaactattctggagaccaagaaaccactaggaattgaaggaatatttggatatttttaatcctaagattttgccctacaattaggcagaggtcaaaaagtgacaatggtacatgcccaggtaaattcccaaaaggcagaattgacagttgtatctgctgtgcattcactctaagatgaggagaacaaaagaagtgtattctcttgttctgtcagctgcataccagtaataaaactgttatgaaatggattttcaaggtctctaaaccttgaaaatccaaagctattgttgcattgtacagcactgaagggctttatgttacaatattctttattcctatctagtatactaggctatttattgtatccccttaggtaaacttatttatttatgctattttgctttgtttcattttttaaggacaagatcaggatagctttggtgaaggtagggtcatattaatatgatgataatgtgcaaccaatttatactttctgcagggagctatggggtacattccttgatttccaggatagtttttcaaataggaaagcaataatggcagtagttctcaaatgggctaggccttttttatattgaagcaataattccatttttaccctttgaaattttgtttttttgatttttgatgtttggtacaaatagaactatatatatttaggtaaaatagatctatcgtgtttaaaaccaaagaaatcaatggaacccttgcacaaaaaagtgtgataaatatttttaaataaaaacttaatacaaatgtaatttgttaatattgtttcatgttttatgtgtagatctaatagctgaactgattcaaactgtaataagctcatcaatttcatttctatgaaaatgtgctctgttgtcacaggatgtttctgttgattttattcatttcctgggaattggtaaacatcatgttcctgatgataacccagtagcaaaaacatttgtactgagtggtacaagccttggggactgaaaaaaaaaagattaaaaccattaaaaagaaactcatttttacgctgaatgaacatttatatgattgcattgggaccagtcatttcctaagctacatatggccatcttgacagtgttttttcttt

SEQ ID NO: 20827 - DNA, 697 bp, Homo sapiens
  ENST00000520440
ggatgaagatgagctggattcccacaccatggtgaagactagtgtggagagtgtgggcaccatgcgggccacaagcacgatgagtgaaggggcccagaccatgattgaacataatagcacgatgttggaatccgacttggggaccatggtgataaacagtgaggatgaggaagaagaagatggaactatgaaaagaaatgcaacctcaccacaagtacaaagaccatctttcatggactactttgataagcaagacttcaagaataagagtcacgaaaactgtaatcagaacatgcatgaacccttccctatgtccaaaaacgtttttcctgataactggaaagttcctcaagatggagactttgactttgtaagtacattttaattcttcaatttatgttttctccttctatattttatcatcaaattgagaagcatagttcatatgtatatgaactgtgtgtatgtatatacaattatagaccatatgttaatattcattatacagccatatacatggttagagaaattgtgaaactgtagcttgcttatagaaatgtacttgcagagaaatacttttttatagttaaataaatcatagctcaaatttaaataaatattcaggactccttaaaactaaaatgacaactattttaaaagatgttttcaataatgcaaatatgagatacttctgaca

SEQ ID NO: 20828 - DNA, 725 bp, Homo sapiens
  ENST00000518582
agttgatcacatcagctcctgaggcttctgcattcttcacgtagttctcgagccttggctttcagctccatcagctcctttaagcacttctctatattggttattctagttatacattcgtctaaatttttttgaaagttttcaacttctttgcctttggtttgaatttcctcctgtagctcagagtagtttgatcgtctgaagccttcttctctcaactcgtcaaagtcattctccgtccagctttgttccgttgctggctatttttatgattcccacaaatccaccaccaacattcagaaagccagaactttggtccgatgatttcaccgattttgttaaaaagtgtttggtgaagaatcctgagcagagagctactgcaacacaacttttacagcatccttttatcaagaatgccaaacctgtatcaatattaagagacctgatcacagaagctatggagatcaaagctaaaagacatgaggaacagcaacgagaattggaagaggaagaagaaaattcggatgaagatgagctggattcccacaccatggtgaagactagtgtggagagtgtgggcaccatgcgggccacaagcacgatgagtgaaggggcccagaccatgattgaacataatagcacgatgttggaatccgacttggggaccatggtgataaacagtgaggatgaggaagaagaagatggaactatgaaaagtatgtggc

SEQ ID NO: 20829 - DNA, 537 bp, Homo sapiens
  ENST00000523159
ggtgatttgctttgaacataagaattttgcaagagacacaaacattcagacaatagaagacactgtcttgccttcaggctatttttatgattcccacaaatccaccaccaacattcagaaagccagaactttggtccgatgatttcaccgattttgttaaaaagtgtttggtgaagaatcctgagcagagagctactgcaacacaacttttacagcatccttttatcaagaatgccaaacctgtatcaatattaagagacctgatcacagaagctatggagatcaaagctaaaagacatgaggaacagcaacgagaattggaagaggaagaagaaaattcggatgaagatgagctggattcccacaccatggtgaagactagtgtggagagtgtgggcaccatgcgggccacaagcacgatgagtgaaggggcccagaccatgattgaacataatagcacgatgttggaatccgacttggggaccatggtgataaacagtgaggatgaggaagaagaagatggaactatgaaaagta

SEQ ID NO: 20830 - DNA, 817 bp, Homo sapiens
  ENST00000518165
acgggaaagttggtccgagttcccagagtttccctctgtggtgccctaggctcggccggccggtgccccggctcctttcctcctttcggccttcgccgtccaccaggtccctctctctgtccccggccgccatggagcagccgccggcgcctaagagtaaactaaaaaagctgagtgaagacagtttgactaagcagcctgaagaagtttttgatgtattagagaagcttggagaagggtcttatggaagtgtatttaaagcaatacacaaggaatccggtcaagttgtcgcaattaaacaagtacctgttgaatcagatcttcaggaaataatcaaagaaatttccataatgcagcaatgtgacagcccatatgttgtaaagtactatggcagttattttaagaatacagacctctggattgttatggagtactgtggcgctggctctgtctcagacataattagattacgaaacaagacagctatttttatgattcccacaaatccaccaccaacattcagaaagccagaactttggtccgatgatttcaccgattttgttaaaaagtgtttggtgaagaatcctgagcagagagctactgcaacacaacttttacagcatccttttatcaagaatgccaaacctgtatcaatattaagagacctgatcacagaagctatggagatcaaagctaaaagacatgaggaacagcaacgagaattggaagaggaagaagaaaattcggatgaagatgagctggattcccacaccatggtgaagactagtgtggagagtgtgggcaccatgcgggccac

SEQ ID NO: 20831 - DNA, 468 bp, Homo sapiens
  ENST00000518627
aagtcatcctttgtaatacctattgctcacatgtatttgagcacttacactattttattaaaatgatctgatatacatttttatattccattagactctaaatttcttgaagaagttaatatattgcaggctatttttatgattcccacaaatccaccaccaacattcagaaagccagaactttggtccgatgatttcaccgattttgttaaaaagtgtttggtgaagaatcctgagcagagagctactgcaacacaacttttacagcatccttttatcaagaatgccaaacctgtatcaatattaagagacctgatcacagaagctatggagatcaaagctaaaagacatgaggaacagcaacgagaattggaagaggaagaagaaaattcgacatcaggaatacaactgtaaacaagatgtggttactgcccttatagatttgagagtctaatgggggatttagac

SEQ ID NO: 20832 - DNA, 510 bp, Homo sapiens
  ENST00000522924
ggggtatggaaaacaggctcttaagtataatgtttattgttatgaaagtgtaacttggtactcaatctccatagatgccagtacagcaatatctatttaaaataaaaatccatatattctttgatccaacagttgcacttctaggaatttattctacagaaatatttaaccatgtgtgaaataacatgtgtaaaaatattcgtagaacattgaaattgtaaaagattggaaagatcctaaatgtctgtcaacaagttggaaacaatttaaagtacaagaaaaagagttactggaaaaatacacctatgtacacacaacatatatacatatcttaatgcttataatgaagtatctctggaaaaataagcaagaaactggcctccagaaaagcatccttttatcaagaatgccaaacctgtatcaatattaagagacctgatcacagaagctatggagatcaaagctaaaagacatgaggaacagcaacgagaattggaagaggaagaagaa

SEQ ID NO: 20833 - DNA, 574 bp, Homo sapiens
  ENST00000521649
gagtttccctctgtggtgccctaggctcggccggccggtgccccggctcctttcctcctttcggccttcgccgtccaccaggtccctctctctgtccccggccgccatggagcagccgccggcgcctaagagtaaactaaaaaagctgagtgaagacagtttgactaagcagcctgaagaagtttttgatgtattagagaagcttggagaagggtcttatggaagtgtatttaaagcaatacacaaggaatccggtcaagttgtcgcaattaaacaagtacctgttgaatcagatcttcaggaaataatcaaagaaatttccataatgcagcaatgtgacaggctatttttatgattcccacaaatccaccaccaacattcagaaagccagaactttggtccgatgatttcaccgattttgttaaaaagtgtttggtgaagaatcctgagcagagagctactgcaacacaacttttacagcatccttttatcaagaatgccaaacctgtatcaatattaagagacctgatcacagaagctatggagatcaaagctaaaagacatgaggaacagc

SEQ ID NO: 20834 - DNA, 577 bp, Homo sapiens
  ENST00000520053
gtgctcaatgagctacaattcaaatagaggaaatttaatgggaaatgattacattagtagcagatggactggcttcctgaatttcagtgttactagaaatcctagaacagcttaaatttgtttttcaaatttagagtctgataaaaagacagataaagagatttgtttatttgattgtgctagtgtgattcttactgtcttttggatatttcatttgtactaggctatttttatgattcccacaaatccaccaccaacattcagaaagccagaactttggtccgatgatttcaccgattttgttaaaaagtgtttggtgaagaatcctgagcagagagctactgcaacacaacttttacagaacattgaaattgtaaaagattggaaagatcctaaatgtctgtcaacaagttggaaacaatttaaagtacaagaaaaagagttactggaaaaatacacctatgtacacacaacatatatacatatcttaatgcttataatgaagtatctctggaaaaataagcaagaaactggcctccagaaaagcatccttttatcaagaatgccaaacctgtat

SEQ ID NO: 20835 - DNA, 1016 bp, Homo sapiens
  ENST00000521768
tcaggctatttttatgattcccacaaatccaccaccaacattcagaaagccagaactttggtccgatgatttcaccgattttgttaaaaagtgtttggtgaagaatcctgagcagagagctactgcaacacaacttttacagcatttatcctttgactttttgctccaccataaaatatgtaagtacaagatccctggactccttgaagagattatcacgttgtaaatatcagttacaggattatctaaatgaagagcttcagagtttcaattttttttgatagaataattgtaagtagactttgtatccagaatgtcagtagattttaaaatctaccttaaaatttaatgcaaatagaaataatttaatatttataataggtgtttgtgaatcttaatttccccaacagaatagtcttagaactttcagctaataataagtatgtctcacattaacaaaacttgatatttgctaaatgatttctattgttaagtgacaaaaggatgaaaaacatggttcttgtaaaaagggacttccctgtctctaaaggaaccattgggttaaaagaacaaaaaaagaaaaaaggaaaaaaaaaaaaaagtaactttccaaagtcccatttttccaaaaggatgtattgaggggtatggaaaacaggctcttaagtataatgtttattgttatgaaagtgtaacttggtactcaatctccatagatgccagtacagcaatatctatttaaaataaaaatccatatattctttgatccaacagttgcacttctaggaatttattctacagaaatatttaaccatgtgtgaaataacatgtgtaaaaatattcgtagaacattgaaattgtaaaagattggaaagatcctaaatgtctgtcaacaagttggaaacaatttaaagtacaagaaaaagagttactggaaaaatacacctatgtacacacaacatatatacatatcttaatgcttataatgaagtatctctggaaaaataagcaagaaa

SEQ ID NO: 20836 - DNA, 531 bp, Homo sapiens
  ENST00000520653
accttctaataccatcacgttggtgatttgctttgaacataagaattttgcaagagacacaaacattcagacaatagaagacactgtcttgccttcaggctatttttatgattcccacaaatccaccaccaacattcagaaagccagaactttggtccgatgatttcaccgattttgttaaaaagtgtttggtgaagaatcctgagcagagagctactgcaacacaacttttacagcatttatcctttgactttttgctccaccataaaatatgtaagtacaagatccctggactccttgaagagattatcacgttgtaaatatcagttacaggattatctaaatgaagagcttcagagtttcaattttttttgatagaataattttgcacttctaggaatttattctacagaaatatttaaccatgtgtgaaataacatgtgtaaaaatattcgtagaacattgaaattgtaaaagattggaaagatcctaaatgtctgtcaacaagttggaaacaatttaaagtacaag

SEQ ID NO: 20837 - DNA, 2065 bp, Homo sapiens
  ENST00000424861
aaagttggtccgagttcccagagtttccctctgtggtgccctaggctcggccggccggtgccccggctcctttcctcctttcggccttcgccgtccaccaggtccctctctctgtccccggccgccatggagcagccgccggcgcctaagagtaaactaaaaaagctgagtgaagacagtttgactaagcagcctgaagaagtttttgatgtattagagaagcttggagaagggtcttatggaagtgtatttaaagcaatacacaaggaatccggtcaagttgtcgcaattaaacaagtacctgttgaatcagatcttcaggaaataatcaaagaaatttccataatgcagcaatgtgacagcccatatgttgtaaagtactatggcagttattttaagaatacagacctctggattgttatggagtactgtggcgctggctctgtctcagacataattagattacgaaacaagacaggattcttaacagataccactgaaggaagtgctagctgtgatttgagaatggatctaacgcttttccatcttggagctgaattcttacattaccttcttctatatgaagcagatcctctctcatgtgttttctccctcttggtgttttcagtataaatctgaccattttgaaatagttgggtatggacctatccagcctcatgaaaagtcttacagatatgagaaagaattaagcatctgttttcaataaaatgctcataaagccacccattaatgtactcagggtgaaaggaatcaaaaaaattattggccagttaatagaagatgaaattgcaaccattcttaaatctacattgaaaggactagaatatttgcactttatgagaaaaatacacagagatataaaagctggaaatattctcctcaatacagaaggacatgcaaaattggcagattttggagtggctggtcagttaacagatacaatggcaaaacgcaatactgtaataggaactccattttggatggctcctgaggtgattcaagaaataggctataactgtgtggccgacatctggtcccttggcattacttctatagaaatggctgaaggaaaacctccttatgctgatatacatccaatgaggtaatgccttgattggttgtgtcacctgtgcagtagttgaaaatggatatgagtacacaatttcaggacctccctgcttccttgtagatcatttggccgtatgctatttttatgattcccacaaatccaccaccaacattcagaaagccagaactttggtccgatgatttcaccgattttgttaaaaagtgtttggtgaagaatcctgagcagagagctactgcaacacaacttttacaggtcagtgcttgtgcctcgaagggaaggatattttcttcatacctttcagctttctgacattggccagaattgctgtgtgtttcataactgatttctaaagatgtaaacctcccctcccctcctgtttgctcccttcttttctttcctcccctctcgtcccctcatttcccccagagtcattttaaaacaaaatttccaaagcattctcctttcagaaaggaatctttgtcttcatagttactatttctcatgttttttttttcttctgttccttgactcagcatttatcctttgactttttgctccaccataaaatatgtaagtacaagatccctggactccttgaagagattatcacgttgtaaatatcagttacaggattatctaaatgaagagcttcagagtttcaattttttttgatagaataattgtaagtagactttgtatccagaatgtcagtagattttaaaatctaccttaaaatttaatgcaaatagaaataatttaatatttataataggtgtttgtgaatcttaatttccccaacagaatagtcttagaactttcagctaataataagtatgtctcacattaacaaaacttgatatttgctaaatgatttctattgttaagtgacaaaaggatgaaaaacatggttcttgtaaaaagggacttccctgtctctaaaggaaccattgggtt

SEQ ID NO: 20838 - DNA, 587 bp, Homo sapiens
  ENST00000523567
tggagagatctctctgagctagactcttcagtggaggaaatgttacaactcatggacagtggcattaccatctgccttaggaacggagcagcctctgtcttcaagaaaaaagaatggagcacacaaggagaagaaaacaagcaagacaggttgtaggctcatcagcaaagaatgagaggaatttttccatgtctcttccaacaaagaagcctaggcattgtgttctgaaacctggatttcttaacctctgggaagaatgaaatggtctttatttatgaaggtctaaatcccaagtggaaacttaaaggactgagcttctggattttatttggcctgaaaaatgttttaagagaatgtgaattagatgcttgtgtttaaaaaacagaagttttcatataaaaactgaaatttccagtacctctttaaaaatcagaagatttggtaacattcagcctgacttccctgtgacaacaggcagttggggatgagctggagctccaactcaagacaagaatgttctttccagtttgccacagtacctaagatacctgaatgtcttctatggtaccaacatccttaaagaatat

SEQ ID NO: 20839 - DNA, 5333 bp, Homo sapiens
  ENST00000523960
ttttcatcaaaggggaggcaactccccagcagcgggcttcacacctttcccgcccttaagtatgtgtacgttgggtgcagaaccgtttggttttcccgaggggtaggcagaatttccaaccccacgagctgctccctctttccgcaaacctcctaaccccggggtttttccataaatgtgtttacttcgtccacgccagcctgcgaagttccaaaatggagtctgggccacgccggcgttctgggcacgactacggtctcttgaaaagatttggaattgaccatgtagataatctctgagagcagttcttaaagtgtaatccagaaccggtggaacttgctagaaacgcatattcttcggaccccctccaaatctgctgaatctgagattgtggaggccattcaatgtcccttcttcaggaatttggaaaaaggatggagagatctctctgagctagactcttcagtggaggaaatgttacaactcatggacagtggcattaccatctgccttaggaacggagcagcctctgtcttcaagaaaaaagaatggagcacacaaggagaagaaaacaagcaagacaggtaaagaaatgcctggttgcagtccctcctcagaccaggcagcagttttggtgttgcgttcctttagatgtttattgtccttaaaataaattcttctttttatttatgttaaattgatgtgttacttggaaacaaaggacttcagtaatacagaagagtgtttggatttccttgcagatattttagcccaagagagtgatttagatagtttcgatgaaattttgtaatatgctgtattttccttctggcaggccagcctaatccataagtaatgtgatgaatggtggagagtgacctcatcaagccccaatgaatgtacattgttgggtggtttccaaactggatggttaatcatcagacttgcctggaggcactttttaaaaaatcagattcaggactcccctctcccccttagctgtggaaggagaacagtagagggaaaacaggagagaaattagttttgcgtaagcgtgcctggatagttttgagagattccatgtcagacattcaactttcttttaatattttctcttaaaaaacaaaacaaaacaaaacaaaacccttgctgataacgtgcttgtgcttaccataggccttttctcactttacaaagaaagacccatcaccatcccaaatcaagctggccttgggtatgagaactcctaggacaccaaagagaaggttcctacgatgatgtggttcccagataaggcttagaaactctcatttagaaaaccttatttctgagagtaaaaccagcattagaaatggccattttggtattgagatatttggttgagtgtgatggtaggagtaatgataattgttgtttaacatctttcttccttaatctgagtggccctgtcctagtggttcctctaaataaggcagctgttaaagaatgcatcacctggtgagtaaaaaaagaggatattgggccaggcatggtggctcatgcctccggcactttgggaggccgaggcaggtggatcacctgaggtcaggagttcgagaccagcctggccaacatggtgaaaccccgtctctactaaaaatacaaaaactagctgggcattgtggcgtgtgcctataaccccagctacttgggaggctgagggcaggagaatggcttgaacctgggaggcaggggttgcagtaaggtgagactgcaccattgcactccagcctgtgcaacagagcaagactgcctaaaaaaaaaaaaacaaaaaaaaaaggatattggtatgaaggagtgactgtcaatatatttaagtatatgtaaatattgattattttttacctcttcaattacttattcctaaaatgtatcattgattagaaaggaacccataaacatatacatctactacgtacccacaaaaattaaaaataaaaaaattttaaaaaggaaagggaagcaactataaacacccaaagcagaataggtgaatgattctgactattttaaatgtttttcatgactacccaatttttcaggaataagtcatggataaattttttatttattttggacttgctgtatattattacataaagaatatagttagaattgattatcaaatcatcatgaaatatttatttcaaatatggtcaattctcatctttaaaaatattttttgaatgaagcaatttttttttagaaacagggtcttgctccatcacccaggctggagtgcagtggcataatcctagctcaccatggcctcaacctcctggcctcaagcttctagccttctccctctttggcctaattctcatttttatttattaaattttgcatatttccttctttcgattaataagaaataaaatgctagcttctggatttttttagcaatgcatacacttttctttcattaattcatagggaaattttgatcatatatttaaacaaaattacagagtttgatattttttaaattaacagactgttttttagagcagttttaggtttacagaacaaatgagtgaaaagtacagagttcccaaatctcttcttgtttctccccctcccaacatttccctgatgattaatatcttgcattagtatgttacatttgttatgattgatgagccaatattgattcattattattaactaaagtccacagtttacattagggttaattctttgtgtggtacattctatgggtttggacaaatgtctaatgacatatacccaccacaacagtatcggacagaagagttttactgctctgaaatgctcctgtgctccacctgttcatccatctctcccccacaactccaggaacaactgaccttttactgtctccatagttttgccttttccagaatgtcatatagatggaatcatatagtatgtagccttttggggttggcttctttcacttagtaatatgcatttaaggttcctctatgtcttttcgtggcttgataactcatttcatgttagtgctgaataatattccattgtatggatgtactacagcctgtccattcacatattgaaggaaatcattgtcatgttcaagttttagaaattagaatgaagctgctatgtttattattaactaaataataatatgctatatgttattggcataaatatgttatttattaactaaacattcatatgcaggttttgggttagtcataagtttgggtgataccaaggagcaaaaccattgctgcataattaagagtatgtttagttttgtaaaatactgccaaaccgactttcacactggctgtatcatttgcattcctaccagcaatgaactgaagtttctgttgctccacatcctcatcagcattttgtattgtcagtgttttccattttagctatttaaataggtgtgtagtagtttctaattttttgttttaatttgtaattccctaatgacatatgatgttgaacttcttttcgtatgcttattttccgtctgtatatcttttttggtgaagtgagatcttttcatgtcttttgcccatcctttatcagatatgcaaatattttctcccagtctgtggcttgtctttttattttcttaatggagtttgatttgtattcttggttcttattctttctcaacaaatgaacaccagagtttgatcaaactaaatttttcagaagaatactatgccttttatgatacctctaacttcacaaataacctaaaagtttagtcacacattctattacatttttacaaagtatcacgttggtgggaaaaagtttttgctttgttgaaatttgccatttgatattggaatacattcttaaataaatgtggttatgttatagatcattttaatgcacatttcttactttttttggctaatgaattattacttgcatttattttatatgtattttatttatttttgagatggaatctccctctgtcaccgagggtagagggcagtggtgcaattttggctcactgcaaccaccacctcctaggttcaagcgattctcctgcctcagcctcccgagtagctggcattacaggcatgtaccaccacacctggctaacttttgtatttttagtagagacggcattttgccacattagccaggctggtcttgaactcctgacaggtgttccacccacctcggcctcccaaagtgctgggattacaggctgacccactgtgcccagcctattttatatttatttttgactatggaaatgatgttagacaaaaagcaaattcaagtgattttcttattcgagttcaaaattgttgaaacagcaaattgatttattatcttgcttagcacgtttgaataacatgttataaaatgatatattaattatcatgttattgatttaatcttttttagtaatattatgtggtacttccctgaagatatttctcagttgtttttaacaatgtttttgagatatgaattaatacattaatttgaattgaaaaacaaagttattgcacactgattaatttttgagaaaaaaaagaaaaagtcaggctttatatgaaagtgaaataaggctgattggattgacatagaggattagctctttaggttttgtggcaggtattttccaagacttgaatgtattctttcctcagcacccagttttgataaaagtatatgtaaaatgtattaataacagtttactgaaaaaaattgaattgacagaagtgtaatggaattaaaattgatatggatatcctagtcctgtctaaatccaaaggataaaacctgatgcctcgaagtgaaagagtaacaaccgtggtcagccatccgtatccgtgggttcagcatctgtggattcaaccaacctcagatcaaaaatattcagaaaaaaagttgtctgtactcaacatgtacagactttttgctttcttctcattattccccaaacaatatggtataacaactatttacatagcatttacactgtattagatgttacaagtaatctacagatgatttaaagtatacaggaggatgtgcatgggttatatgaaaatactatgccattttatattagggacttcaatatccgtggattttggtatccaagtgtgcatacacaaatacaccaatttatggccgggcgcggtggctcacacctgtaatcccagctactcgggaggctgaggtaggagaattccttgaacccaggaggccgaggttgcagtgagcagaaatcgcaccactgcactccagcctgggcgaaagagcaaaactccatctcaaaaaaaaaaaaaaaaaaa

SEQ ID NO: 20840 - DNA, 531 bp, Homo sapiens
  ENST00000519420
agagctcagtcctgagcctcagctgcgggatgcctgcggtcctctctctccaactgcctcattcctcctgcagcttttctcagtttgggagatttggagggagctttctcttccttcagactccccaagcctcccactcacggggtggtgacctgaagagcgttcctacgcttcgcacttccttttcatcaaaggggaggcaactccccagcagcgggcttcacacctttcccgcccttaagtatgtgtacgttgggtgcagaaccgtttggttttcccgaggggtaggcagaatttccaaccccacgagctgctccctctttccgcaaacctcctaaccccggggtttttccataaatgtgtttacttcgtccacgccagcctgcgaagttccaaaatggagtctgggccacgccggcgttctgggcacgactacggtctcttgaaaaggccattcaatgtcccttcttcaggaatttggaaaaaggatggagagatctctctgagctagactcttcagtggaggaaatg

SEQ ID NO: 20841 - DNA, 2485 bp, Homo sapiens
  ENST00000617590
acgggaaagttggtccgagttcccagagtttccctctgtggtgccctaggctcggccggccggtgccccggctcctttcctcctttcggccttcgccgtccaccaggtccctctctctgtccccggccgccatggagcagccgccggcgcctaagagtaaactaaaaaagctgagtgaagacagtttgactaagcagcctgaagaagtttttgatgtattagagaagcttggagaagggtcttatggaagtgtatttaaagcaatacacaaggaatccggtcaagttgtcgcaattaaacaagtacctgttgaatcagatcttcaggaaataatcaaagaaatttccataatgcagcaatgtgacagcccatatgttgtaaagtactatggcagttattttaagaatacagacctctggattgttatggagtactgtggcgctggctctgtctcagacataattagattacgaaacaagacagctatttttatgattcccacaaatccaccaccaacattcagaaagccagaactttggtccgatgatttcaccgattttgttaaaaagtgtttggtgaagaatcctgagcagagagctactgcaacacaacttttacagcatccttttatcaagaatgccaaacctgtatcaatattaagagacctgatcacagaagctatggagatcaaagctaaaagacatgaggaacagcaacgagaattggaagaggaagaagaaaattcggatgaagatgagctggattcccacaccatggtgaagactagtgtggagagtgtgggcaccatgcgggccacaagcacgatgagtgaaggggcccagaccatgattgaacataatagcacgatgttggaatccgacttggggaccatggtgataaacagtgaggatgaggaagaagaagatggaactatgaaaagaaatgcaacctcaccacaagtacaaagaccatctttcatggactactttgataagcaagacttcaagaataagagtcacgaaaactgtaatcagaacatgcatgaacccttccctatgtccaaaaacgtttttcctgataactggaaagttcctcaagatggagactttgactttttgaaaaatctaagtttagaagaactacagatgcggttaaaagcactggaccccatgatggaacgggagatagaagaacttcgtcagagatacactgcgaaaagacagcccattctggatgcgatggatgcaaagaaaagaaggcagcaaaacttttgagtctaatttcctctctgtttttaactattctggagaccaagaaaccactaggaattgaaggaatatttggatatttttaatcctaagattttgccctacaattaggcagaggtcaaaaagtgacaatggtacatgcccaggtaaattcccaaaaggcagaattgacagttgtatctgctgtgcattcactctaagatgaggagaacaaaagaagtgtattctcttgttctgtcagctgcataccagtaataaaactgttatgaaatggattttcaaggtctctaaaccttgaaaatccaaagctattgttgcattgtacagcactgaagggctttatgttacaatattctttattcctatctagtatactaggctatttattgtatccccttaggtaaacttatttatttatgctattttgctttgtttcattttttaaggacaagatcaggatagctttggtgaaggtagggtcatattaatatgatgataatgtgcaaccaatttatactttctgcagggagctatggggtacattccttgatttccaggatagtttttcaaataggaaagcaataatggcagtagttctcaaatgggctaggccttttttatattgaagcaataattccatttttaccctttgaaattttgtttttttgatttttgatgtttggtacaaatagaactatatatatttaggtaaaatagatctatcgtgtttaaaaccaaagaaatcaatggaacccttgcacaaaaaagtgtgataaatatttttaaataaaaacttaatacaaatgtaatttgttaatattgtttcatgttttatgtgtagatctaatagctgaactgattcaaactgtaataagctcatcaatttcatttctatgaaaatgtgctctgttgtcacaggatgtttctgttgattttattcatttcctgggaattggtaaacatcatgttcctgatgataacccagtagcaaaaacatttgtactgagtggtacaagccttggggactgaaaaaaaaaagattaaaaccattaaaaagaaactcatttttacgctgaatgaacatttatatgattgcattgggaccagtcatttcctaagctacatatggccatcttgacagtgttttttcttttgtgtgtttaattattatgtgtaaatcataaagacaaataaatttcactgtgccacccagcata

SEQ ID NO: 20842 - DNA, 2063 bp, Homo sapiens
  ENST00000306304
gtgcgctgggcggcgctcggaccccttggcagccgcaggtgcctccccagcccagcccagctcagtccagcgcagcccagcccagcccagcccggcgctcgcagcctccgccgcttccgggcagataggtgccttttcttgctccttgctcttggagttcttctcttagtccctgttccctggatgaaagcatcgctccgagcctcatgggaggaatgaaggaagaatcgagactagatatccaactaaggcttcgggacatgttttgagcgaagatgggtgtttctgcccggatagtataaatcgaggatccaggtctgggcagattcaaccatgggagcgaacacttcaagaaaaccaccagtgtttgatgaaaatgaagatgtcaactttgaccactttgaaattttgcgagccattgggaaaggcagttttgggaaggtctgcattgtacagaagaatgataccaagaagatgtacgcaatgaagtacatgaataaacaaaagtgcgtggagcgcaatgaagtgagaaatgtcttcaaggaactccagatcatgcagggtctggagcaccctttcctggttaatttgtggtattccttccaagatgaggaagacatgttcatggtggtggacctcctgctgggtggagacctgcgttatcacctgcaacagaacgtccacttcaaggaagaaacagtgaagctcttcatctgtgagctggtcatggccctggactacctgcagaaccagcgcatcattcacagggatatgaagcctgacaatattttacttgacgaacatgggcacgtgcacatcacagatttcaacattgctgcgatgctgcccagggagacacagattaccaccatggctggcaccaagccttacatggcacctgagatgttcagctccagaaaaggagcaggctattcctttgctgttgactggtggtccctgggagtgacggcatatgaactgctgagaggccggagaccgtatcatattcgctccagtacttccagcaaggaaattgtacacacgtttgagacgactgttgtaacttacccttctgcctggtcacaggaaatggtgtcacttcttaaaaagctactcgaacctaatccagaccaacgattttctcagttatctgatgtccagaacttcccgtatatgaatgatataaactgggatgcagtttttcagaagaggctcattccaggtttcattcctaataaaggcaggctgaattgtgatcctacctttgaacttgaggaaatgattttggagtccaaacctctacataagaaaaaaaagcgtctggcaaagaaggagaaggatatgaggaaatgcgattcttctcaggtaagcaggtccccaccaaactcagggtcatgggtatccccatgatggctgcaatatcttcgagagcttctactgggaggtcatttcagcttcctgcttttgctgcttagtgaaataggagaagtagatcagccgggtttctaaaagggcagaccagagctcctctgaggatcctagcagcaacattttacttgtaggctttccgtctagagttctgccattaacttgactcagttatttctctcttccagttctcaattcaaaatttacaaatttcctgggagaggaactgtcattggccaagcttaggtcaggggatgattcataaaattatggtaaaggggcaggtttcaaagtacacacatggttgttttggacctcactcctgctttgaggagtttctgggagcagccaaccctagagatgatgtctgttctttgccacaagcagaattttatgatatcaagcctcacagaagagtgtctgttcacaggaatgacggaattctaacatggtggagcactattgctggatttcaggctgagttaaattaactttgtaactaagtatattattctctgtcagagtcagagctcagatttcagtgaagtaacttgcaaacactcagtaggattttatactcacatgtggctctatgaattataatgatgatgaagtaataaagttactttgcctct

SEQ ID NO: 20843 - DNA, 5393 bp, Homo sapiens
  ENST00000397936
gtgcgctgggcggcgctcggaccccttggcagccgcaggtgcctccccagcccagcccagctcagtccagcgcagcccagcccagcccagcccggcgctcgcagcctccgccgcttccgggcagataggtgccttttcttgctccttgctcttggagttcttctcttagtccctgttccctggatgaaagcatcgctccgagcctcatgggaggaatgaaggaagaatcgagactagatatccaactaaggcttcgggacatgttttgagcgaagatgggtgtttctgcccggatagtataaatcgaggatccaggtctgggcagattcaaccatgggagcgaacacttcaagaaaaccaccagtgtttgatgaaaatgaagatgtcaactttgaccactttgaaattttgcgagccattgggaaaggcagttttgggaaggtctgcattgtacagaagaatgataccaagaagatgtacgcaatgaagtacatgaataaacaaaagtgcgtggagcgcaatgaagtgagaaatgtcttcaaggaactccagatcatgcagggtctggagcaccctttcctggttaatttgtggtattccttccaagatgaggaagacatgttcatggtggtggacctcctgctgggtggagacctgcgttatcacctgcaacagaacgtccacttcaaggaagaaacagtgaagctcttcatctgtgagctggtcatggccctggactacctgcagaaccagcgcatcattcacagggatatgaagcctgacaatattttacttgacgaacatgggcacgtgcacatcacagatttcaacattgctgcgatgctgcccagggagacacagattaccaccatggctggcaccaagccttacatggcacctgagatgttcagctccagaaaaggagcaggctattcctttgctgttgactggtggtccctgggagtgacggcatatgaactgctgagaggccggagaccgtatcatattcgctccagtacttccagcaaggaaattgtacacacgtttgagacgactgttgtaacttacccttctgcctggtcacaggaaatggtgtcacttcttaaaaagctactcgaacctaatccagaccaacgattttctcagttatctgatgtccagaacttcccgtatatgaatgatataaactgggatgcagtttttcagaagaggctcattccaggtttcattcctaataaaggcaggctgaattgtgatcctacctttgaacttgaggaaatgattttggagtccaaacctctacataagaaaaaaaagcgtctggcaaagaaggagaaggatatgaggaaatgcgattcttctcagacatgtcttcttcaagagcaccttgactctgtccagaaggagttcataattttcaacagagaaaaagtaaacagggactttaacaaaagacaaccaaatctagccttggaacaaaccaaagacccacaaggtgaggatggtcagaataacaacttgtaaaggcctcatgtcttcttcttgggacaatctcatgccagaaacttctaattacatatgtcaagaaaagctgacagtagttcttgccactccacacaccatgacttagaaaatgtgaatgaatatatttcaaaaaaggcagcacaacacagtgaagggtcctgggcctgagctcctgggatgtcatttcacatcaatcaactgtgtgatctagagcaagtcacttagccactttctgtgctttactttatttatctaaaatgagagggttatactagacgagccataccctgcctttttagtgctatagttgttattctaaaccgcctttatttttattttaaaattaatatatgaatatagatttatttttccactccttctaattatgcagtgacaaatggacaaatggacacaggactcagtgagacttttcagacctcgaaagtttcataaagtggtcagaatgccccaggctacttggataaagataaggaattctatcagggaggcatgaatggaatcagattaaaagtaacagagatggatgagggccttccagtgatatgcgtgaatcagcattagatccgcttatctcagctggcaggagcctgctgtgcacaccacttcccagctccctcttcaacaatgtgaaagtggtaacttgaaattggtaataatgggagcatttacaccacggaaactggtaaatgctcgttttttccctcctaacaagtgaattgctaaatattagcccaccactccttccaagaagcatgttccttgagggctaattgtcctctgaagattagcagagacctgtatctggagaggatcagaaaagaatgtcatcacactgaaagtatgtccaccttgcagttcagaaaagttgcatcttatatggggtttattgtctaagttagaaatgaatttagaagatagtaaaatttaccgttgaaaaaccccttaaattacccataaagtatatgggaagtatcttttctcagtaaagcccaatacagtgtcacctttcactaatgaaacaagccattgcttttgttttgttttgacttagttatttttatttttggtctcattttggctaataccagatgagctaaaatgttgaacaaattatacttgtttttatagactagaattactcttttttttcttttcaggcagagtctcactctgtcacccaggctggagtgcagtggcatgatctctgctcactacatctgcctcccgggttcaagtgattcttgtgtctcagcctcctaagtagctgggatcgcatgtgtgtgccaccatgtgtagctaattttttgtatttttagtagagataggattttgctaagctggccaggttggtttcaaactcctggtctcaagtgatccgcccaccttggcctcccaaagtgctgggattacaggcgtgagccaccaaacctggccttagaattactcttagaacagtggaatgcccacacatccaagacaggcaagttcatggagactaagggaacagtggtatcatgtctcccttctcccttgtgcttactacaagaatggcaggcagaattccctacttatttaaaatatcactgatgtctcactctttttctttatattttatttattgatttgccacaaagtttaattcacctaagtgagacgtgcatatgatgtaactccactgtacagatacacagatctttacagaagaactatttttggcaacccctatgcccctgggtagggtccagaagtgaacaggcttggtgggggattgttttcacctcttggctactcagagtacctaaacctgtccttacttatggagagcatgtgtcacaccaagatggcagtaagctggcaactgcgaagacctgactgatgcccatttgggaagccaggcaagtgaaaatggaccgaagaaacagagatggctgtcttttatgcagggcttttccataaagaggttacactggggcaaccaagtatgtgtagaaagccagagctaaacttcagcttggcattcacagttttctcttcactgagctaataggcccagagtttcgggcagagctgtgaaatagtgcttctctaatagcaaccatattattgttacataattaaaagccagctcttttgttgtttgtttgattccttttccctacagttcccacatcatttgtctgtgctattctgtttttctccaaacactataaacttgaagcaattgccctgactcgatttcagagaaggggatgtgttggaaagagcaagaataagaaagtgaccagattctgctgcagtctggtaaccccacgagtgtcagggactacttgcatgtttacttctatccttcatttgttttgattcaagcctttatgtgctgtggactcacctccctaagtaaccaggttcctcctctcgctgcaaccttgtttgcatccttcccaagaagaggctttgggaaatttttctgtaattacacttaccaaagagccatggaaccattaggatctccactgtgatgagagttaagccatagtgccatttcacacgtatacatttatgatgggatgggaacccgatacaatctctgtaggctgaatccctagttttatttccagtgagctgcttctgtgactgaagcacctctgtgggcttttgggaaccatggatgcacagatgagagagcacaggctcagagagtaagatggatttctagtgctagccaggtgaatgacacacagtgtatttcaagtttgaaaagcaaaaccatggtatctgacagtgctgattgtaatcacctcccaccactgtgcattttaaacatgagaacaaaaaacttttccaaaatttaaacttttcctaaatctttgtggtcattgctagttgttgacatcagatcctttggttttattctataacttgggctaaacgttaatatcccactaggtggaacatgtctcttccggagttgtgacaaccgaggctcagagctgtgatttttagaaaacaagatgactattaaatcctttggcctggtattcttgaatgtttttctcccagtgcttcccttgcctgtatggagcatctgcaaagtctgagcaggttttgaagtccaagagcatcccagctataaggctcttgcactgtgacagagctgcccacctccagtacaccctcagtgacctcgagtagatgcgtagggcagtcaaacccggcaacttatgccacaaccctaattccaggaagtcgtctgctaatggctaacccactgccatggtggcactggttttgcctgaggtcattgctagggcaggaatgaacagcaaccagcacagagcattgctaaattaattacagtaatctaattaattagtagctaggcttcttctgataggaaagtttcaaccagaaaccactagatgttctattatcatagcttttgtagattggatggaagaataagtaggaagaaagagtattaatgtagctagtagggaccagtgttgctgcttgtggctgaggcagtaatgctaaggctttagctcttcaaaagcagaatgaaaaggcacaaaaagcacttcaagcttgtttctgtacccagttgtccctgtattgtctacataaaatcctgtttcctgctatctgtctgtgattcctgtttattacaaattcagtgtgtctgactgatattaaacactgatattaaaatttcaaacttcacttatctgtgctgttgtgaacaggcagctgatctggcagccctcgaatgggaaacaagtgcttctgttgagctgtagcatatataatataaatgtgcctatgtgtattaaaatgtcttctgtaaacaa

SEQ ID NO: 20844 - DNA, 766 bp, Homo sapiens
  ENST00000503975
cggcgctcgcagcctccgccgcttccgggcagataggtgccttttcttgctccttgctcttggagttcttctcttagtccctgttccctggatgaaagcatcgctccgagcctcatgggaggaatgaaggaagaatcgagactagatatccaactaaggcttcgggacatgttttgagcgaagatgggtgtttctgcccggatagtataaatcgaggatccaggtctgggcagattcaaccatgggagcgaacacttcaagaaaaccaccagtgtttgatgaaaatgaagatggtaagaaatatgggatagtggcatataaaaaatagaattttgcaaaattcaagtatatgcttctagtttcataagttaagcataagcatggtctgtagggccttgaaggaaaaaggcaaagctgcatgagtgagtctgaggactttgtaggctcatagctaggttttaccttccactttccatgggacctttggcagctttcctaatctccactataccaatgtcctttgtccaaagggagctgcagttgggcatgtggtggatagttaaatgatttgtttgtcctctgtgctgttccttggcagttgaagttacccccattgctcattgttacagaaaatacattatcaacatgtacatgaatgataaccagtgctcataatattatagaatgaagctgtgccttctgaatttccaactgccaagcttttgtgtactagacaaatcccataatgctacgtcatagaaaaaag

SEQ ID NO: 20845 - DNA, 798 bp, Homo sapiens
  ENST00000626951
ccttgctcttggagttcttctcttagtccctgttccctggatgaaagcatcgctccgagcctcatgggaggaatgaaggaagaatcgagactagatatccaactaaggcttcgggacatgttttgagcgaagatgggtgtttctgcccggatagtataaatcgaggatccaggtctgggcagattcaaccatgggagcgaacacttcaagaaaaccaccagtgtttgatgaaaatgaagatgtcaactttgaccactttgaaattttgcgagccattgggaaaggcagttttgggaaggtctgcattgtacagaagaatgataccaagaagatgtacgcaatgaagtacatgaataaacaaaagtgcgtggagcgcaatgaagtgagaaatgtcttcaaggaactccagatcatgcagggtctggagcaccctttcctggttaatttgtggtattccttccaagatgaggaagacatgttcatggtggtggacctcctgctgggtggagacctgcgttatcacctgcaacagaacgtccacttcaaggaagaaacagtgaagctcttcatctgtgagctggtcatggccctggactacctgcagaaccagcgcatcattcacagggatatgaagcctgacaatattttacttgacgaacatgatacctggctctcctacaagtcccactgaattggagtttcaggagaccgaagcccaggcacatgtattttgcaaaactacactgaagtttctgataatgacggatatcaacaattaaacgcttacttcttgccaaa

SEQ ID NO: 20846 - DNA, 1637 bp, Homo sapiens
  ENST00000398523
ctcttagtccctgttccctggatgaaagcatcgctccgagcctcatgggaggaatgaaggaagaatcgagactagatatccaactaaggcttcgggacatgttttgagcgaagatgggtgtttctgcccggatagtataaatcgaggatccaggtctgggcagattcaaccatgggagcgaacacttcaagaaaaccaccagtgtttgatgaaaatgaagatgtcaactttgaccactttgaaattttgcgagccattgggaaaggcagttttgggaaggtctgcattgtacagaagaatgataccaagaagatgtacgcaatgaagtacatgaataaacaaaagtgcgtggagcgcaatgaagtgagaaatgtcttcaaggaactccagatcatgcagggtctggagcaccctttcctggttaatttgtggtattccttccaagatgaggaagacatgttcatggtggtggacctcctgctgggtggagacctgcgttatcacctgcaacagaacgtccacttcaaggaagaaacagtgaagctcttcatctgtgagctggtcatggccctggactacctgcagaaccagcgcatcattcacagggatatgaagcctgacaatattttacttgacgaacatgggcacgtgcacatcacagatttcaacattgctgcgatgctgcccagggagacacagattaccaccatggctggcaccaagccttacatggcacctgagatgttcagctccagaaaaggagcaggctattcctttgctgttgactggtggtccctgggagtgacggcatatgaactgctgagaggccggagaccgtatcatattcgctccagtacttccagcaaggaaattgtacacacgtttgagacgactgttgtaacttacccttctgcctggtcacaggaaatggtgtcacttcttaaaaagctactcgaacctaatccagaccaacgattttctcagttatctgatgtccagaacttcccgtatatgaatgatataaactgggatgcagtttttcagaagaggctcattccaggtttcattcctaataaaggcaggctgaattgtgatcctacctttgaacttgaggaaatgattttggagtccaaacctctacataagaaaaaaaagcgtctggcaaagaaggagaaggatatgaggaaatgcgattcttctcagacatgtcttcttcaagagcaccttgactctgtccagaaggagttcataattttcaacagagaaaaagtaaacagggactttaacaaaagacaaccaaatctagccttggaacaaaccaaagacccacaagtgacaaatggacaaatggacacaggactcagtgagacttttcagacctcgaaagtttcataaagtggtcagaatgccccaggctacttggataaagataaggaattctatcagggaggcatgaatggaatcagattaaaagtaacagagatggatgagggccttccagtgatatgcgtgaatcagcattagatccgcttatctcagctggcaggagcctgctgtgcacaccacttcccagctccctcttcaacaatgtgaaagtggtaacttgaaattggtaataatgggagcatttacaccac

SEQ ID NO: 20847 - DNA, 659 bp, Homo sapiens
  ENST00000503384
ggactctaatttaggcaaagcaacagcaggtgtggatgtgaggaggcaaaaggagacagggggtggttatataactacattatcaaccatatttttcccatttatagtctttaagctcacatcatctgtgcaattctagagttacacaagaaaatgatgcttaatactactaacattactttatggcaatgtaaatgctttatatgatccaatggaccaatatctacatgcttagatacaacatgctataggaagtttagagtctgagtttttgaatgagagaggccttggttcagagcccatttcttccatttactagcctgtgaccttgggttaagcttcagttttctgatttaaaaattggggattttctgtctcataaatttactgtgagaattgaatgagaagatgagtattgagaagctagtacactgtttcaactccagttagctttcttaagcctttttgcccctaccccttagttctgttcgttttattgtgagcaactttcttttttctttttactcctctagggatatgaagcctgacaatattttacttgacgaacatgggcacgtgcacatcacagatttcaacattgctgcgatgctgcccagggagacacagattaccaccatggctggcaccaagccttacat

SEQ ID NO: 20848 - DNA, 668 bp, Homo sapiens
  ENST00000515832
gcaacaacaatggccatcaagcattttgtttgcacctctgtgatcagaagcagcagtgtcggaagcacagatcctcagaatttggagaacacagttcttgctttccaccctgactctcacaggctgtgtgcaaactgctccggaacatgtgtgtgctcagctccctcccatggggctggaggatgagggatgggtagctgctgctgtgctaagagcttaagttggtcataattaactgcgctttgccacccaagccttccctgaaagttgcaagctttcaatagactccagagttctaaaatagtgacattagacagattctgccagtgcaatcgctgtctaggaggggagacagattcctggtgcttcctgttttgccagcttcccggaatcttcttcacatagcatccattttgaagatactacttacttctcaatttggggctattcattgaatagactgtcaccaggttattggctgtttgaagattctcatttgtctgctaactatacctctattttttttctacgttcacctggaagacatgtcttcttcaagagcaccttgactctgtccagaaggagttcataattttcaacagagaaaaagtaaacagggactttaacaaaagacaaccaaatctagccttggaacaaaccaaagaccc

SEQ ID NO: 20849 - DNA, 545 bp, Homo sapiens
  ENST00000506091
ctcaatttggggctattcattgaatagactgtcaccaggttattggctgtttgaagattctcatttgtctgctaactatacctctattttttttctacgttcacctggaagacatgtcttcttcaagagcaccttgactctgtccagaaggagttcataattttcaacagagaaaatgacaaatggacaaatggacacaggactcagtgagacttttcagacctcgaaagtttcataaagtggtcagaatgccccaggctacttggataaagataaggaattctatcagggaggcatgaatggaatcagattaaaagtaacagagatggatgagggccttccagtgatatgcgtgaatcagcattagatccgcttatctcagctggcaggagcctgctgtgcacaccacttcccagctccctcttcaacaatgtgaaagtggtaacttgaaattggtaataatgggagcatttacaccacggaaactggtaaatgctcgttttttccctcctaacaagtgaattgctaaatattagcccaccact

SEQ ID NO: 20850 - DNA, 294 bp, Homo sapiens
  ENST00000510953
ttgaatagactgtcaccaggttattggctgtttgaagattctcatttgtctgctaactatacctctattttttttctacgttcacctggaagacatgtcttcttcaagagcaccttgactctgtccagaaggagttcataattttcaacagagaaaaagtaaacagggactttaacaaaagacaaccaaatctagccttggaacaaaccaaagacccacaagtgacaaatggacaaatggacacaggactcagtgagacttttcagacctcgaaagtttcataaagtggtcaga

SEQ ID NO: 20851 - DNA, 3582 bp, Homo sapiens
  ENST00000282908
ctgcgtgctgccttcgtccgtcccctcctcccccgctccttcccctccttcccctgctcccgcgccgcctcgcgtctcccgcccgctgtagccggcgaggagcgccgcacgttggccccggcgcgaggagctcccgggttcccgggcgggcactggagtaaggagctgcgagcgcagcccgaggcggggcacggcggaaggcgcggcgagagcggggtccctgcgagcgcagtcggaagggcgtccaggagaagggggacgccgtccccgcccctgcacggtgctcggccccctcgggctccgcgcgcggctacaacccggactgggcgcgcccccggcatcccgcatctctgcgcgcgtcccacatcccgcatccggcatcccagcggccgggcatgtagcagcggcagcaacggcggaatatgggcgggaaccactcccacaagccccccgtgtttgacgagaatgaggaagtcaactttgaccattttcagattctgcgggccattggtaaagggagttttggaaaggtatgcatcgtgcagaagcgagacactaagaaaatgtatgcaatgaagtacatgaacaagcagaagtgcatcgagagggatgaggttcggaatgttttccgggagctgcagatcatgcaagggctggagcaccccttcctggtcaatctgtggtactccttccaggatgaggaggacatgttcatggtggtggacctgctcctgggaggcgacctgcgctaccatctgcagcagaatgtgcatttcacagaggggactgtgaaactctacatctgtgagctggcactggccctggagtatcttcagaggtaccacatcatccacagagacatcaagccagacaatatcctgctggatgaacacggacatgttcacattacagacttcaacatagcgacggtagtgaaaggagcagaaagggcttcctccatggctggcaccaagccctacatggctccagaagtattccaggtgtacatggacagaggccccggatactcgtaccctgtcgactggtggtccctgggcatcacagcctatgagctgctgcggggctggaggccgtacgaaatccactcggtcacgcccatcgatgaaatcctcaacatgttcaaggtggagcgtgtccactactcctccacgtggtgcaaggggatggtggccctgctgaggaagctcctgaccaaggatcctgagagccgcgtgtccagccttcatgacatacagagcgtgccctacttggccgacatgaactgggacgcggtgttcaagaaggcactgatgcccggctttgtgcccaataaagggaggttgaactgcgatcccacatttgagcttgaagagatgattctagaatccaagccacttcacaaaaagaagaagcgattggcaaagaacagatccagggatggcacaaaggacagctgcccgctgaatggacacctgcagcactgtttggagactgtccgggaggaattcatcatattcaacagagagaagctcaggaggcagcagggacagggcagccagctcttggacaccgacagccgagggggaggccaggcccaaagcaagctccaggacgggtgcaacaacaacctcctcacccacacctgcacccgtggctgcagcagctgagcccacacttgttgctgctcaacaggactgcactcgtctctgccctgcccacccagagcccctctttgtgccctgatggtccctgtctcacccctgaaaacatcagatgcagaaaaagccctggacttggagctgggaagcctgggttctggtcccatctccatgactgattcacgtgtgacctcagacaagtcacgccctctctgtgcctccgttttctgcatctgccaaaggggttaaacacttctgccccacttcaaattacaagattatggggagaacccaattaggtaggaaacatgaaaaacctttgatatttataaaatcatttttacgtgcaaaatataaccttaatatttgaagtgacccccattccccaaagcaatcaaaccgtcatgactttgcaatttggcacatcctagcttgttagagggcacttccgaaaaacacagccctgacagcaaaataaaggtctgatatgttggccccttctatggaaacaacgctgccaaatcctggagcaaaacctgaagtgtcttcatgtgcattctctggcaggccacagtcctgagcttgtaagatggtgcagcatgcagaccagacttgtccccaaggtctcagcgctgcggtctcactcctcccctcatttaagaagactatccttaccttttagtttcagcagtcctcaccaccaccatatccccagtgctgggatggcacacaggtgtccattcagatgagagttgggtcgctgagcattggttactcctgcagagtgtaatcagcaccccatccaactggcccgaaagcccagacctgcagcagaactctccaactctctatcagctttcagggttttctctcctgggaagggtgtaaaatcagcttgtcagattcttcttacagagagtatccaatcggtattggtggagcggctccctatttatacaataggaagcatgggtgcttagaaagtttatttcaggaggaaaatgggttcacacaaaaagcaaactacattctggtctgctcagggagaagcttgcctttgaactggaagatgttgggatgagcagggaaagcttagactttggagtcaggtttgtgttcagaatccagccctgctggctactaactaactgggagaccttaggcaaagcatgcaatcgctctgaatggcagtttcctcatttttaaacagggataataaaactaatattgcaggggagttacagggttaaataagatcctgtgtgtaaccccaagcattggatgactcatagaatggccttttttgtcagcataatcgtcatcattatttagatactttcttccttcactcacccagcaggtcagttttctgtgcaaacaaacctgtttaggattcttccaaatgttcttcctggggtctttgatatttgtttgttacatcctgctgaagttcgactgtgtttttattttttcatccaacttccatttttcactttttacatgattactcaatccttggggctgtccatgtcatctcttagatttcttaaaagacattttaatgtatggttaggttttatatttttattttttaaaaaagaaatagtcagtgttttcctcctttcaaccgagactatttctggattgtgtgctcctcgtcagttgacttgttttgcacacttttctttacttcatgtccccatcaacaaccgtcctgctccccacctcccccaggaaataaggggcctgctcctctccctactgtgaccctggaggctcttaagatgatgatggttttttttattgggctgagttcacgaattaggggcaggagctggaagtcgccctaggaacaccagatttcctggttctgttcaagttggcatttcttgtttggaataaactatttcttggacattccttc

SEQ ID NO: 20852 - DNA, 1989 bp, Homo sapiens
  ENST00000512018
ggagtaaggagctgcgagcgcagcccgaggcggggcacggcggaaggcgcggcgagagcggggtccctgcgagcgcagtcggaagggcgtccaggagaagggggacgccgtccccgcccctgcacggtgctcggccccctcgggctccgcgcgcggctacaacccggactgggcgcgcccccggcatcccgcatctctgcgcgcgtcccacatcccgcatccggcatcccagcggccgggcatgtagcagcggcagcaacggcggaatatgggcgggaaccactcccacaagccccccgtgtttgacgagaatgaggaagtcaactttgaccattttcagattctgcgggccattggtaaagggagttttggaaaggattgccaatgccgtttgttccttgagaatctaagtgaggaaagttgaaaaaaaacccataaacatcacaaaggcagctctttccagcaacatagacgtttgttgttttggtatgcatcgtgcagaagcgagacactaagaaaatgtatgcaatgaagtacatgaacaagcagaagtgcatcgagagggatgaggttcggaatgttttccgggagctgcagatcatgcaagggctggagcaccccttcctggtcaatctgtggtactccttccaggatgaggaggacatgttcatggtggtggacctgctcctgggaggcgacctgcgctaccatctgcagcagaatgtgcatttcacagaggggactgtgaaactctacatctgtgagctggcactggccctggagtatcttcagaggtaccacatcatccacagagacatcaagccagacaatatcctgctggatgaacacggacatgttcacattacagacttcaacatagcgacggtagtgaaaggagcagaaagggcttcctccatggctggcaccaagccctacatggctccagaagtattccaggtgtacatggacagaggccccggatactcgtaccctgtcgactggtggtccctgggcatcacagcctatgagctgctgcggggctggaggccgtacgaaatccactcggtcacgcccatcgatgaaatcctcaacatgttcaaggtggagcgtgtccactactcctccacgtggtgcaaggggatggtggccctgctgaggaagctcctgaccaaggatcctgagagccgcgtgtccagccttcatgacatacagagcgtgccctacttggccgacatgaactgggacgcggtgttcaagaaggcactgatgcccggctttgtgcccaataaagggaggttgaactgcgatcccacatttgagcttgaagagatgattctagaatccaagccacttcacaaaaagaagaagcgattggcaaagaacagatccagggatggcacaaaggacagctgcccgctgaatggacacctgcagcactgtttggagactgtccgggaggaattcatcatattcaacagagagaagctcaggaggcagcagggacagggcagccagctcttggacaccgacagccgagggggaggccaggcccaaagcaagctccaggacgggtgcaacaacaacctcctcacccacacctgcacccgtggctgcagcagctgagcccacacttgttgctgctcaacaggactgcactcgtctctgccctgcccacccagagcccctctttgtgccctgatggtccctgtctcacccctgaaaacatcagatgcagaaaaagccctggacttggagctgggaagcctgggttctggtcccatctccatgactgattcacgtgtgacctcagacaagtcacgccctctctgtgcctccgttttctgcatctgccaaaggggttaaacacttctgccccacttcaaattacaagattatggggagaacccaattaggtaggaaacatgaaaaacctttgatatttataaaatcatttttacgtgcaaaatataaccttaatatttgaagtga

SEQ ID NO: 20853 - DNA, 3272 bp, Homo sapiens
  ENST00000512636
gggatttactggcaaggccgtacattgttgacctgtcttggtgtagggaaacatgtagaagccaggcagaagtggggtagagagtgaagcagcaagactgcagagcctcatcaagaagtgtggagtgaagggaaggcttcagatggacaatttgtgtgctggggaaaaaatggaatgtgctgcaaattcccctgtggataagggtggacggctgctctggcaagtatagtgcacctgacccaagagcctttggaatagtcaactttgaccattttcagattctgcgggccattggtaaagggagttttggaaaggtatgcatcgtgcagaagcgagacactaagaaaatgtatgcaatgaagtacatgaacaagcagaagtgcatcgagagggatgaggttcggaatgttttccgggagctgcagatcatgcaagggctggagcaccccttcctggtcaatctgtggtactccttccaggatgaggaggacatgttcatggtggtggacctgctcctgggaggcgacctgcgctaccatctgcagcagaatgtgcatttcacagaggggactgtgaaactctacatctgtgagctggcactggccctggagtatcttcagaggtaccacatcatccacagagacatcaagccagacaatatcctgctggatgaacacgctccagaagtattccaggtgtacatggacagaggccccggatactcgtaccctgtcgactggtggtccctgggcatcacagcctatgagctgctgcggggctggaggccgtacgaaatccactcggtcacgcccatcgatgaaatcctcaacatgttcaaggtggagcgtgtccactactcctccacgtggtgcaaggggatggtggccctgctgaggaagctcctgaccaaggatcctgagagccgcgtgtccagccttcatgacatacagagcgtgccctacttggccgacatgaactgggacgcggtgttcaagaaggcactgatgcccggctttgtgcccaataaagggaggttgaactgcgatcccacatttgagcttgaagagatgattctagaatccaagccacttcacaaaaagaagaagcgattggcaaagaacagatccagggatggcacaaaggacagctgcccgctgaatggacacctgcagcactgtttggagactgtccgggaggaattcatcatattcaacagagagaagctcaggaggcagcagggacagggcagccagctcttggacaccgacagccgagggggaggccaggcccaaagcaagctccaggacgggtgcaacaacaacctcctcacccacacctgcacccgtggctgcagcagctgagcccacacttgttgctgctcaacaggactgcactcgtctctgccctgcccacccagagcccctctttgtgccctgatggtccctgtctcacccctgaaaacatcagatgcagaaaaagccctggacttggagctgggaagcctgggttctggtcccatctccatgactgattcacgtgtgacctcagacaagtcacgccctctctgtgcctccgttttctgcatctgccaaaggggttaaacacttctgccccacttcaaattacaagattatggggagaacccaattaggtaggaaacatgaaaaacctttgatatttataaaatcatttttacgtgcaaaatataaccttaatatttgaagtgacccccattccccaaagcaatcaaaccgtcatgactttgcaatttggcacatcctagcttgttagagggcacttccgaaaaacacagccctgacagcaaaataaaggtctgatatgttggccccttctatggaaacaacgctgccaaatcctggagcaaaacctgaagtgtcttcatgtgcattctctggcaggccacagtcctgagcttgtaagatggtgcagcatgcagaccagacttgtccccaaggtctcagcgctgcggtctcactcctcccctcatttaagaagactatccttaccttttagtttcagcagtcctcaccaccaccatatccccagtgctgggatggcacacaggtgtccattcagatgagagttgggtcgctgagcattggttactcctgcagagtgtaatcagcaccccatccaactggcccgaaagcccagacctgcagcagaactctccaactctctatcagctttcagggttttctctcctgggaagggtgtaaaatcagcttgtcagattcttcttacagagagtatccaatcggtattggtggagcggctccctatttatacaataggaagcatgggtgcttagaaagtttatttcaggaggaaaatgggttcacacaaaaagcaaactacattctggtctgctcagggagaagcttgcctttgaactggaagatgttgggatgagcagggaaagcttagactttggagtcaggtttgtgttcagaatccagccctgctggctactaactaactgggagaccttaggcaaagcatgcaatcgctctgaatggcagtttcctcatttttaaacagggataataaaactaatattgcaggggagttacagggttaaataagatcctgtgtgtaaccccaagcattggatgactcatagaatggccttttttgtcagcataatcgtcatcattatttagatactttcttccttcactcacccagcaggtcagttttctgtgcaaacaaacctgtttaggattcttccaaatgttcttcctggggtctttgatatttgtttgttacatcctgctgaagttcgactgtgtttttattttttcatccaacttccatttttcactttttacatgattactcaatccttggggctgtccatgtcatctcttagatttcttaaaagacattttaatgtatggttaggttttatatttttattttttaaaaaagaaatagtcagtgttttcctcctttcaaccgagactatttctggattgtgtgctcctcgtcagttgacttgttttgcacacttttctttacttcatgtccccatcaacaaccgtcctgctccccacctcccccaggaaataaggggcctgctcctctccctactgtgaccctggaggctcttaagatgatgatggttttttttattgggctgagttcacgaattaggggcaggagctggaagtcgccctaggaacaccagatttcctggttctgttcaagttggcatttcttgtttggaataaactatttcttggacattc

SEQ ID NO: 20854 - DNA, 3241 bp, Homo sapiens
  ENST00000510398
gtagagagtgaagcagcaagactgcagagcctcatcaagaagtgtggagtgaagggaaggcttcagatggacaatttgtgtgctggggaaaaaatggaatgtgctgcaaattcccctgtggataagggtggacggctgctctgtcaactttgaccattttcagattctgcgggccattggtaaagggagttttggaaaggtatgcatcgtgcagaagcgagacactaagaaaatgtatgcaatgaagtacatgaacaagcagaagtgcatcgagagggatgaggttcggaatgttttccgggagctgcagatcatgcaagggctggagcaccccttcctggtcaatctgtggtactccttccaggatgaggaggacatgttcatggtggtggacctgctcctgggaggcgacctgcgctaccatctgcagcagaatgtgcatttcacagaggggactgtgaaactctacatctgtgagctggcactggccctggagtatcttcagaggtaccacatcatccacagagacatcaagccagacaatatcctgctggatgaacacggacatgttcacattacagacttcaacatagcgacggtagtgaaaggagcagaaagggcttcctccatggctggcaccaagccctacatggctccagaagtattccaggtgtacatggacagaggccccggatactcgtaccctgtcgactggtggtccctgggcatcacagcctatgagctgctgcggggctggaggccgtacgaaatccactcggtcacgcccatcgatgaaatcctcaacatgttcaaggtggagcgtgtccactactcctccacgtggtgcaaggggatggtggccctgctgaggaagctcctgaccaaggatcctgagagccgcgtgtccagccttcatgacatacagagcgtgccctacttggccgacatgaactgggacgcggtgttcaagaaggcactgatgcccggctttgtgcccaataaagggaggttgaactgcgatcccacatttgagcttgaagagatgattctagaatccaagccacttcacaaaaagaagaagcgattggcaaagaacagatccagggatggcacaaaggacagctgcccgctgaatggacacctgcagcactgtttggagactgtccgggaggaattcatcatattcaacagagagaagctcaggaggcagcagggacagggcagccagctcttggacaccgacagccgagggggaggccaggcccaaagcaagctccaggacgggtgcaacaacaacctcctcacccacacctgcacccgtggctgcagcagctgagcccacacttgttgctgctcaacaggactgcactcgtctctgccctgcccacccagagcccctctttgtgccctgatggtccctgtctcacccctgaaaacatcagatgcagaaaaagccctggacttggagctgggaagcctgggttctggtcccatctccatgactgattcacgtgtgacctcagacaagtcacgccctctctgtgcctccgttttctgcatctgccaaaggggttaaacacttctgccccacttcaaattacaagattatggggagaacccaattaggtaggaaacatgaaaaacctttgatatttataaaatcatttttacgtgcaaaatataaccttaatatttgaagtgacccccattccccaaagcaatcaaaccgtcatgactttgcaatttggcacatcctagcttgttagagggcacttccgaaaaacacagccctgacagcaaaataaaggtctgatatgttggccccttctatggaaacaacgctgccaaatcctggagcaaaacctgaagtgtcttcatgtgcattctctggcaggccacagtcctgagcttgtaagatggtgcagcatgcagaccagacttgtccccaaggtctcagcgctgcggtctcactcctcccctcatttaagaagactatccttaccttttagtttcagcagtcctcaccaccaccatatccccagtgctgggatggcacacaggtgtccattcagatgagagttgggtcgctgagcattggttactcctgcagagtgtaatcagcaccccatccaactggcccgaaagcccagacctgcagcagaactctccaactctctatcagctttcagggttttctctcctgggaagggtgtaaaatcagcttgtcagattcttcttacagagagtatccaatcggtattggtggagcggctccctatttatacaataggaagcatgggtgcttagaaagtttatttcaggaggaaaatgggttcacacaaaaagcaaactacattctggtctgctcagggagaagcttgcctttgaactggaagatgttgggatgagcagggaaagcttagactttggagtcaggtttgtgttcagaatccagccctgctggctactaactaactgggagaccttaggcaaagcatgcaatcgctctgaatggcagtttcctcatttttaaacagggataataaaactaatattgcaggggagttacagggttaaataagatcctgtgtgtaaccccaagcattggatgactcatagaatggccttttttgtcagcataatcgtcatcattatttagatactttcttccttcactcacccagcaggtcagttttctgtgcaaacaaacctgtttaggattcttccaaatgttcttcctggggtctttgatatttgtttgttacatcctgctgaagttcgactgtgtttttattttttcatccaacttccatttttcactttttacatgattactcaatccttggggctgtccatgtcatctcttagatttcttaaaagacattttaatgtatggttaggttttatatttttattttttaaaaaagaaatagtcagtgttttcctcctttcaaccgagactatttctggattgtgtgctcctcgtcagttgacttgttttgcacacttttctttacttcatgtccccatcaacaaccgtcctgctccccacctcccccaggaaataaggggcctgctcctctccctactgtgaccctggaggctcttaagatgatgatggttttttttattgggctgagttcacgaattaggggcaggagctggaagtcgccctaggaacaccagatttcctggttctgttcaagttggcatttcttgtttggaataaactatttcttgg

SEQ ID NO: 20855 - DNA, 460 bp, Homo sapiens
  ENST00000513705
tcttcaggaagcactccttaataaattgcttgcagatgaagcctcatctcaaagtctgcatctggaagaactcaactaagaaagctgcactttcgaaagagcagaatcgtgggtagaattgtattaatagatctctcgagctggctggagtcctacaggtactccttccaggatgaggaggacatgttcatggtggtggacctgctcctgggaggcgacctgcgctaccatctgcagcagaatgtgcatttcacagaggggactgtgaaactctacatctgtgagctggcactggccctggagtatcttcagaggtaccacatcatccacagcattttcatgaatttaaagcagatgcttcaaactctgtctttaaattcctcgttcctgttcccatggaccacttaattttaaaatgttaactcactaaaaggcaaataaacgatacactaaaagcaca

SEQ ID NO: 20856 - DNA, 798 bp, Homo sapiens
  ENST00000505508
ctcccctgctgccatgtgtaaatgcgtttacttctcctttgccttccgccatgattgtactccttccaggatgaggaggacatgttcatggtggtggacctgctcctgggaggcgacctgcgctaccatctgcagcagaatgtgcatttcacagaggggactgtgaaactctacatctgtgagctggcactggccctggagtatcttcagaggtaccacatcatccacagagacatcaagccagacaatatcctgctggatgaacacggacatgttcacattacagacttcaacatagcgacggtagtgaaaggagcagaaagggcttcctccatggctggcaccaagccctacatggaggccgtacgaaatccactcggtcacgcccatcgatgaaatcctcaacatgttcaaggtggagcgtgtccactactcctccacgtggtgcaaggggatggtggccctgctgaggaagctcctgaccaaggatcctgagagccgcgtgtccagccttcatgacatacagagcgtgccctacttggccgacatgaactgggacgcggtgttcaagaaggcactgatgcccggctttgtgcccaataaagggaggttgaactgcgatcccacatttgagcttgaagagatgattctagaatccaagccacttcacaaaaagaagaagcgattggcaaagaacagatccagggatggcacaaaggacagctgcccgctgaatggacacctgcagcactgtttggagactgtccgggaggaattcatcatattcaacagagagaa

SEQ ID NO: 20857 - DNA, 973 bp, Homo sapiens
  ENST00000511959
aactacatgctaatccctttgaatctggagctgacttagtcatgtttctgccttcagagagctacccagtgggggagatggacatgcaggggatgaggcaccagagagaacacaacactctctgccctcaaggagcttggagtcaagagaaaagggagacaactaagcaaaaatgcatgaggagatgaagagcatgggggaaatgaggaagcccctgtctagcctgggcaggagggagatggtaaggaagtgataatagcagaggcctattctgaggagtccactgtacctgtgaagagccttgtctggcacatgctccagaagtattccaggtgtacatggacagaggccccggatactcgtaccctgtcgactggtggtccctgggcatcacagcctatgagctgctgcggggctgggtaagacaggcacctgtgcggtacacacgaggggctgtgcagtgggggctcacgttgtacctggacgggcagagtcggcagggcccgcggtgcaggaaggagcactgggggagtcactgccccccaggtttcagtcctgatgcctgtgtgccgcctatgaacgccctgaacttctggtccaacccactcattgtacagatgggaaagaggcattcagtgggggagggtcttacacaaaggcccacagcggatcagtgacaagtcaaacatcaaagcgccttggcctcgtggtttcaaacactgtcctctttgaacccacaacacaaggtcttcatgtctgattttctagctgattggaaaatctttaaaggtgaagaccatgcttcttttttctctttgtttcacatcttccctgaatatctaactcagtgtcctataaaaatgggacattcaatcaatacgtatttgtattttattgcatttaaatttacaagctgaagatgattaatggggctatttggtggctgtaataacacatttttttgtttgagcag

SEQ ID NO: 20858 - DNA, 877 bp, Homo sapiens
  ENST00000508728
gttctaccatcagctccaagtgtgtgggggaggagggaatgtcaccttctctaggactgcagacatttgtcgcttgtctgatcatgacagccaggacaggatcactctgctgctgcttctaccctgagttctgaatggacttggggctgccaggcatgacaagctccagaagtattccaggtgtacatggacagaggccccggatactcgtaccctgtcgactggtggtccctgggcatcacagcctatgagctgctgcggggctggaggccgtacgaaatccactcggtcacgcccatcgatgaaatcctcaacatgttcaaggtggagcgtgtccactactcctccacgtggtgcaaggggatggtggccctgctgaggaagctcctgaccaaggatcctgagagccgcgtgtccagccttcatgacatacagagcgtgccctacttggccgacatgaactgggacgcggtgttcaagaaggcactgatgcccggctttgtgcccaataaagggaggttgaactgcgatcccacatttgagcttgaagagatgattctagaatccaagccacttcacaaaaagaagaagcgattggcaaagaacagatccagggatggcacaaaggacagctgcccgctgaatggacacctgcagcactgtttggagactgtccgggaggaattcatcatattcaacagagagaagctcaggaggcagcagggacagggcagccagctcttggacaccgacagccgagggggaggccaggcccaaagcaagctccaggacgggtgcaacaacaacctcctcacccacacctgcacccgtggctgcagcagctgagcccacacttgttgctgctcaacaggactgc

SEQ ID NO: 20859 - DNA, 1325 bp, Homo sapiens
  ENST00000473980
gtgactgattttggcttagcggtgaagaagcaaagtaggagtgaagccatgctgcaggccacatgtgggactcctatctatatggattacgtggagaaccaccctttttggcaagctcagaagagaagctttttgagttaataagaaaaggagaactacattttgaaaatgcagtctggaattccataagtgactgtgctaaaagtgttttgaaacaacttatgaaagtagatcctgctcacagaatcacagctaaggaactactagataaccagtggttaacaggcaataaactttcttcggtgagaccaaccaatgtattagagatgatgaaggaatggaaaaataacccagaaagtgttgaggaaaacacaacagaagagaagaataagccgtccactgaagaaaagttgaaaagttaccaaccctggggaaatgtccctgatgccaattacacttcagatgaagaggaggaaaaacagtctactgcttatgaaaagcaatttcctgcaaccagtaaggacaactttgatatgtgcagttcaagtttcacatctagcaaactccttccagctgaaatcaagggagaaatggagaaaacccctgtgactccaagccaaggaacagcaaccaagtaccctgctaaatccggcgccctgtccagaaccaaaaagaaactctaaggttccctccagtgttggacagtacaaaaacaaagctgctcttgttagcactttgatgagggggtaggaggggaagaagacagccctatgctgagcttgtagccttttagctccacagagccccgccatgtgtttgcaccagcttaaaattgaagctgcttatctccaaagcagcataagctgcacatggcattaaaggacagccaccagtaggcttggcagtgggctgcagtggaaatcaactcaagatgtacacgaaggttttttaggggggcagataccttcaatttaaggctgtgggcacacttgctcatttttacttcaaattcttatgtttaggcacagctatttataggggaaaacaagaggccaaatatagtaatggaggtgccaaataattatgtgcactttgcactagaagactttgttagaaaattactaataaacttgccatacgtattacagcagaagtgcttcagtcattcacatgtgttcgtgagattttaggttgctatagattgtttaagacagcttattttaaatgtagaaaaataggagattttgtaactgcttgccattaacttgctgctaaattcccaatgtattgattaaatcaataaaaaacagatgttactcagcaca

SEQ ID NO: 20860 - DNA, 4677 bp, Homo sapiens
  ENST00000486305
ttggaactgggtaatagacagaggttggaacagtttggagggctcagaacaagacaggaaaatgtgggacagtttggagctccctagagacttgttgaatgtctttgaacaaaatgctgataatgatatggatgatgaaattcaggctgaggtgctttcagatggagatgaggaacttcttgggaactggagcaaaggtgactcttgttacgttttactaaagcaactggcagcattttgcccctgccttagagatttgtggaactttaaacttgagagagatgatttagggtatctggtggaagaaatttctaagcagcaaagcattcaagaggcaacttgggtgctgttaaaggcattcagttttataagggaagcagagcataaaaatttggaaaatttgcagcctgacaatgcaatagaaaagaaaatcccattttctgaggagaaattcaagctggctgcagaaatttgcataagcaaccaggaggcaaatgttaatccccaagacaatgagaaaaatgtctccagggcatgtcagaggtcttcacagcagcccctcccattacccagagtactaggaggaaaaagtggtttcgtgggctgggcccaggattctcatgctgtgtgcagtctagagacttggtgccctgcatcctagccactccagccatggctgaaagggcccaacatagagctcgggccatggcctcagagggtgcaagcctcaagccttggctgctttaatgtggtgttgagtctgcgagtgcacagaagtgaagaattagggtttgggaacctccacatagatttcagaagatatatggaaacgcctggatgcgcaggcagtagtttgctgcaggggcaggatcttcagggagaacctcttctagggcagtgcagaagggaaatatggggtgggagcccccacacagagtccctactggggcactgcctagtggaactgtgagaagagggccaccattctccagaccctagaatagtagatccaccgacagcttgcaccatgcacctggaaaggccacagacacttaatgtcagcctgtgaaagcagccaggagggaggctgtaccttgcaaagctacagggacagagctgcccaagactatgggaacctacctcttgcatcagcgtgacctggatgtgagacatggagtcaaaggaggtcattttggagctttaagatttgactgccccactggattttggacttgcattgggcctgtagcctttttgttttggccaatttctcccatttgtaatggctatatttacccaatgcctatacccccattgtatctaggaagtaactaacttgcttttgattttacgggctcataggcagaagggacttaccttgtctcagatgtggacttttgagttaatgctgaaatgagttgagactttgggggactgttgggaaggcatgattggttttgaaatgtgaacatatgtgatttgggaagggccagagttggaatgatatggtttggctctatgtccccacccaaatttcaccttgtagctcccataattcccatgtgtcatgggagggaaccactgggagatgattgaatcagaagggtgggtcttttccatgttgttctaatgatagtgaatgggtctcacgagatctgatggttttaaaaacaggagtttctgtgtacaagccctctctttgcctgcttccatccatgtaagatgtgacatgctcctccttgccttctgacatgattgtgaagcttccccagtcatgtggaactgtaaatccaataaacctctttcttttgtaaattgcccagtctcagatatgtctttatcagcagcgtgaaaacggactaatacacatggtgaatgtgaaagtgatcacacatacagagagagagagagtggcattttgagagtggcatttctatggaaggctttgactagctgacccaaccagggcattacctagtggcattagttcagctgctctcccatgttctggttcctatgcacgatgggtccagaaactcttgttaattccctggagttgatttggatcagggagactgactcccccaaaaccaaattgataagaaatgaaggtgtaaatgagtttagctgtttattatttacaatgcaaaccaaaatggtgatgttggcaaaaccaatgtattctttctttataagcagaagttaaatgataagaggatggattcttggtttggatgatggttttatgggtagtggttatttttttctcagtgctgatctgtgttgaaatttttgtcacatattgcttttttttttttaaagcaaaaggaatcaaaagtgatttttcataagatacaggaaaagcattagttgttaaataaagaaacatttgttcagtagttactatgtgtcgattttgtagtatagctctcagaaatttgggatgttttggggtgaatgtattttatatctacacacacttatgtgtgtgtatatatataaatcatttctcctttttcttatgaagatatttcattaatatattatagtttgaaagagattcatttttatacttttgagtttttccacatttcaccattaggatttttatggttttcctccaaaggacacttaataaaattcatcaacgcttattttggttaattaagatgtgtttattaatattgaagcaaatatatagtgtcttctatttgattttaacttggagcagaatctcttttcccttgggtgagtatctgtcagtattatatgttcatttttaatagctgatgaatggcatagagagacaactctttttttttttttctccaggaaatctatacctttggaagaatattgggaaaagggagctttggaatagtcattgaagcgacagacaaggaaacagaaacgaagtgggcaattaaaaaagtgaacaaagaaaaggctggaagctctgctgtgaagttacttgaacgagaggtgaacattctgaaaagtgtaaaacatgaacacatcatacatctggaacaagtatttgaaacgccaaagaaaatgtaccttgtgatggagctttgtgaggatggagaactcaaagaaattctggataggaaagggcatttctcagagaatgagacaaggtggatcattcaaagtctcgcatcagctatagcatatcttcacaataatgatattgtacatagagatctgaaactggaaaatataatggttaaaagcagtcttattgatgataacaatgaaataaacttaaacataaaggtgactgattttggcttagcggtgaagaagcaaagtaggagtgaagccatgctgcaggccacatgtgggactcctatctatatggcccctgaagttatcagtgcccacgactatagccagcagtgtgacatttggagcataggcgtcgtaatgtacatgttattacgtggagaaccaccctttttggcaagctcagaagagaagctttttgagttaataagaaaaggagaactacattttgaaaatgcagtctggaattccataagtgactgtgctaaaagtgttttgaaacaacttatgaaagtagatcctgctcacagaatcacagctaaggaactactagataaccagtggttaacaggcaataaactttcttcggtgagaccaaccaatgtattagagatgatgaaggaatggaaaaataacccagaaagtgttgaggaaaacacaacagaagagaagaataagccgtccactgaagaaaagttgaaaagttaccaaccctggggaaatgtccctgatgccaattacacttcagatgaagaggaggaaaaacagtctactgcttatgaaaagcaatttcctgcaaccagtaaggacaactttgatatgtgcagttcaagtttcacatctagcaaactccttccagctgaaatcaagggagaaatggagaaaacccctgtgactccaagccaaggaacagcaaccaagtaccctgctaaatccggcgccctgtccagaaccaaaaagaaactctaaggttccctccagtgttggacagtacaaaaacaaagctgctcttgttagcactttgatgagggggtaggaggggaagaagacagccctatgctgagcttgtagccttttagctccacagagccccgccatgtgtttgcaccagcttaaaattgaagctgcttatctccaaagcagcataagctgcacatggcattaaaggacagccaccagtaggcttggcagtgggctgcagtggaaatcaactcaagatgtacacgaaggttttttaggggggcagataccttcaatttaaggctgtgggcacacttgctcatttttacttcaaattcttatgtttaggcacagctatttataggggaaaacaagaggccaaatatagtaatggaggtgccaaataattatgtgcactttgcactagaagactttgttagaaaattactaataaacttgccatacgtattacagcagaagtgcttcagtcattcacatgtgttcgtgagattttaggttgctatagattgtttaagacagcttattttaaatgtagaaaaataggagattttgtaactgcttgccattaacttgctgctaaattcccaatgtattgattaaatcaataaaaaacagatgttactcagc

SEQ ID NO: 20861 - DNA, 3103 bp, Homo sapiens
  ENST00000447869
atgtactcccaattacttctggaagtttctcaaagtactcctttatatgtactgcagagtgtatttttcttcctcctcaactgagatctttccaacttgccaccatgcagctgccaatggtcctagttaagtaaaatgctgccatacctattttagactcagggaaaaatagcacccactcatttttatttttgctcaatataaaaatgaggatacttatgaggatacttaaacttttaggattagctagttttctaaaaatcgaattattcactcctttgtaaagtatgtaataggaatttgctctaataatcaatagattaaggtttaaaatttgaaaccatagtaatgtatgtttaacaccaatattttaagcctttttaaaaaccacaacccacattaagaaatacatttcatactgtgatcaagtacacacgcacacacacactctatacatatatgtctgtccaattaaaagtttcacagaaatttccaaggaggtatgctaaatattatctctttgattctactttatttttaaaaagtggtatcaacccacaaaatggatttcataacccactacgcagtttgataagatgctgttttagaccatgcttttcaccagttttgtggtcctattttgtccttttcatgtctatacaggatgcttctagtgctagttgctagcttttctctgatttccaggatggtaataggttaagaatttctctaaatggttatttcttttctttctgcagctctcacgtgtgaatatgtgtctagtgcatccttaacctgaggacttcaccagttcgaaattacagttttcaccatcaactaccttatcctttttggcctggttttcttcctcaaacagtggaaacatttttaaagttgcttttgttgcagagttaaacaaatggctgatagtggcttagataaaaaatccacaaaatgccccgactgttcatctgcttctcagaaagatgtactttgtgtatgttccagcaaaacaagggttcctccagttttggtggtggaaatgtcacagacatcaagcattggtagtgcagaatctttaatttcactggagagaaaaaaagaaaaaaatatcaacagagatataacctccaggaaagatttgccctcaagaacctcaaatgtagagagaaaagcatctcagcaacaatggggtcggggcaactttacagaaggaaaagttcctcacataaggattgagaatggagctgctattgaggaaatctatacctttggaagaatattgggaaaagggagctttggaatagtcattgaagcgacagacaaggaaacagaaacgaagtgggcaattaaaaaagtgaacaaagaaaaggctggaagctctgctgtgaagttacttgaacgagaggtgaacattctgaaaagtgtaaaacatgaacacatcatacatctggaacaagtatttgaaacgccaaagaaaatgtaccttgtgatggagctttgtgaggatggagaactcaaagaaattctggataggaaagggcatttctcagagaatgagacaaggtggatcattcaaagtctcgcatcagctatagcatatcttcacaataatgatattgtacatagagatctgaaactggaaaatataatggttaaaagcagtcttattgatgataacaatgaaataaacttaaacataaaggtgactgattttggcttagcggtgaagaagcaaagtaggagtgaagccatgctgcaggccacatgtgggactcctatctatatggcccctgaagttatcagtgcccacgactatagccagcagtgtgacatttggagcataggcgtcgtaatgtacatgttattacgtggagaaccaccctttttggcaagctcagaagagaagctttttgagttaataagaaaaggagaactacattttgaaaatgcagtctggaattccataagtgactgtgctaaaagtgttttgaaacaacttatgaaagtagatcctgctcacagaatcacagctaaggaactactagataaccagtggttaacaggcaataaactttcttcggtgagaccaaccaatgtattagagatgatgaaggaatggaaaaataacccagaaagtgttgaggaaaacacaacagaagagaagaataagccgtccactgaagaaaagttgaaaagttaccaaccctggggaaatgtccctgatgccaattacacttcagatgaagaggaggaaaaacagtctactgcttatgaaaagcaatttcctgcaaccagtaaggacaactttgatatgtgcagttcaagtttcacatctagcaaactccttccagctgaaatcaagggagaaatggagaaaacccctgtgactccaagccaaggaacagcaaccaagtaccctgctaaatccggcgccctgtccagaaccaaaaagaaactctaaggttccctccagtgttggacagtacaaaaacaaagctgctcttgttagcactttgatgagggggtaggaggggaagaagacagccctatgctgagcttgtagccttttagctccacagagccccgccatgtgtttgcaccagcttaaaattgaagctgcttatctccaaagcagcataagctgcacatggcattaaaggacagccaccagtaggcttggcagtgggctgcagtggaaatcaactcaagatgtacacgaaggttttttaggggggcagataccttcaatttaaggctgtgggcacacttgctcatttttacttcaaattcttatgtttaggcacagctatttataggggaaaacaagaggccaaatatagtaatggaggtgccaaataattatgtgcactttgcactagaagactttgttagaaaattactaataaacttgccatacgtattacagcagaagtgcttcagtcattcacatgtgttcgtgagattttaggttgctatagattgtttaagacagcttattttaaatgtagaaaaataggagattttgtaactgcttgccattaacttgctgctaaattcccaatgtattgattaaatcaataaaaaacagatgttactcagc

SEQ ID NO: 20862 - DNA, 2707 bp, Homo sapiens
  ENST00000315204
gccggccggctggtaaccccccagcggagggaccgggccgagcccgcggacccctccgagtgtctcctggggcccagccgttggtaccccatttcccccgggtccggtatttggggtggtctctgtctgccccggttcatctccaccgtctcaccttcaccccatcttgggacgtgaaactttttgaaagtttagaagcgaacttactgtggggaccttcctctggggttagttctctggtgccaccttcagtgatctgtgtggcagctctgctgctcacttctggctttactgggttttggtatttaactgttgcttacgcacactggaaattttcacctgcagtttttcttctgcctaagctctcacgtgtgaatatgtgtctagtgcatccttaacctgaggacttcaccagttcgaaattacagttttcaccatcaactaccttatcctttttggcctggttttcttcctcaaacagtggaaacatttttaaagttgcttttgttgcagagttaaacaaatggctgatagtggcttagataaaaaatccacaaaatgccccgactgttcatctgcttctcagaaagatgtactttgtgtatgttccagcaaaacaagggttcctccagttttggtggtggaaatgtcacagacatcaagcattggtagtgcagaatctttaatttcactggagagaaaaaaagaaaaaaatatcaacagagatataacctccaggaaagatttgccctcaagaacctcaaatgtagagagaaaagcatctcagcaacaatggggtcggggcaactttacagaaggaaaagttcctcacataaggattgagaatggagctgctattgaggaaatctatacctttggaagaatattgggaaaagggagctttggaatagtcattgaagcgacagacaaggaaacagaaacgaagtgggcaattaaaaaagtgaacaaagaaaaggctggaagctctgctgtgaagttacttgaacgagaggtgaacattctgaaaagtgtaaaacatgaacacatcatacatctggaacaagtatttgaaacgccaaagaaaatgtaccttgtgatggagctttgtgaggatggagaactcaaagaaattctggataggaaagggcatttctcagagaatgagacaaggtggatcattcaaagtctcgcatcagctatagcatatcttcacaataatgatattgtacatagagatctgaaactggaaaatataatggttaaaagcagtcttattgatgataacaatgaaataaacttaaacataaaggtgactgattttggcttagcggtgaagaagcaaagtaggagtgaagccatgctgcaggccacatgtgggactcctatctatatggcccctgaagttatcagtgcccacgactatagccagcagtgtgacatttggagcataggcgtcgtaatgtacatgttattacgtggagaaccaccctttttggcaagctcagaagagaagctttttgagttaataagaaaaggagaactacattttgaaaatgcagtctggaattccataagtgactgtgctaaaagtgttttgaaacaacttatgaaagtagatcctgctcacagaatcacagctaaggaactactagataaccagtggttaacaggcaataaactttcttcggtgagaccaaccaatgtattagagatgatgaaggaatggaaaaataacccagaaagtgttgaggaaaacacaacagaagagaagaataagccgtccactgaagaaaagttgaaaagttaccaaccctggggaaatgtccctgatgccaattacacttcagatgaagaggaggaaaaacagtctactgcttatgaaaagcaatttcctgcaaccagtaaggacaactttgatatgtgcagttcaagtttcacatctagcaaactccttccagctgaaatcaagggagaaatggagaaaacccctgtgactccaagccaaggaacagcaaccaagtaccctgctaaatccggcgccctgtccagaaccaaaaagaaactctaaggttccctccagtgttggacagtacaaaaacaaagctgctcttgttagcactttgatgagggggtaggaggggaagaagacagccctatgctgagcttgtagccttttagctccacagagccccgccatgtgtttgcaccagcttaaaattgaagctgcttatctccaaagcagcataagctgcacatggcattaaaggacagccaccagtaggcttggcagtgggctgcagtggaaatcaactcaagatgtacacgaaggttttttaggggggcagataccttcaatttaaggctgtgggcacacttgctcatttttacttcaaattcttatgtttaggcacagctatttataggggaaaacaagaggccaaatatagtaatggaggtgccaaataattatgtgcactttgcactagaagactttgttagaaaattactaataaacttgccatacgtattacagcagaagtgcttcagtcattcacatgtgttcgtgagattttaggttgctatagattgtttaagacagcttattttaaatgtagaaaaataggagattttgtaactgcttgccattaacttgctgctaaattcccaatgtattgattaaatcaataaaaaacagatgttactcagc

SEQ ID NO: 20863 - DNA, 2558 bp, Homo sapiens
  ENST00000396672
gccggccggctggtaaccccccagcggagggaccgggccgagcccgcggacccctccgagtgtctcctggggcccagccgttggtaccccatttcccccgggtccggtatttggggtggtctctgtctgccccggttcatctccaccgtctcaccttcaccccatcttgggacgtgaaactttttgaaagtttagaagcgaacttactgtgggctctcacgtgtgaatatgtgtctagtgcatccttaacctgaggacttcaccagttcgaaattacagttttcaccatcaactaccttatcctttttggcctggttttcttcctcaaacagtggaaacatttttaaagttgcttttgttgcagagttaaacaaatggctgatagtggcttagataaaaaatccacaaaatgccccgactgttcatctgcttctcagaaagatgtactttgtgtatgttccagcaaaacaagggttcctccagttttggtggtggaaatgtcacagacatcaagcattggtagtgcagaatctttaatttcactggagagaaaaaaagaaaaaaatatcaacagagatataacctccaggaaagatttgccctcaagaacctcaaatgtagagagaaaagcatctcagcaacaatggggtcggggcaactttacagaaggaaaagttcctcacataaggattgagaatggagctgctattgaggaaatctatacctttggaagaatattgggaaaagggagctttggaatagtcattgaagcgacagacaaggaaacagaaacgaagtgggcaattaaaaaagtgaacaaagaaaaggctggaagctctgctgtgaagttacttgaacgagaggtgaacattctgaaaagtgtaaaacatgaacacatcatacatctggaacaagtatttgaaacgccaaagaaaatgtaccttgtgatggagctttgtgaggatggagaactcaaagaaattctggataggaaagggcatttctcagagaatgagacaaggtggatcattcaaagtctcgcatcagctatagcatatcttcacaataatgatattgtacatagagatctgaaactggaaaatataatggttaaaagcagtcttattgatgataacaatgaaataaacttaaacataaaggtgactgattttggcttagcggtgaagaagcaaagtaggagtgaagccatgctgcaggccacatgtgggactcctatctatatggcccctgaagttatcagtgcccacgactatagccagcagtgtgacatttggagcataggcgtcgtaatgtacatgttattacgtggagaaccaccctttttggcaagctcagaagagaagctttttgagttaataagaaaaggagaactacattttgaaaatgcagtctggaattccataagtgactgtgctaaaagtgttttgaaacaacttatgaaagtagatcctgctcacagaatcacagctaaggaactactagataaccagtggttaacaggcaataaactttcttcggtgagaccaaccaatgtattagagatgatgaaggaatggaaaaataacccagaaagtgttgaggaaaacacaacagaagagaagaataagccgtccactgaagaaaagttgaaaagttaccaaccctggggaaatgtccctgatgccaattacacttcagatgaagaggaggaaaaacagtctactgcttatgaaaagcaatttcctgcaaccagtaaggacaactttgatatgtgcagttcaagtttcacatctagcaaactccttccagctgaaatcaagggagaaatggagaaaacccctgtgactccaagccaaggaacagcaaccaagtaccctgctaaatccggcgccctgtccagaaccaaaaagaaactctaaggttccctccagtgttggacagtacaaaaacaaagctgctcttgttagcactttgatgagggggtaggaggggaagaagacagccctatgctgagcttgtagccttttagctccacagagccccgccatgtgtttgcaccagcttaaaattgaagctgcttatctccaaagcagcataagctgcacatggcattaaaggacagccaccagtaggcttggcagtgggctgcagtggaaatcaactcaagatgtacacgaaggttttttaggggggcagataccttcaatttaaggctgtgggcacacttgctcatttttacttcaaattcttatgtttaggcacagctatttataggggaaaacaagaggccaaatatagtaatggaggtgccaaataattatgtgcactttgcactagaagactttgttagaaaattactaataaacttgccatacgtattacagcagaagtgcttcagtcattcacatgtgttcgtgagattttaggttgctatagattgtttaagacagcttattttaaatgtagaaaaataggagattttgtaactgcttgccattaacttgctgctaaattcccaatgtattgattaaatcaataaaaaacagatgttactcagc

SEQ ID NO: 20864 - DNA, 1991 bp, Homo sapiens
  ENST00000358872
gctgtttgtcctcgcgcggcccccgtccactgccctgcggttgctctgcgggctgaaaagtttctcccggtgcagaattccgggctcagcgacagcctgcgccgagtgtgcgcacctgtcggagacccgccagtccgccggccgcggaaatctatacctttggaagaatattgggaaaagggagctttggaatagtcattgaagcgacagacaaggaaacagaaacgaagtgggcaattaaaaaagtgaacaaagaaaaggctggaagctctgctgtgaagttacttgaacgagaggtgaacattctgaaaagtgtaaaacatgaacacatcatacatctggaacaagtatttgaaacgccaaagaaaatgtaccttgtgatggagctttgtgaggatggagaactcaaagaaattctggataggaaagggcatttctcagagaatgagacaaggtggatcattcaaagtctcgcatcagctatagcatatcttcacaataatgatattgtacatagagatctgaaactggaaaatataatggttaaaagcagtcttattgatgataacaatgaaataaacttaaacataaaggtgactgattttggcttagcggtgaagaagcaaagtaggagtgaagccatgctgcaggccacatgtgggactcctatctatatggcccctgaagttatcagtgcccacgactatagccagcagtgtgacatttggagcataggcgtcgtaatgtacatgttattacgtggagaaccaccctttttggcaagctcagaagagaagctttttgagttaataagaaaaggagaactacattttgaaaatgcagtctggaattccataagtgactgtgctaaaagtgttttgaaacaacttatgaaagtagatcctgctcacagaatcacagctaaggaactactagataaccagtggttaacaggcaataaactttcttcggtgagaccaaccaatgtattagagatgatgaaggaatggaaaaataacccagaaagtgttgaggaaaacacaacagaagagaagaataagccgtccactgaagaaaagttgaaaagttaccaaccctggggaaatgtccctgatgccaattacacttcagatgaagaggaggaaaaacagtctactgcttatgaaaagcaatttcctgcaaccagtaaggacaactttgatatgtgcagttcaagtttcacatctagcaaactccttccagctgaaatcaagggagaaatggagaaaacccctgtgactccaagccaaggaacagcaaccaagtaccctgctaaatccggcgccctgtccagaaccaaaaagaaactctaaggttccctccagtgttggacagtacaaaaacaaagctgctcttgttagcactttgatgagggggtaggaggggaagaagacagccctatgctgagcttgtagccttttagctccacagagccccgccatgtgtttgcaccagcttaaaattgaagctgcttatctccaaagcagcataagctgcacatggcattaaaggacagccaccagtaggcttggcagtgggctgcagtggaaatcaactcaagatgtacacgaaggttttttaggggggcagataccttcaatttaaggctgtgggcacacttgctcatttttacttcaaattcttatgtttaggcacagctatttataggggaaaacaagaggccaaatatagtaatggaggtgccaaataattatgtgcactttgcactagaagactttgttagaaaattactaataaacttgccatacgtattacagcagaagtgcttcagtcattcacatgtgttcgtgagattttaggttgctatagattgtttaagacagcttattttaaatgtagaaaaataggagattttgtaactgcttgccattaacttgctgctaaattcccaatgtattgattaaatcaataaaaaacagatgttactcagc

SEQ ID NO: 20865 - DNA, 1243 bp, Homo sapiens
  ENST00000444064
gttaaaagcagtcttattgatgataacaatgaaataaacttaaacataaaggtgactgattttggcttagcggtgaagaagcaaagtaggagtgaagccatgctgcaggccacatgtgggactcctatctatatggcccctgaagttatcagtgcccacgactatagccagcagtgtgacatttggagcataggcgtcgtaatgtacatgttattacgtggagaaccaccctttttggcaagctcagaagagaagctttttgagttaataagaaaaggagaactacattttgaaaatgcagtctggaattccataagtgactgtgctaaaagtgttttgaaacaacttatgaaagtagatcctgctcacagaatcacagctaaggaactactagataaccagtggttaacatctactgcttatgaaaagcaatttcctgcaaccagtaaggacaactttgatatgtgcagttcaagtttcacatctagcaaactccttccagctgaaatcaagggagaaatggagaaaacccctgtgactccaagccaaggaacagcaaccaagtaccctgctaaatccggcgccctgtccagaaccaaaaagaaactctaaggttccctccagtgttggacagtacaaaaacaaagctgctcttgttagcactttgatgagggggtaggaggggaagaagacagccctatgctgagcttgtagccttttagctccacagagccccgccatgtgtttgcaccagcttaaaattgaagctgcttatctccaaagcagcataagctgcacatggcattaaaggacagccaccagtaggcttggcagtgggctgcagtggaaatcaactcaagatgtacacgaaggttttttaggggggcagataccttcaatttaaggctgtgggcacacttgctcatttttacttcaaattcttatgtttaggcacagctatttataggggaaaacaagaggccaaatatagtaatggaggtgccaaataattatgtgcactttgcactagaagactttgttagaaaattactaataaacttgccatacgtattacagcagaagtgcttcagtcattcacatgtgttcgtgagattttaggttgctatagattgtttaagacagcttattttaaatgtagaaaaataggagattttgtaactgcttgccattaacttgctgctaaattcccaatgtattgattaaatcaataaaaaacagatgt

SEQ ID NO: 20866 - DNA, 1895 bp, Homo sapiens
  ENST00000534493
agaattccgggctcagcgacagcctgcgccgagtgtgcgcacctgtcggagacccgccagtccgccggccgcgatggggagccagataaacgttacataactagaaagtggcagagcaaaacaagggttcctccagttttggtggtggaaatgtcacagacatcaagcattggtagtgcagaatctttaatttcactggagagaaaaaaagaaaaaaatatcaacagagatataacctccaggaaagatttgccctcaagaacctcaaatgtagagagaaaagcatctcagcaacaatggggtcggggcaactttacagaaggaaaagttcctcacataaggattgagaatggagctgctattgaggaaatctatacctttggaagaatattgggaaaagggagctttggaatagtcattgaagcgacagacaaggaaacagaaacgaagtgggcaattaaaaaagtgaacaaagaaaaggctggaagctctgctgtgaagttacttgaacgagaggtgaacattctgaaaagtgtaaaacatgaacacatcatacatctggaacaagtatttgaaacgccaaagaaaatgtaccttgtgatggagctttgtgaggatggagaactcaaagaaattctggataggaaagggcatttctcagagaatgagacaaggtggatcattcaaagtctcgcatcagctatagcatatcttcacaataatgatattgtacatagagatctgaaactggaaaatataatggttaaaagcagtcttattgatgataacaatgaaataaacttaaacataaaggtgactgattttggcttagcggtgaagaagcaaagtaggagtgaagccatgctgcaggccacatgtgggactcctatctatatggcccctgaagttatcagtgcccacgactatagccagcagtgtgacatttggagcataggcgtcgtaatgtacatgttattacgtggagaaccaccctttttggcaagctcagaagagaagctttttgagttaataagaaaaggagaactacattttgaaaatgcagtctggaattccataagtgactgtgctaaaagtgttttgaaacaacttatgaaagtagatcctgctcacagaatcacagctaaggaactactagataaccagtggttaacaggcaataaactttcttcggtgagaccaaccaatgtattagagatgatgaaggaatggaaaaataacccagaaagtgttgaggaaaacacaacagaagagaagaataagccgtccactgaagaaaagttgaaaagttaccaaccctggggaaatgtccctgatgccaattacacttcagatgaagaggaggaaaaacagtctactgcttatgaaaagcaatttcctgcaaccagtaaggacaactttgatatgtgcagttcaagtttcacatctagcaaactccttccagctgaaatcaagggagaaatggagaaaacccctgtgactccaagccaaggaacagcaaccaagtaccctgctaaatccggcgccctgtccagaaccaaaaagaaactctaaggttccctccagtgttggacagtacaaaaacaaagctgctcttgttagcactttgatgagggggtaggaggggaagaagacagccctatgctgagcttgtagccttttagctccacagagccccgccatgtgtttgcaccagcttaaaattgaagctgcttatctccaaagcagcataagctgcacatggcattaaaggacagccaccagtaggcttggcagtgggctgcagtggaaatcaactcaagatgtacacgaaggttttttaggggggcagataccttcaatttaaggctgtgggcacacttgctcatttttacttc

SEQ ID NO: 20867 - DNA, 921 bp, Homo sapiens
  ENST00000526517
ggcttggagaaggggctttgcacccgccgccgctgtttgtcctcgcgcggcccccgtccactgccctgcggttgctctgcgggctgaaaagtttctcccggtgcagaattccgggctcagcgacagcctgcgccgagtgtgcgcacctgtcggagacccgccagtccgccggccgcggtgactgattttggcttagcggtgaagaagcaaagtaggagtgaagccatgctgcaggccacatgtgggactcctatctatatggcccctgaagttatcagtgcccacgactatagccagcagtgtgacatttggagcataggcgtcgtaatgtacatgttattacgtggagaaccaccctttttggcaagctcagaagagaagctttttgagttaataagaaaaggagaactacattttgaaaatgcagtctggaattccataagtgactgtgctaaaagtgttttgaaacaacttatgaaagtagatcctgctcacagaatcacagctaaggaactactagataaccagtggttaacaacggagtctcgctctgtcaccaggctggagtgcagtgacacaatctcggctcactgcaacctctgcctcctgggttcaagtcaactgcaacctctgcctcctgggttcaagtgattctcctgcctcagcctcctgagggactaaaggcatgcaccaccatgcccagcaattttttgtatttttagtagacacagaatttcaccatattggccaggatggtctcgatctcttggcctcatcatctgcccggctcggcctcccaaagtgctgggattacaggtgtgagccaccatgcccggccgataatattcttaaaagatcactctgactattggggtgggggggagtggcttggaaatagggaattagatagatgttgaagta

SEQ ID NO: 20868 - DNA, 635 bp, Homo sapiens
  ENST00000524760
gcagaatctttaatttcactggagagaaaaaaagaaaaaaatatcaacagagatataacctccaggaaagatttgccctcaagaacctcaaatgtagagagaaaagcatctcagcaacaatggggtcggggcaactttacagaaggaaaagttcctcacataaggattgagaatggagctgctattgaggctggaagctctgctgtgaagttacttgaacgagaggtgaacattctgaaaagtgtaaaacatgaacacatcatacatctggaacaagtatttgaaacgccaaagaaaatgtaccttgtgatggagctttgtgaggatggagaactcaaagaaattctggataggaaagggcatttctcagagaatgagacaaggtggatcattcaaagtctcgcatcagctatagcatatcttcacaataatgatattgtacatagagatctgaaactggaaaatataatggttaaaagcagtcttattgatgataacaatgaaataaacttaaacataaaggtgactgattttggcttagcggtgaagaagcaaagtaggagtgaagccatgctgcaggccacatgtgggactcctatctatatggcccctgaagttatcagtgcccacgacta

SEQ ID NO: 20869 - DNA, 946 bp, Homo sapiens
  ENST00000418597
aggccgttgctatggcaacgcggtggaaaaacgggcctctgggtatctcgctgccggccggctggtaaccccccagcggagggaccgggccgagcccgcggacccctccgagtgtctcctggggcccagccgttggtaccccatttcccccgggtccggtatttggggtggtctctgtctgccccggttcatctccaccgtctcaccttcaccccatcttgggacgtgaaactttttgaaagtttagaagcgaacttactgtgggcaaaacaagggttcctccagttttggtggtggaaatgtcacagacatcaagcattggtagtgcagaatctttaatttcactggagagaaaaaaagaaaaaaatatcaacagagatataacctccaggaaagatttgccctcaagaacctcaaatgtagagagaaaagcatctcagcaacaatggggtcggggcaactttacagaaggaaaagttcctcacataaggattgagaatggagctgctattgaggaaatctatacctttggaagaatattgggaaaagggagctttggaatagtcattgaagcgacagacaaggaaacagaaacgaagtgggcaattaaaaaagtgaacaaagaaaaggctggaagctctgctgtgaagttacttgaacgagaggtgaacattctgaaaagtgtaaaacatgaacacatcatacatctggaacaagtatttgaaacgccaaagaaaatgtaccttgtgatggagctttgtgaggatggagaactcaaagaaattctggataggaaagggcatttctcagagaatgagacaaggtggatcattcaaagtctcgcatcagctatagcatatcttcacaataatgatattgtacatagagatctgaaactggaaaatataatggttaaaagcagtcttattgatgataacaatgaaat

SEQ ID NO: 20870 - DNA, 767 bp, Homo sapiens
  ENST00000422559
ggtgcagaattccgggctcagcgacagcctgcgccgagtgtgcgcacctgtcggagacccgccagtccgccggccgcggcagggccactacttctcagcacatccggccttctggctcatctcctccctgcatctcactacgcccctccccactccaggcaaaacaagggttcctccagttttggtggtggaaatgtcacagacatcaagcattggtagtgcagaatctttaatttcactggagagaaaaaaagaaaaaaatatcaacagagatataacctccaggaaagatttgccctcaagaacctcaaatgtagagagaaaagcatctcagcaacaatggggtcggggcaactttacagaaggaaaagttcctcacataaggattgagaatggagctgctattgaggaaatctatacctttggaagaatattgggaaaagggagctttggaatagtcattgaagcgacagacaaggaaacagaaacgaagtgggcaattaaaaaagtgaacaaagaaaaggctggaagctctgctgtgaagttacttgaacgagaggtgaacattctgaaaagtgtaaaacatgaacacatcatacatctggaacaagtatttgaaacgccaaagaaaatgtaccttgtgatggagctttgtgaggatggagaactcaaagaaattctggataggaaagggcatttctcagagaatgagacaaggtggatcattcaaagtctcgcatcagctatagcatatcttcacaataatg

SEQ ID NO: 20871 - DNA, 709 bp, Homo sapiens
  ENST00000457885
gcctgaagttaaatcattttggaaagtgatacagctctcacgtgtgaatatgtgtctagtgcatccttaacctgaggacttcaccagttcgaaattacagttttcaccatcaactaccttatcctttttggcctggttttcttcctcaaacagtggaaacatttttaaagttgcttttgttgcagagttaaacaaatggctgatagtggcttagataaaaaatccacaaaatgccccgactgttcatctgcttctcagaaagatgtactttgtgtatgttccagcaaaacaagggttcctccagttttggtggtggaaatgtcacagacatcaagcattggtagtgcagaatctttaatttcactggagagaaaaaaagaaaaaaatatcaacagagatataacctccaggaaagatttgccctcaagaacctcaaatgtagagagaaaagcatctcagcaacaatggggtcggggcaactttacagaaggaaaagttcctcacataaggattgagaatggagctgctattgaggaaatctatacctttggaagaatattgggaaaagggagctttggaatagtcattgaagcgacagacaaggaaacagaaacgaagtgggcaattaaaaaagtgaacaaagaaaaggctggaagctctgctgtgaagttacttgaacgagaggtgaacattctgaaaagtgtaaaac

SEQ ID NO: 20872 - DNA, 808 bp, Homo sapiens
  ENST00000532336
tggaaaaacgggcctctgggtatctcgctgccggccggctggtaaccccccagcggagggaccgggccgagcccgcggacccctccgagtgtctcctggggcccagccgttggtaccccatttcccccgggtccggtatttggggtggtctctgtctgccccggttcatctccaccgtctcaccttcaccccatcttgggacgtgaaactttttgaaagtttagaagcgaacttactgtgggaccaacttgcttccagattgcttacacctggggagacaataccaccatgaagatgacagataacccacgatgaagtgctaagttgtttgctatggtagtagctggaattcagaggggagagacttatggctaccagatccaagatagctctcacgtgtgaatatgtgtctagtgcatccttaacctgaggacttcaccagttcgaaattacagttttcaccatcaactaccttatcctttttggcctggttttcttcctcaaacagtggaaacatttttaaagttgcttttgttgcagagttaaacaaatggctgatagtggcttagataaaaaatccacaaaatgccccgactgttcatctgcttctcagaaagatgtactttgtgtatgttccagcaaaacaagggttcctccagttttggtggtggaaatgtcacagacatcaagcattggtagtgcagaatctttaatttcactggagagaaaaaaagaaaaaaatatcaacagagatataacctccaggaaagatttggtaaatatcaaagattccacatctaagcacaag

SEQ ID NO: 20873 - DNA, 758 bp, Homo sapiens
  ENST00000431279
tgggtatctcgctgccggccggctggtaaccccccagcggagggaccgggccgagcccgcggacccctccgagtgtctcctggggcccagccgttggtaccccatttcccccgggtccggtatttggggtggtctctgtctgccccggttcatctccaccgtctcaccttcaccccatcttgggacgtgaaactttttgaaagtttagaagcgaacttactgtggggcagggccactacttctcagcacatccggccttctggctcatctcctccctgcatctcactacgcccctccccactccagggcctgaagttaaatcattttggaaagtgatacaggagaggactctgctatgaaacttcctgagtgaaatgataagtggcatgaagaaaaacaaagcaagctctcacgtgtgaatatgtgtctagtgcatccttaacctgaggacttcaccagttcgaaattacagttttcaccatcaactaccttatcctttttggcctggttttcttcctcaaacagtggaaacatttttaaagttgcttttgttgcagagttaaacaaatggctgatagtggcttagataaaaaatccacaaaatgccccgactgttcatctgcttctcagaaagatgtactttgtgtatgttccagcaaaacaagggttcctccagttttggtggtggaaatgtcacagacatcaagcattggtagtgcagaatctttaatttcactggagagaaaaaaagaaaaaaa

SEQ ID NO: 20874 - DNA, 562 bp, Homo sapiens
  ENST00000454443
gtgcagccggcacctcccggccaaccccgcggcttggagaaggggctttgcacccgccgccgctgtttgtcctcgcgcggcccccgtccactgccctgcggttgctctgcgggctgaaaagtttctcccggtgcagaattccgggctcagcgacagcctgcgccgagtgtgcgcacctgtcggagacccgccagtccgccggccgcggcagggccactacttctcagcacatccggccttctggctcatctcctccctgcatctcactacgcccctccccactccaggctctcacgtgtgaatatgtgtctagtgcatccttaacctgaggacttcaccagttcgaaattacagttttcaccatcaactaccttatcctttttggcctggttttcttcctcaaacagtggaaacatttttaaagttgcttttgttgcagagttaaacaaatggctgatagtggcttagataaaaaatccacaaaatgccccgactgttcatctgcttctcagaaagatgtactttgtgtatgttccagcaaaacaagggttcctccagtttt

SEQ ID NO: 20875 - DNA, 582 bp, Homo sapiens
  ENST00000526360
acacaggagggatgggtcggcagagtttgtaagtttggatgggtaataacttaacccaggggattgttggtggaggaacgagggagtcctgtagctagagataggcagaagcagacaggatatttgggttctaggtaagcaaggtgcatctaagacctaagaagtcttcagaggcagcagagacgaacaaatgaacgtgaaggcagggccactacttctcagcacatccggccttctggctcatctcctccctgcatctcactacgcccctccccactccagggtaaattccaataatgctgctctgttccagatggagttcatgttgactgagctctcacgtgtgaatatgtgtctagtgcatccttaacctgaggacttcaccagttcgaaattacagttttcaccatcaactaccttatcctttttggcctggttttcttcctcaaacagtggaaacatttttaaagttgcttttgttgcagagttaaacaaatggctgatagtggcttagataaaaaatccacaaaatgccccgactgttcatctgcttctcagaaagatgtactttgtgtatgttcc

SEQ ID NO: 20876 - DNA, 545 bp, Homo sapiens
  ENST00000541191
acggcagtgaggtgaggctggtgagaggggaagtggcgacagttcagtcaactccctcaaaaccagtctggccttcaccaggcggagatgggtggggccgggaagacgggcgttgacgacagaaggctacttccggctgtgtttccgttactatggcaatgacggcagggactacaacaacctttcctatgagcaaccatacccgggaaagagtgactgtagccaagctcacattggagaatttttatagcaacctaattttacagcatgaagagagagaaaccaggcagaagaaattagaagtggccatggaagaagaaggattagcagatgaagagaaaaagttacgtcgatcacaacacgctcgcaaagaaacagagttcttacggctcaaaaggaccagacttggcttggatgactttgagtctctgaaagttataggaagaggagcttttggagaggtgcggttggtccagaagaaagatacaggccatatctatgcaatgaagatattgagaaagtctgatatgcttgaaaaagagcag

SEQ ID NO: 20877 - DNA, 5068 bp, Homo sapiens
  ENST00000389032
gagagttcagggaggccgccctgagattccggcgaggccgcgggtcccacctcccgggggcggggcgagggcggagcggggagaagggagctgacgggcgcccggccggctgcggtccgtgcggaggctgagccggccgcgggcgcgaccggaggcagtttccgttactatggcaatgacggcagggactacaacaacctttcctatgagcaaccatacccgggaaagagtgactgtagccaagctcacattggagaatttttatagcaacctaattttacagcatgaagagagagaaaccaggcagaagaaattagaagtggccatggaagaagaaggattagcagatgaagagaaaaagttacgtcgatcacaacacgctcgcaaagaaacagagttcttacggctcaaaaggaccagacttggcttggatgactttgagtctctgaaagttataggaagaggagcttttggagaggtgcggttggtccagaagaaagatacaggccatatctatgcaatgaagatattgagaaagtctgatatgcttgaaaaagagcaggtggcccatatccgagcagaaagagatattttggtagaagcagatggtgcctgggtggtgaagatgttttacagttttcaggataagaggaatctttatctaatcatggaatttctccctggaggtgacatgatgacattgctaatgaagaaagacaccttgacagaagaggaaacacagttctacatttcagagactgttctggcaatagatgcgatccaccagttgggtttcatccatcgggatattaagccagacaaccttttattggatgccaagggtcatgtaaaattatctgattttggtttatgtacgggattaaagaaagctcacaggactgaattttatagaaatctcacacacaacccaccaagtgacttctcatttcagaacatgaactcaaagaggaaagcagaaacttggaagaagaacaggagacaactggcatattccacagttgggacaccagattacattgctccagaagtattcatgcagactggttacaacaaattgtgtgactggtggtctttgggagtgattatgtatgaaatgctaataggatatccacctttctgctctgaaacacctcaagaaacgtacagaaaagtgatgaactggaaagaaactctggtatttcctccagaggtacctatatctgagaaagccaaggacttaattctcagattttgtattgattctgaaaacagaattggaaatagtggagtagaagaaataaaaggtcatcccttttttgaaggtgtcgactgggagcacataagggaaaggccagcagcaatccctatagaaatcaaaagcattgatgatacttcaaattttgatgacttccctgaatctgatattttacaaccagtgccaaataccacagaaccggactacaaatccaaagactgggtttttctcaattatacctataaaaggtttgaagggttgactcaacgtggctctatccccacctacatgaaagctgggaagttatgaatgaagataacattcacccataaccaagagaactcaggtagctgcatcaccaggcttgcttggcgtagataacaatacactgaaatactcctgaagatggtggtgcttattgactacaagaggaaattctacaggattaggatttctaagactactataggaattggttggcagtgccagctggctcttttttttaatattttattatttttgttaactttattatatgaaggtactggaataaaaggaacagacatccctttctaactgcactgcctacatgcgtattaaggtccattctgcctgtgtgtgctgtggctttgaactgtaacacctctaatcaattcaggagaaacacatatcatttaaagcaacataggctaacctgtaggtaacactgcagtattgatgttttactgcaaatcttatgggtctagataatcagtaaaagccatcttccatagttggtgttagaacattgccctattggtttggacatctgtagaatatatatgaagacaatttctgtaatggttttaagagatttaaaaagaaattcactggttctttacaaaatagaatttatcatcaagttattacacaaacttcacagtaaggagtgacaagtttataataaggaagacaaagtttaacaccttcactcaagcactccactaatatatttacgttgcattcagaaatactgatgaccttcatatacgtagtctgtatactcatagggagatgtactgtattatataacatgtaaagttgattttcttgtgacaagagaacttctttttttaacaagaggacatggcattattttaatttgattatggtgagttgaatttaagacatgaccatgaaggctgcttgtagaattagtgtatttttattaaactatttttttaaatgtcaaacttctatcatgtaaatggacttatagagaacaaaaagctatttactttggttttctagaaagttgttacatatcatggctggttaacttttatttcttttgatgaaaatttttcctttgatagtacttgtattattgtgccattattttcttatgctccaaatgtaccaaagatcttgaacagagtggatgttcacaactgagtagaattttcctttcctgtgggcatgctgtattcagacctgacagatctttgatagaggtcagcttattaaagggcaatattgttcttgtttagctacatcactgtggtgaatatagatggaattaaggaagtaaatgcaggccagggggttgtgatgagaggataggggagataatatcagcatcaaattctttgggtatctctctaagaattaaataatcttttctagcttaatattttaattctaattcaaacaactctgaggttttggtttcattagtaatagttgaggaataatatactagcaaagaatggcctaatgtttgtcataactgttaatggatgaaattttttaaagatacaaccatgataaccattataaatgatctatgatcaaaatctaaagtgatgaattatttgtaggaatgtcttcctaatggggaagaattgcataggagcattatgcaaatctacacaagcttttataaatgttgctgctgggtagctccacagtgtttcataaggccatcctgtttcccccaactcccccatttttggtttgtttctttttaaatatttgttgagtacttacgtgtttatctaacagttcacttccatttttctagtctggattttttgagtatttaggaaagagagctattaaaaactggggatttctcaatgtgactaactctaatttttctaattataactgcctttaattaacataatattaacttttgctgaggtttatgagattttctcaccccacatcgctcccctttttttaaaaaggactgttttgctagtgtgataatgaataggtaagatatgagataattgcaacattgtctagttctagtatggtaactattcttgaaatggtattgaaaaataccgttaattcaaattgacagagattgataaaaagaaactgatttacctaagtttactttttaattgcataatagagcattttttgttttgagttccctcattcttattaccagaaagagcttgcaaatagttttactttcttggcactggaagggtagttctggaaagctactttgttgagagtctcattcttccctggagttaatagagtgattcacaatctttggggttttctcctcatcaaaagcatttcttaagtgcctatctaaaagcaattaaagactgtgtctgccctttagaagctaagaatttgattcatgatgcaaattaactagataatttgcaaagtacccttgagattgaattttctctattatatatttcccatatttcaggtgaataatttaatttaaatgacaaaaccctatctagtcaactgggcataatgacattttctttaaattagactctattttgaattaaaagagttttattataaaccgtgtgtttttggtttttctaagtatatagaaagcttgtataattcagatttatcaatttcctgatttaatgtagactttgacttttttattaaaaacctttgtattaaagcaagttatgttatttttcttttatgcatttattactaacatagctttaaatctttaaatgtattgaagcattgtgctgtctgaaaataaggaattgcttataaaccagccacttctgaatacaatatgtagctgatttaataagctagttagtgaatggaaaataagtgtggagtattaaaaatgttctttggttggtaaggcctaagatagggtttcatttatttctatactttttctgttttttaaacacctgcatatttttatgtaaatctctaaatttaaaatattttaagtacatttatttttggtgttttattgtataaaaccttagacaatcaatcagtcagtctttactgacaggagcagcagctatctgtcttttgctgatctacaaataaatgaattgagaatttagtccatagaggtccctggctaccaaacacattctcctttgaattgttaaaattcagaacattcaaaataactgttttgctacaacccatgattattttcctgttgtgtttatttaaatttactttctctttagaagtgcacttatttctgaaaaatcttaatgaaacaaacgcttagaacaaatataaatatgagacacttgggactactagagatattttagatttttatgaaaaaaatgtgaggggatattgctgctttaaaaaggaataaagtaataaaaatatatctcagctatttttttaaagcaatataattcagcaattgtctagaaaagtaatcatgaggctactgagtttggtgttcagttactgagtttcaaaaatgttttggtggcatgaggacaaaatttcattgaaggtaagataagaataaaaactatgtttacaaaa

SEQ ID NO: 20878 - DNA, 752 bp, Homo sapiens
  ENST00000545470
ggcggggcgagggcggagcggggagaagggagctgacgggcgcccggccggctgcggtccgtgcggaggctgagccggccgcgggcgcgaccggaggcagtttccgttactatggcaatgacggcagggactacaacaacctttcctatgagcaaccatacccgggaaagagtgactgtagccaagctcacattggagaatttttatagcaacctaattttacagcatgaagagagagaaaccaggcagaagaaattagaagtggccatggaagaagaaggattagcagatgaagaggtgcggttggtccagaagaaagatacaggccatatctatgcaatgaagatattgagaaagtctgatatgcttgaaaaagagcaggtggcccatatccgagcagaaagagatattttggtagaagcagatggtgcctgggtggtgaagatgttttacagttttcaggataagaggaatctttatctaatcatggaatttctccctggaggtgacatgatgacattgctaatgaagaaagacaccttgacagaagaggaaacacagttctacatttcagagactgttctggcaatagatgcgatccaccagttgggtttcatccatcgggatattaagccagacaaccttttattggatgccaagggtcatgtaaaattatctgattttggtttatgtacgggattaaagaaagctcacaggactgaattttatagaaatctcacacacaacccacc

SEQ ID NO: 20879 - DNA, 664 bp, Homo sapiens
  ENST00000544367
gagaagggagctgacgggcgcccggccggctgcggtccgtgcggaggctgagccggccgcgggcgcgaccggaggcagtttccgttactatggcaatgacggcagggactacaacaacctttcctatgagcaaccatacccgggaaagagtgactgtagccaagctcacattggagaatttttatagcaacctaattttacagcatgaagagagagaaaccaggcagaagaaattagaagtggccatggaagaagaaggattagcagatgaagaggtaatgtaattacctataattactgtacaaaagcacccccagtgacttttcattcatttgacatcagaaaaagttacgtcgatcacaacacgctcgcaaagaaacagagttcttacggctcaaaaggaccagacttggcttggatgactttgagtctctgaaagttataggaagaggagcttttggagaggtgcggttggtccagaagaaagatacaggccatatctatgcaatgaagatattgagaaagtctgatatgcttgaaaaagagcaggtggcccatatccgagcagaaagagatattttggtagaagcagatggtgcctgggtggtgaagatgttttacagttttcaggataagaggaatctttatctaatcatggaatttc

SEQ ID NO: 20880 - DNA, 581 bp, Homo sapiens
  ENST00000539863
gacgggcgcccggccggctgcggtccgtgcggaggctgagccggccgcgggcgcgaccggaggcagtttccgttactatggcaatgacggcagggactacaacaacctttcctatgagcaaccatacccgggaaagagtgactgtagccaagctcacattggagaatttttatagcaacctaattttacagcatgaagagagagaaaccaggcagaagaaattagaagtggccatggaagaagaaggattagcagatgaagaggtaatgtaattacctataattactgtacaaaagcacccccagtgacttttcattcatttgacatcaggtattttataacttaaataatgtggattttatcatttgaatatgggcttctttgttgctgtcatggatatcttttattgatatctttagaaggaggcagttttgtttttttcttaaattccaagaacacgtatttaagagaacattgccaagtgtattttaggtgtgtggaatgagaaaggcaagctccgggaggaattaatcaatcgttagcttttctaaaattttttctaaatattcttttaaagctat

SEQ ID NO: 20881 - DNA, 757 bp, Homo sapiens
  ENST00000434385
gcggtccgtgcggaggctgagccggccgcgggcgcgaccggaggcagtttccgttactatggcaatgacggcagggactacaacaacctttcctatgagcaaccatacccgggaaagagtgactgtagccaagctcacattggagaatttttatagcaacctaattttacagcatgaagagagagaaaccaggtatagtaagggctaatcaaaactttttttagttaaataagctgttgtgctgtgagtggaatagaaacttgtttaccatgaatgatatgaatattatggatccctgcatgctgtttttgagtttcctgtactgacagtgcacatagacatgtgttttattttcacagagtagtttcctgaggtgccccaagtcttgtgcatctatatacccgtatgacatgccaattaacgttttaaacaaaccttttccaaacatgaaattatgatatgtctttacattttcttttaaagggatgcctggcttggtgtggtgtggctcatgcctataatcccagcactttgggaagccgaggtgggcagatcacctgaggtcaggagttcaagaccagcctggccaacatggtgaaaccccatctctactgaaaatacaaaaaattagccgggtgtggtggcgggtgcctgtaatcccagctactcaggaggctgaggcaggagaattgcttgaaggcagcagtgagccaaggctgcagtgagccaagatcacaccactgcactccagcctggg

SEQ ID NO: 20882 - DNA, 463 bp, Homo sapiens
  ENST00000540996
gtgcggaggctgagccggccgcgggcgcgaccggaggcaggcatctgaatttcatttgaaaatgaaatgggctgcacagtctggagaagtgtactataccttgttatagcacgttttggaatgacccagaattcagaatgaaatgggcagctatgagccccatccaaagtttccgttactatggcaatgacggcagggactacaacaacctttcctatgagcaaccatacccgggaaagagtgactgtagccaagctcacattggagaatttttatagcaacctaattttacagcatgaagagagagaaaccaggcagaagaaattagaagtggccatggaagaagaaggattagcagatgaagagaaaaagttacgtcgatcacaacacgctcgcaaagaaacagagttcttacggctcaaaaggaccagacttggcttggatgactttgagtctctgaaag

SEQ ID NO: 20883 - DNA, 477 bp, Homo sapiens
  ENST00000546286
cggccgcgggcgcgaccggaggcagtttccgttactatggcaatgacggcagggactacaacaacctttcctatgagcaaccatacccgggaaagagtgactgtagccaagctcacattggagaatttttatagcaacctaattttacagcatgaagagagagaaaccagaggagaaaactggaaatcattcaacaagcagcactgaagtgcctaggggcagaagaaattagaagtggccatggaagaagaaggattagcagatgaagagaaaaagttacgtcgatcacaacacgctcgcaaagaaacagagttcttacggctcaaaaggaccagacttggcttggatgactttgagtctctgaaagttataggaagaggagcttttggagaggtgcggttggtccagaagaaagatacaggccatatctatgcaatgaagatattgagaaagtctgatatgcttgaaaaagagcag

SEQ ID NO: 20884 - DNA, 548 bp, Homo sapiens
  ENST00000543246
attgtatgtgaattagccacccttgtgactatttgaggagagagaagttagtctaaaatattatgttaaattatgatattacataattttattgcataagttcatcaaactacttccatctgaaaaatcctgatctcaaaatagtttccgttactatggcaatgacggcagggactacaacaacctttcctatgagcaaccatacccgggaaagagtgactgtagccaagctcacattggagaatttttatagcaacctaattttacagcatgaagagagagaaaccaggcagaagaaattagaagtggccatggaagaagaaggattagcagatgaagagaaaaagttacgtcgatcacaacacgctcgcaaagaaacagagttcttacggctcaaaaggaccagacttggcttggatgactttgagtctctgaaagttataggaagaggagcttttggagaggtgcggttggtccagaagaaagatacaggccatatctatgcaatgaagatattgagaaagtctgatatgcttgaaaaagagcag

SEQ ID NO: 20885 - DNA, 526 bp, Homo sapiens
  ENST00000544969
agggcagcctgctcgacaaggccccttggcagacagtcagctccctccaaggccaaaccccaagttcaacatacatctttctctcccatttctgcaagcataactgtgaacagcataattcttttccgttactatggcaatgacggcagggactacaacaacctttcctatgagcaaccatacccgggaaagagtgactgtagccaagctcacattggagaatttttatagcaacctaattttacagcatgaagagagagaaaccaggcagaagaaattagaagtggccatggaagaagaaggattagcagatgaagagaaaaagttacgtcgatcacaacacgctcgcaaagaaacagagttcttacggctcaaaaggaccagacttggcttggatgactttgagtctctgaaagttataggaagaggagcttttggagaggtgcggttggtccagaagaaagatacaggccatatctatgcaatgaagatattgagaaagtctgatatgcttgaaaaagagcag

SEQ ID NO: 20886 - DNA, 580 bp, Homo sapiens
  ENST00000407753
ggcagaagaaattagaagtggccatggaagaagaaggattagcagatgaagagaaaaagttacgtcgatcacaacacgctcgcaaagaaacagagttcttacggctcaaaaggaccagacttggcttggatgactttgagtctctgaaagttataggaagaggagcttttggagaggtgcggttggtccagaagaaagatacaggccatatctatgcaatgaagatattgagaaagtctgatatgcttgaaaaagagcaggtgacatgatgacattgctaatgaagaaagacaccttgacagaagaggaaacacagttctacatttcagagactgttctggcaatagatgcgatccaccagttgggtttcatccatcgggatattaagccagacaaccttttattggatgccaagggtcatgtaaaattatctgattttggtttatgtacgggattaaagaaagctcacaggactgaattttatagaaatctcacacacaacccaccaagtgacttctcatttcagaacatgaactcaaagaggaaagcagaaacttggaagaagaacaggagacaactg

SEQ ID NO: 20887 - DNA, 1369 bp, Homo sapiens
  ENST00000536093
tacatttcagagactgttctggcaatagatgcgatccaccagttgggtttcatccatcgggatattaagccagacaaccttttattggatgccaagggtcatgtaaaattatctgattttggtttatgtacgggattaaagaaagctcacaggactgaattttatagaaatctcacacacaacccaccaagtgacttctatgtatatgtattttctttttgtggagagcatttttccctcgtgattacaattccatattgttgaaattagcatttcagaacatgaactcaaagaggaaagcagaaacttggaagaagaacaggagacaactggcatattccacagttgggacaccagattacattgctccagaagtattcatgcagactggttacaacaaattgtgtgactggtggtctttgggagtgattatgtatgaaatgctaataggatatccacctttctgctctgaaacacctcaagaaacgtacagaaaagtgatgaactggaaagaaactctggtatttcctccagaggtacctatatctgagaaagccaaggacttaattctcagattttgtattgattctgaaaacagaattggaaatagtggagtagaagaaataaaaggtcatcccttttttgaaggtgtcgactgggagcacataagggaaaggccagcagcaatccctatagaaatcaaaagcattgatgatacttcaaattttgatgacttccctgaatctgatattttacaaccagtgccaaataccacagaaccggactacaaatccaaagactgggtttttctcaattatacctataaaaggtttgaagggttgactcaacgtggctctatccccacctacatgaaagctgggaagttatgaatgaagataacattcacccataaccaagagaactcaggtagctgcatcaccaggcttgcttggcgtagataacaatacactgaaatactcctgaagatggtggtgcttattgactacaagaggaaattctacaggattaggatttctaagactactataggaattggttggcagtgccagctggctcttttttttaatattttattatttttgttaactttattatatgaaggtactggaataaaaggaacagacatccctttctaactgcactgcctacatgcgtattaaggtccattctgcctgtgtgtgctgtggctttgaactgtaacacctctaatcaattcaggagaaacacatatcatttaaagcaacataggctaacctgtaggtaacactgcagtattgatgttttactgcaaatcttatgggtctagataatcagtaaaagccatcttccatagttggtgttagaacat

SEQ ID NO: 20888 - DNA, 982 bp, Homo sapiens
  ENST00000543992
tgttaaatacatactgatcaataccagtgagctccccacggatcctgtttcaggaaggtgggtatttaacccaaactcccacgtataaaagtggttatctacatagcttttcaggtaaaaggggaggcagtgctttcaatcctttattttattgactttattagcaacgtgattgtaaattgatgaatggtggcatttttgactgttaaatagagcactcagggttgtttggtttcttgtcgcacatgtttggtgggtataaacttcactgctcacaaagctgatgaaacatttttgatttatttgatacataggatatccacctttctgctctgaaacacctcaagaaacgtacagaaaagtgatgaactggaaagaaactctggtatttcctccagaggtacctatatctgagaaagccaaggacttaattctcagattttgtattgattctgaaaacagaattggaaatagtggagtagaagaaataaaaggtcatcccttttttgaaggtgtcgactgggagcacataagggaaaggccagcagcaatccctatagaaatcaaaagcattgatgatacttcaaattttgatgacttccctgaatctgatattttacaaccagtgccaaataccacagaaccggactacaaatccaaagactgggtttttctcaattatacctataaaaggtttgaagggttgactcaacgtggctctatccccacctacatgaaagctgggaagttatgaatgaagataacattcacccataaccaagagaactcaggtagctgcatcaccaggcttgcttggcgtagataacaatacactgaaatactcctgaagatggtggtgcttattgactacaagaggaaattctacaggattaggatttctaagactactataggaattggttggcagtgccagctggctcttttttttaatattttattatttttgttaactttattatat

SEQ ID NO: 20889 - DNA, 2288 bp, Homo sapiens
  ENST00000350889
gaggaagagagcagctcgcttctaactggactgcacgttggtgacagcgtcccaagctggtgacagacccactctgtaactttcagctagattcagccaccagatcccagaaacatgacccttgctgcctacaaagagaagatgaaggagctcccgctggtgtccttgttctgctcctgcttcctggccgatcccctgaataagtcgtcctacaaatatgaaggctggtgtgggagacagtgtaggaggaaggatgaaagccagcggaaagacagtgctgactggagagaaagaagagctcaggcagacacggtggacctgaattggtgcgtcatttccgacatggaagtcatcgagctgaacaaatgcacctcgggccaatcctttgaagtcatcctgaagccaccctcctttgatggggttcccgagttcaacgcctccctgccaaggcggcgagacccatccctggaagagatccagaagaaactagaagcggctgaggagcgaaggaagtaccaggaagcggagctcctgaaacacctagcagagaaacgggaacatgagagagaggtgatccaaaaggccattgaggaaaacaacaacttcatcaagatggctaaggaaaaactggcccagaagatggaatccaacaaggagaacagggaggcccacctcgccgccatgttggaacggctgcaagagaaggacaagcacgccgaggaggtgcggaaaaacaaggagctgaaggaagaggcctccaggtaaagcctagaggccaaagaactttccaggtcagccggacagctccagcagctccacgttccaggcagcctcgcccgccggctgcgctcccagcactggggtttggggggaggggggtggccaaggggcgtttcctctgcttttggtgtttgtacatgttaagaattgaccagtgaagccatcctatttgtttccggggaacaatgacggggtgggagaggggagaggagagagtttgggaaagggagatggagaagaactcaaggacattgcaaccctgcccggcgcagatctgattttcacatctctacctggacattgagcctccaggcaccatgttgaggagagatgaaaaccagggcggtagaacttcagggtgaaggacagagtcctgggtggggcagcggctgcagggcgcaccagagaacccagccagaggggttgtgagtaccagtggtgttgcttccaccctgcagcaggtgggatgaggtctgtgtgtgtgtgtgaaccatcattttttgatcatcatgaccaatgaaacattgactccaagtgtccagttctttatttcccaaatgtgtcctttgggtaattgttaaaaagttctcgaaacctggctttcatccatctgatggcagatgcccctttgcttccttaattctgccattcaagcatctggagcctgggtgaggtgggttgaatcaggccagcctttggcataattgaaaggttttctcttctgttttttaaaatcccctctgtgggctaatctttattggatagcatgcactaaattgatgagaaaagaaactcaatcttcctttcaatgaactgacatcctaatatggtccccaagatgcactgtaagaaggaatttgtcttagtcacaaccgttcagactgctgtaacaaaataccttagactaagtaattgataacagaaattgattgctcacagttttggaggctgggaagtccaatatcaaggtgccagcagattcagtgtctggtgagggcttgccatctgcttcaaagatgatgcctttttgctgcatcctcacatggcagaagggaagggcaaaagggcttccttgagccttttctttaaggcactaatcccattcatgaaggtggagtcctcatgatctcacctcttaaggccctatctcttaattctgtagtgtcgggattaggattcaacctgtatattgggggagacagcaacattcacaccatagcagaagtcctccatgctttgggggtttgagattctaggtagattagaaaatacgagcaaggaaataaagtgtttgctagtagaaggcaaaggaggcatccagacccagcagtcttggtctccaggacactgaaccatggctggaaaagaagctctcctcctcccttcccctgcaaacatgagtgcaggggctgcctgtgttaaccgggtcccaggacctcttcccactctgctctgcacactgtgtagttttttacagctttgcaaataaaccctttggtatagccttt

SEQ ID NO: 20890 - DNA, 1623 bp, Homo sapiens
  ENST00000519997
actaattgagggagtgaggaagagagcagctcgcttctaactggactgcaccctacaaagagaagatgaaggagctcccgctggtgtccttgttctgctcctgcttcctggccgatcccctgaataagtcgtcctacaaatatgaagcagacacggtggacctgaattggtgcgtcatttccgacatggaagtcatcgagctgaacaaatgcacctcgggccaatcctttgaagtcatcctgaagccaccctcctttgatggggttcccgagttcaacgcctccctgccaaggcggcgagacccatccctggaagagatccagaagaaactagaagcggctgaggagcgaaggaagtaccaggaagcggagctcctgaaacacctagcagagaaacgggaacatgagagagaggtgatccaaaaggccattgaggaaaacaacaacttcatcaagatggctaaggaaaaactggcccagaagatggaatccaacaaggagaacagggaggcccacctcgccgccatgttggaacggctgcaagagaaggaaccgcctgctgcgcggtgactcccgggacctgatcggtggcctcgtcccatggacaagcacgccgaggaggtgcggaaaaacaaggagctgaaggaagaggcctccaggtaaagcctagaggccaaagaactttccaggtcagccggacagctccagcagctccacgttccaggcagcctcgcccgccggctgcgctcccagcactggggtttggggggaggggggtggccaaggggcgtttcctctgcttttggtgtttgtacatgttaagaattgaccagtgaagccatcctatttgtttccggggaacaatgacggggtgggagaggggagaggagagagtttgggaaagggagatggagaagaactcaaggacattgcaaccctgcccggcgcagatctgattttcacatctctacctggacattgagcctccaggcaccatgttgaggagagatgaaaaccagggcggtagaacttcagggtgaaggacagagtcctgggtggggcagcggctgcagggcgcaccagagaacccagccagaggggttgtgagtaccagtggtgttgcttccaccctgcagcaggtgggatgaggtctgtgtgtgtgtgtgaaccatcattttttgatcatcatgaccaatgaaacattgactccaagtgtccagttctttatttcccaaatgtgtcctttgggtaattgttaaaaagttctcgaaacctggctttcatccatctgatggcagatgcccctttgcttccttaattctgccattcaagcatctggagcctgggtgaggtgggttgaatcaggccagcctttggcataattgaaaggttttctcttctgttttttaaaatcccctctgtgggctaatctttattggatagcatgcactaaattgatgagaaaagaaactcaatcttcctttcaatgaactgacatcctaatatggtccccaagatgcactgtaagaaggaatttgtcttagtcacaaccgttcagactgctgtaacaaaataccttagactaagtaattgataacagaaattgattgctcacagttttgga

SEQ ID NO: 20891 - DNA, 1250 bp, Homo sapiens
  ENST00000265770
agggtaccactaattgagggagtgaggaagagagcagctcgcttctaactggactgcacgttggtgacagcgtcccaagctggtgacagacccactctgtaactttcagctagattcagccaccagatcccagaaacatgacccttgctgcctacaaagagaagatgaaggagctcccgctggtgtccttgttctgctcctgcttcctggccgatcccctgaataagtcgtcctacaaatatgaagcagacacggtggacctgaattggtgcgtcatttccgacatggaagtcatcgagctgaacaaatgcacctcgggccaatcctttgaagtcatcctgaagccaccctcctttgatggggttcccgagttcaacgcctccctgccaaggcggcgagacccatccctggaagagatccagaagaaactagaagcggctgaggagcgaaggaagtaccaggaagcggagctcctgaaacacctagcagagaaacgggaacatgagagagaggtgatccaaaaggccattgaggaaaacaacaacttcatcaagatggctaaggaaaaactggcccagaagatggaatccaacaaggagaacagggaggcccacctcgccgccatgttggaacggctgcaagagaaggacaagcacgccgaggaggtgcggaaaaacaaggagctgaaggaagaggcctccaggtaaagcctagaggccaaagaactttccaggtcagccggacagctccagcagctccacgttccaggcagcctcgcccgccggctgcgctcccagcactggggtttggggggaggggggtggccaaggggcgtttcctctgcttttggtgtttgtacatgttaagaattgaccagtgaagccatcctatttgtttccggggaacaatgacggggtgggagaggggagaggagagagtttgggaaagggagatggagaagaactcaaggacattgcaaccctgcccggcgcagatctgattttcacatctctacctggacattgagcctccaggcaccatgttgaggagagatgaaaaccagggcggtagaacttcagggtgaaggacagagtcctgggtggggcagcggctgcagggcgcaccagagaacccagccagaggggttgtgagtaccagtggtgttgcttccaccctgcagcaggtgggatgaggtctgtgtgtgtgtgtgaaccatcattttttgatcatcatgaccaatgaaacattga

SEQ ID NO: 20892 - DNA, 1224 bp, Homo sapiens
  ENST00000523048
gagagaagcccagggtaccactaattgagggagtgaggaagagagcagctcgcttctaactggactgcacgttggtgacagcgtcccaagctggtgacagacccactctgtaactttcagctagattcagccaccagatcccagaaacatgacccttgctgcctacaaagagaagatgaaggagctcccgctggtgtccttgttctgctcctgcttcctggccgatcccctgaataagtcgtcctacaaatatgaaggctggtgtgggagacagtgtaggaggaaggatgaaagccagcggaaagacagtgctgactggagagaaagaagagctcaggcagacacggtggacctgaattggtgcgtcatttccgacatggaagtcatcgagctgaacaaatgcacctcgggccaatcctttgaagtcatcctgaagccaccctcctttgatggggttcccgagttcaacgcctccctgccaaggcggcgagacccatccctggaagagatccagaagaaactagaagcggctgaggagcgaaggaagtaccaggaagcggagctcctgaaacacctagcagagaaacgggaacatgagagagaggtgatccaaaaggccattgaggaaaacaacaacttcatcaagatggctaaggaaaaactggcccagaagatggaatccaacaaggagaacagggaggcccacctcgccgccatgttggaacggctgcaagagaaggaaccgcctgctgcgcggtgactcccgggacctgatcggtggcctcgtcccatggacaagcacgccgaggaggtgcggaaaaacaaggagctgaaggaagaggcctccaggtaaagcctagaggccaaagaactttccaggtcagccggacagctccagcagctccacgttccaggcagcctcgcccgccggctgcgctcccagcactggggtttggggggaggggggtggccaaggggcgtttcctctgcttttggtgtttgtacatgttaagaattgaccagtgaagccatcctatttgtttccggggaacaatgacggggtgggagaggggagaggagagagtttgggaaagggagatggagaagaactcaaggacattgcaaccctgcccggcgcagatctgattttcacatctctacctggacattgagcctccaggcaccatgttgaggagagatgaaaaccagggcggtagaacttca

SEQ ID NO: 20893 - DNA, 1273 bp, Homo sapiens
  ENST00000519614
accactaattgagggagtgaggaagagagcagctcgcttctaactggactgcacgttggtgacagcgtcccaagctggtgacagacccactctgtaactttcagctagattcagccaccagatcccagaaacatgacccttgctgcctacaaagagaagatgaaggagctcccgctggtgtccttgttctgctcctgcttcctggccgatcccctgaataagtcgtcctacaaatatgaagcagacacggtggacctgaattggtgcgtcatttccgacatggaagtcatcgagctgaacaaatgcacctcgggccaatcctttgaagtcatcctgaagccaccctcctttgatggggttcccgagttcaacgcctccctgccaaggcggcgagacccatccctggaagagatccagaagaaactagaagcggctgaggagcgaaggaagtaccaggaagcggagctcctgaaacacctagcagagaaacgggaacatgagagagaggtgatccaaaaggccattgaggaaaacaacaacttcatcaagatggctaaggaaaaactggcccagaagatggaatccaacaaggagaacagggaggcccacctcgccgccatgttggaacggctgcaagagaaggtgaggggtccctggctagagaggagtttcctgggacatgctgttttccttctgcagcaagtatgcggggacctgctgatcatctcagggaggaagcagcctcaggcaaaaatcaggatctttttcttaggcaggatctttagagagttccgaaggatgatcagggaagtcagaggcaagaaataggaaccagactcagggtttccttgggggatattctgcacagttacacaattaaaatccttcattgccttagggagcatatatgtctgattttctagaagaagcctgtctaatacaaaggagtagagatagacaagcaggtatgcattcctagcttcatccctgaatggattgatttgatggaaggaaagatgctttcttgagctcttggctctaagtcacgggtatgatgagctgagattcccactgagcaggaaacatgattctctctaaacctcttgacacagacccagtgagtcacaggtctttccaatatgttgccttttgtcaataaatggaacggtgtcacctaaatatgagaaacatgaggccggggttggttctgtgtgtcagcagaataccggcccgttctgctgagaacacgctggcctcatttcctgagtctcaa

SEQ ID NO: 20894 - DNA, 1004 bp, Homo sapiens
  ENST00000522908
accactaattgagggagtgaggaagagagcagctcgcttctaactggactgcacgttggtgacagcgtcccaagctggtgacagacccactctgtaactttcagctagattcagccaccagatcccagaaacatgacccttgctgcctacaaagagaagatgaaggagctcccgctggtgtccttgttctgctcctgcttcctggccgatcccctgaataagtcgtcctacaaatatgaaggctggtgtgggagacagtgtaggaggaaggatgaaagccagcggaaagacagtgctgactggagagaaagaagagctcaggcagacacggtggacctgaattggtgcgtcatttccgacatggaagtcatcgagctgaacaaatgcacctcgggccaatcctttgaagtcatcctgaagccaccctcctttgatggggttcccgagttcaacgcctccctgccaaggcggcgagacccatccctggaagagatccagaagaaactagaagcggctgaggagcgaaggaagtaccaggaagcggagctcctgaaacacctagcagagaaacgggaacatgagagagaggtgatccaaaaggccattgaggaaaacaacaacttcatcaagatggctaaggaaaaactggcccagaagatggaatccaacaaggagaacagggaggcccacctcgccgccatgttggaacggctgcaagagaaggtgaggggtccctggctagagaggagtttcctgggacatgctgttttccttctgcagcaagtatgcggggacctgctgatcatctcagggaggaagcagcctcaggcaaaaatcaggatctttttcttaggcaggatctttagagagttccgaaggatgatcagggaagtcagaggcaagaaataggaaccagactcagggtttccttgggggatattctgcacagttacacaattaaaatccttcattgccttagggagcatatatgtctgattttctag

SEQ ID NO: 20895 - DNA, 698 bp, Homo sapiens
  ENST00000522750
aattgagggagtgaggaagagagcagctcgcttctaactggactgcacgttggtgacagcgtcccaagctggtgacagacccactctgtaactttcagctagattcagccaccagatcccagaaacatgacccttgctgcctacaaagagaagatgaaggagctcccgctggtgtccttgttctgctcctgcttcctggccgatcccctgaataagtcgtcctacaaatatgaaggtcagtgaaggctcagccaggaaagtgaggggcgggggggccctgtgtcctgtcctcataggtcctgcaccccgaccccagtcccgtgaatctctcctcccgagacagtttccttcccagtgccgatgaaatcacagcgggtgagcccgagggtctgagctgcagtggtccagcctgggcactagggggaggccatgaaggtctgcatcaggcgccccccagagtgcactcgatcttgtcacctctgtgcatgcatccagcaaatcgagactggggggtatgcaaaggctggtgtgggagacagtgtaggaggaaggatgaaagccagcggaaagacagtgctgactggagagaaagaagagctcaggcagacacggtggacctgaattggtgcgtcatttccgacatggaagtcatcgagctgaacaaatgcacctcgggccaatcctttgaagtcatcctg

SEQ ID NO: 20896 - DNA, 2243 bp, Homo sapiens
  ENST00000484110
tttgccagcaggcgatggaatagggactacgagacaccctgcagcctctcctgggaggacaacgccccttctccctctccatgcactcttgaggcagcaaagaggaggcatctggacgcgtttacctcctccccacccccacagcttggccctcactaaactatcttgtgtccttcctcctgctatgattgattcgcccaggaaggagggagcgctctcccctcctctgggaggctggagactcggggacagaagatgcgctggagggaagagaacggagcgtcggacaccagaaaaactttgggggattcggggtgagaaagaaggcgtgaagagagaagggaggctcagcaggggaggaggggcgggggcgggggcgggagcgggaggagtcactgcgccgcggccgcccctccccgccctccactcggcggccccgggtcttcctccccctcctcctccccctcctcctccccctcctcttcctccgcctcctggtgtggctggctgcggccagaatcggagccccaaccgcgctgccggtgagtgaccagccccaggggacagagacgggaggcctgggaccccccctctccagggtggggcctcccgccgtgtctgggaaagtttgcgggcgccccgggacgcgggcatctccagggccgctcggcgcctccccatctccccgcgcccgccctggccgcccccaggggcgccctggggcccgcagagggatggcctcccggcagggactcctcggctcccctctgttctgagactgctgctgggaccggggtccgactctaaagagaaaactcaaacagcaaaaaaaggaatatcgactcagttccgagggcgggggccggggctcgttctcacccgcgcgcggcccctcgacctctcggacccgggccaccagctctgcgcccctcacgcctccctcggggtctctgtgtctctctcccgctcccggactccctcctccttctgactgctgttatttgggctgttgtccctccccgctccctggtacctcagctcggaccttagcctgtgcctgcagcccggagtcccctcctgccctggaaggcaaggagccaggccacggggccacagccgcgggggccaccacactggcccaaatatttcctgcaggtatgaccattcactgggtattggggttgggtcccttggacccacaaactgaacctcgtgggtacagggaaaaattaaaatatattcctccttaggattgtactgcttctgttggtttggcatctttttatttttaacccttctaactgtgctttcttcgaataataatgatacttcatgtaattagcgtttctaatatctaaagacagaagaaggaagaaaataaacggaagagagagaatgcttgctaaaaatactcatttttgacttcagtccacactcgactgttttcctgggagatagaagttcagtgtagcttgttttcagactaaccgcaaacacgattacagcctcctccaggctagaagttttaatttgcctgacatgcagcacactgtttgttggtattcccagcctggcattcccgtctgcatagctctagtctccctcccaactcccccacccccactttctttctcataaaagggagctgtgaaaacaaggcaatgggagaggctcaaacgagctggaccacataataaaaacagccctacttattttaatcctgaggctatggactcccctggactctgattgggtggaagaattgtttagttcatttgtgtggtttttctgtcagtagttattatggttgaatcagtgtttccatgacagtcttgcttctgtgggcacgatggggagcctgttaattctcggatgggtctggacagatcaagtctggagtctggagagatttttcagggcttgacctgggctgatattgcaaacctctgcacactcactcagaaccagagcagccgggagcagcctgagctggggttttcttccacatgatctgggaagaaaaagctctaccaaggagcgaactgtgtgagcatggttgctgggggatgttgaatgttttacgtttttaggaagaacacacttctcaaaactttagccattcctgtttccatacaaacaataaatgtggttgtaacaaatgtagtagatcagattctgaacaaccccttaaaaaacaggtccaagtattgaaccatttggaaataaagattttattttatttg

SEQ ID NO: 20897 - DNA, 5511 bp, Homo sapiens
  ENST00000404752
ggtgtggctggctgcggccagaatcggagccccaaccgcgctgccgagtcaacctatttgatttcttgacaagaccacaatctgatcccaaagatgtgctccacaaatccaggcaaatgggtcacctttgatgatgatcctgctgttcaatcttctcaaaagtcaaagaattttcctctggagaatcaaggtgtctgtagaccaaatggactgaagctgaaccttcctggcctcagggaatttcccagtggatcttcctccaccagcagcactcctctctcctcccccattgtagatttttatttcagtccaggacctccaagtaactctcctctttctacacctaccaaagacttcccaggttttcctggcatccccaaagcagggactcatgtgctttatcctattccagaatcatcttcagacagcccactcgcaatatcaggaggagaatcttccttactgcctaccagaccaacatgtttatcccatgccttgttacccagtgaccactcatgtacacatccaactcccaaagtaggtcttccagatgaagttaatcctcaacaggctgaaagcctaggattccaaagtgatgatctcccccagtttcagtattttcgagaggactgtgctttttcaagtccattttggaaagatgaaggcagtgattcccatttcacccttgacccaccaggaagcaaaaagatgttctcatcaagaaacaaggagatgcctattgaccaaaaaagcctaaataagtgttcactcaactatatctgtgagaagcttgaacatctccagtcagctgagaaccaagactcacttagaagtttgtctatgcactgtctatgtgctgaagaaaatgcctcttcctttgtcccccacacactcttcaggagtcagccaaaatccggatggtctttcatgctgagaattcctgagaagaagaatatgatgtcttcccggcaatggggaccaatttttctgaaagttttgcctggaggaattttgcagatgtattatgaacagggattagaaaaaccatttaaagagatacagcttgatccatattgtaggctttctgaacccaaggttgagaacttcagtgtagcaggaaaaatccacactgtgaagattgaacatgtgtcttacacagaaaaaaggaaataccattctaagacagaagtagttcatgaacctgacatagagcagatgctgaagttggggtccacatcgtaccatgacttccttgactttctgactactgtggaggaggagctgatgaagttgccagctgtttcaaaaccaaaaaagaactacgaggagcaagaaatttccttggaaattgtggacaacttttggggtaaagtcacaaaagaaggaaaatttgttgaaagtgctgtgataactcaaatttattgcctctgctttgtgaatgggaacctggaatgctttttaaccttgaatgaccttgagttgccgaagcgagatgaatcctattatgagaaggactcagaaaaaaaggggattgatattcttgactaccattttcataagtgtgtgaatgtacaagaatttgagcaatcaagaatcattaagtttgtacctctggatgcctgccggtttgagctgatgcgtttcaagactttgtataatggggataatcttcccttttccttgaagtctgtagtggttgtccagggagcatacgtggaacttcaggcttttgtcaacatggcctcattggcgcagaggtcatcctatgctggttccttaaggtcctgtgacaatataaggatacactttcctgtcccatcgcagtggatcaaggccctttggaccatgaacctccagaggcagaagtctctgaaagctaaaatgaaccgccgagcatgtctggggagtttacaggaacttgaatctgaacctgtcattcaagtcactgtggggtcagcaaaatatgagagtgcctaccaggcagtggtatggaagatagatcggcttccagacaaaaattcaagtctagatcatccccattgtctgtcatacaaattagagcttggatcagaccaagaaattccctctgattggtatccatttgctactgttcagttttccgtgcctgacacctgtgcctcaaggacagaggtcaggtctctgggagtggagagtgatgtccagccacagaaacatgttcagcagcgagcttgctacaacatccaggttgaaatagaaaagaagtggattaaaatcgatggagaagacccagataaaattggtgactgcataactcagtaggagtagcaagagtttatgatgacagcccacttgtcaaatatgtaattcaccgaaaccacaccaagtcctgctactgtagagtggaaatgacttctgaatagcggttttaggacaggtctgatggctgtgtttagagaagtttagacctaaaaccgaacaatctgtattttttgcttttcatgtgtttttgtcctaggggttcgatctaaaatgtttctataattcgtgtgatgttttgcttcctattgaaactcaaaggcactgttactcgttgtgtgaccccgcagccagtatgatttttgattactcagtggctgactgttttgctctctggattactgaggtgccgtcttcatttcttcccatctcttcttgctgcttagtgtctgtactagagggtaagggaatcaaaggagacataaaccaaaatagttaattttccctctttcttgcctctgaaatgtggctaggtgtagaatgatgttgaaaccacaggctaaaatgtagatctggaagtatctgtgcttttgaattacttatttacctgtcctcttaccgttggtaaataataattggctatatttggtacctgtctctctcctactgtattgtcattttcaaaatgtgtttgttttctggcgcgtgctgcaaagaagctatttctgttgtcctacatattttagtataaatcactaagacatatttcctttcacttggcaggattcctttcaaaatggaatctgagtattagacactagttaacatatttgtgtatattaaatatgaatttttaaaatttataaatactattttccaaaagtacagactctaaggacatattttgataaagtattatttgtaatgaacacaagcctctcttgagtagaagtctaaatcacattatgattattttatactagttctgctatcatgctgttttatgctaattctgcttattttagagtatttttcattaaaaggtgagcaaagtgaaagatacttggtattttacccagatttctaagtggcaacatttttattcttcagagtcaggtaaatgactataatagtttggtttctaatgaaaagtcaatagcattagcagttataattctgtttataatttcctttcagcatttacagtgaaaagtgagaattttaaaatttatgaaatctatattccaggtattgtttttagtctgaaaaacaaactcccccatgtggtattaatataccttcaatttatgttgagtcttaaacataattaggagatatttttctctatttgctagatttgttttgagtcaaaactgatttagtgttcttccaaacaacatttatgtgttggcctacagagtttatttcatgtgttttttttaatatttaatattatattacattcattgaaatctgttcaaaaacagattaagacaaacatttatgatggtctgtatcaatcagcagattttattgcttttcattattttactgtaaaggcaaagaatgcaataggtgatggttggttgaaaggaattgttattgctgtttttattttttactttttttgagacagagtctcactctgttgcccagcctggagtgcagtgtgtcatcttggctcactgcaacctccgcctcctgggttcaagggattctcctgcctcagcctccaactagctgggattacaggcacaagccaccatgcctggctaaaattcttttgtatttttactacagacggagtttccccatgttggccgggctagtctcgaactcctgacctcaggtgatccaccagcctcggcctcccaaagttctgggattaaatgcgtgagccaccatgcccggccgctattgctctttttaacttcatttgatgccttgcttataatatcatatgcttgaggctcactgttgatgtagagtagggcaaatctgtgtgtgtatgtcattaaaaaaattctaccatctttctttatcatctggtgtgggcgcactctacagtgacttcagtctgctcagaacgaatgtggaggccggccgaaactgatgctgcccacagtcccagtgaagttaggtgggttaattactgccattcctttctaagtgtgttttatggcatcctgcccacaaagaactcacagtctgattaggatgaacttaatgactatttacacctcaaaatatattcagcaaagggttcacttagttgcccctcatgcttcacaggttgactagtatctgtgggtacctccctgcccaggttattcactcacaagccaccgggccttcaggacatctcaagattcagtcttgacaatataatagcaaaagctggactaaagcccaaatggattgtctgtggcaatgcagaagctgatagcattaacagcagggtgttacagcataattgttaattcgcacatctattaggatccttaaatattcattacttaatgttaaattaacattctgtgtagggaggggaggcttattcaattcttctgacctcagaactggcagaaggtcagatgtgactacagaactctaggtgaaaaatcaggtagggttcaaattaagtagaactgcccttgccggaatagtgatcttcaaaaaacccttgcttttaggggagggaagcggggaaggaaaggaatgagggaggaaatattcctttctagcattcattttgcttagatcactccattgtgagtttgaccattttggagtcaaatgagcagacttccaaggagttgaccagtttgtgactagtctggtcacctttccagttacaggatcatattaactgtgtaaatgaattcatgggtagatgatttgtgcagatctgaatttaagaacatttcctttttctgtgggaatcacaagagtttatccactaaaaaaagatatgtaaaaaagatactttccagcacataaataaaggctggaattttacaacctgatgtatatattagacagttctaggatgttagttcccttcattccagagctatgcttgtgatacagccccttttcttataaagtcagttagaaggacttccttaacaatgactattataatgtcttacttaaaatacagttttgtattctgtcaatgcaaatataagacaggttgagccttaatcatgtaacaaaatattttgtagattacatattgatttttcaaaaattaaaaatgtatttcaaact

SEQ ID NO: 20898 - DNA, 5614 bp, Homo sapiens
  ENST00000406226
ggccagaatcggagccccaaccgcgctgccgctcggaccttagcctgtgcctgcagcccggagtcccctcctgccctggaaggcaaggagccaggccacggggccacagccgcgggggccaccacactggcccaaatatttcctgcagagtcaacctatttgatttcttgacaagaccacaatctgatcccaaagatgtgctccacaaatccaggcaaatgggtcacctttgatgatgatcctgctgttcaatcttctcaaaagtcaaagaattttcctctggagaatcaaggtgtctgtagaccaaatggactgaagctgaaccttcctggcctcagggaatttcccagtggatcttcctccaccagcagcactcctctctcctcccccattgtagatttttatttcagtccaggacctccaagtaactctcctctttctacacctaccaaagacttcccaggttttcctggcatccccaaagcagggactcatgtgctttatcctattccagaatcatcttcagacagcccactcgcaatatcaggaggagaatcttccttactgcctaccagaccaacatgtttatcccatgccttgttacccagtgaccactcatgtacacatccaactcccaaagtaggtcttccagatgaagttaatcctcaacaggctgaaagcctaggattccaaagtgatgatctcccccagtttcagtattttcgagaggactgtgctttttcaagtccattttggaaagatgaaggcagtgattcccatttcacccttgacccaccaggaagcaaaaagatgttctcatcaagaaacaaggagatgcctattgaccaaaaaagcctaaataagtgttcactcaactatatctgtgagaagcttgaacatctccagtcagctgagaaccaagactcacttagaagtttgtctatgcactgtctatgtgctgaagaaaatgcctcttcctttgtcccccacacactcttcaggagtcagccaaaatccggatggtctttcatgctgagaattcctgagaagaagaatatgatgtcttcccggcaatggggaccaatttttctgaaagttttgcctggaggaattttgcagatgtattatgaacagggattagaaaaaccatttaaagagatacagcttgatccatattgtaggctttctgaacccaaggttgagaacttcagtgtagcaggaaaaatccacactgtgaagattgaacatgtgtcttacacagaaaaaaggaaataccattctaagacagaagtagttcatgaacctgacatagagcagatgctgaagttggggtccacatcgtaccatgacttccttgactttctgactactgtggaggaggagctgatgaagttgccagctgtttcaaaaccaaaaaagaactacgaggagcaagaaatttccttggaaattgtggacaacttttggggtaaagtcacaaaagaaggaaaatttgttgaaagtgctgtgataactcaaatttattgcctctgctttgtgaatgggaacctggaatgctttttaaccttgaatgaccttgagttgccgaagcgagatgaatcctattatgagaaggactcagaaaaaaaggggattgatattcttgactaccattttcataagtgtgtgaatgtacaagaatttgagcaatcaagaatcattaagtttgtacctctggatgcctgccggtttgagctgatgcgtttcaagactttgtataatggggataatcttcccttttccttgaagtctgtagtggttgtccagggagcatacgtggaacttcaggcttttgtcaacatggcctcattggcgcagaggtcatcctatgctggttccttaaggtcctgtgacaatataaggatacactttcctgtcccatcgcagtggatcaaggccctttggaccatgaacctccagaggcagaagtctctgaaagctaaaatgaaccgccgagcatgtctggggagtttacaggaacttgaatctgaacctgtcattcaagtcactgtggggtcagcaaaatatgagagtgcctaccaggcagtggtatggaagatagatcggcttccagacaaaaattcaagtctagatcatccccattgtctgtcatacaaattagagcttggatcagaccaagaaattccctctgattggtatccatttgctactgttcagttttccgtgcctgacacctgtgcctcaaggacagaggtcaggtctctgggagtggagagtgatgtccagccacagaaacatgttcagcagcgagcttgctacaacatccaggttgaaatagaaaagaagtggattaaaatcgatggagaagacccagataaaattggtgactgcataactcagtaggagtagcaagagtttatgatgacagcccacttgtcaaatatgtaattcaccgaaaccacaccaagtcctgctactgtagagtggaaatgacttctgaatagcggttttaggacaggtctgatggctgtgtttagagaagtttagacctaaaaccgaacaatctgtattttttgcttttcatgtgtttttgtcctaggggttcgatctaaaatgtttctataattcgtgtgatgttttgcttcctattgaaactcaaaggcactgttactcgttgtgtgaccccgcagccagtatgatttttgattactcagtggctgactgttttgctctctggattactgaggtgccgtcttcatttcttcccatctcttcttgctgcttagtgtctgtactagagggtaagggaatcaaaggagacataaaccaaaatagttaattttccctctttcttgcctctgaaatgtggctaggtgtagaatgatgttgaaaccacaggctaaaatgtagatctggaagtatctgtgcttttgaattacttatttacctgtcctcttaccgttggtaaataataattggctatatttggtacctgtctctctcctactgtattgtcattttcaaaatgtgtttgttttctggcgcgtgctgcaaagaagctatttctgttgtcctacatattttagtataaatcactaagacatatttcctttcacttggcaggattcctttcaaaatggaatctgagtattagacactagttaacatatttgtgtatattaaatatgaatttttaaaatttataaatactattttccaaaagtacagactctaaggacatattttgataaagtattatttgtaatgaacacaagcctctcttgagtagaagtctaaatcacattatgattattttatactagttctgctatcatgctgttttatgctaattctgcttattttagagtatttttcattaaaaggtgagcaaagtgaaagatacttggtattttacccagatttctaagtggcaacatttttattcttcagagtcaggtaaatgactataatagtttggtttctaatgaaaagtcaatagcattagcagttataattctgtttataatttcctttcagcatttacagtgaaaagtgagaattttaaaatttatgaaatctatattccaggtattgtttttagtctgaaaaacaaactcccccatgtggtattaatataccttcaatttatgttgagtcttaaacataattaggagatatttttctctatttgctagatttgttttgagtcaaaactgatttagtgttcttccaaacaacatttatgtgttggcctacagagtttatttcatgtgttttttttaatatttaatattatattacattcattgaaatctgttcaaaaacagattaagacaaacatttatgatggtctgtatcaatcagcagattttattgcttttcattattttactgtaaaggcaaagaatgcaataggtgatggttggttgaaaggaattgttattgctgtttttattttttactttttttgagacagagtctcactctgttgcccagcctggagtgcagtgtgtcatcttggctcactgcaacctccgcctcctgggttcaagggattctcctgcctcagcctccaactagctgggattacaggcacaagccaccatgcctggctaaaattcttttgtatttttactacagacggagtttccccatgttggccgggctagtctcgaactcctgacctcaggtgatccaccagcctcggcctcccaaagttctgggattaaatgcgtgagccaccatgcccggccgctattgctctttttaacttcatttgatgccttgcttataatatcatatgcttgaggctcactgttgatgtagagtagggcaaatctgtgtgtgtatgtcattaaaaaaattctaccatctttctttatcatctggtgtgggcgcactctacagtgacttcagtctgctcagaacgaatgtggaggccggccgaaactgatgctgcccacagtcccagtgaagttaggtgggttaattactgccattcctttctaagtgtgttttatggcatcctgcccacaaagaactcacagtctgattaggatgaacttaatgactatttacacctcaaaatatattcagcaaagggttcacttagttgcccctcatgcttcacaggttgactagtatctgtgggtacctccctgcccaggttattcactcacaagccaccgggccttcaggacatctcaagattcagtcttgacaatataatagcaaaagctggactaaagcccaaatggattgtctgtggcaatgcagaagctgatagcattaacagcagggtgttacagcataattgttaattcgcacatctattaggatccttaaatattcattacttaatgttaaattaacattctgtgtagggaggggaggcttattcaattcttctgacctcagaactggcagaaggtcagatgtgactacagaactctaggtgaaaaatcaggtagggttcaaattaagtagaactgcccttgccggaatagtgatcttcaaaaaacccttgcttttaggggagggaagcggggaaggaaaggaatgagggaggaaatattcctttctagcattcattttgcttagatcactccattgtgagtttgaccattttggagtcaaatgagcagacttccaaggagttgaccagtttgtgactagtctggtcacctttccagttacaggatcatattaactgtgtaaatgaattcatgggtagatgatttgtgcagatctgaatttaagaacatttcctttttctgtgggaatcacaagagtttatccactaaaaaaagatatgtaaaaaagatactttccagcacataaataaaggctggaattttacaacctgatgtatatattagacagttctaggatgttagttcccttcattccagagctatgcttgtgatacagccccttttcttataaagtcagttagaaggacttccttaacaatgactattataatgtcttacttaaaatacagttttgtattctgtcaatgcaaatataagacaggttgagccttaatcatgtaacaaaatattttgtagattacatattgatttttcaaaaattaaaaatgtatttcaaacta

SEQ ID NO: 20899 - DNA, 1006 bp, Homo sapiens
  ENST00000444932
aggtcatcctatgctggttccttaaggtcctgtgacaatataaggatacactttcctgtcccatcgcagtggatcaaggccctttggaccatgaacctccagaggcagaagtctctgaaagctaaaatgaaccgccgagcatgtctggggagtttacaggaacttgaatctgaacctgtcattcaagtcactgtggggtcagcaaaatatgagagtgcctaccaggcagtggtatggaagatagatcggcttccagacaaaaattcaattttccgtgcctgacacctgtgcctcaaggacagaggtcaggtctctgggagtggagagtgatgtccagccacagaaacatgttcagcagcgagcttgctacaacatccaggttgaaatagaaaagaagtggattaaaatcgatggagaagacccagataaaattggtgactgcataactcagtaggagtagcaagagtttatgatgacagcccacttgtcaaatatgtaattcaccgaaaccacaccaagtcctgctactgtagagtggaaatgacttctgaatagcggttttaggacaggtctgatggctgtgtttagagaagtttagacctaaaaccgaacaatctgtattttttgcttttcatgtgtttttgtcctaggggttcgatctaaaatgtttctataattcgtgtgatgttttgcttcctattgaaactcaaaggcactgttactcgttgtgtgaccccgcagccagtatgatttttgattactcagtggctgactgttttgctctctggattactgaggtgccgtcttcatttcttcccatctcttcttgctgcttagtgtctgtactagagggtaagggaatcaaaggagacataaaccaaaatagttaattttccctctttcttgcctctgaaatgtggctaggtgtagaatgatgttgaaaccacaggctaaaatgtagatctggaagtatctgtgcttttgaattacttatttacctgtcctc

SEQ ID NO: 20900 - DNA, 4302 bp, Homo sapiens
  ENST00000555447
cttggctggtcacagcacagtgctcctgggcccaggggctgtgatctcctgtcatttggttgccattttcctgtgaagagggtagagaatatgcacccagtcaggaaaacaactcacgaggcaaaaaagtacatctcgtggatggagcagggcgaagtggttacaagtacagactctggagccagactgcctgggtttgaattgtgcggtttcagatttctgcctggcagattaaccaacggcaagagaggctgatctgtctacattctgagtactgcccttggcaagacacctagaacagaccctggacccaagtctaccgtactaccatacccctactccagcccaccccagacagtattctggggttcacctgaggtcagcagtgtgaagatgaccagtgcctttttagcatgacgactttggaccatgtgattgccacccaccagtcagaatgggtctccttcaatgaagagccaccctttcctgcccactcgcaggggggcacggaagagcacctcccaggactgtcatcttccccagaccagtccgagagctcctccggggagaaccatgtggtggatggaggctctcaagaccattcccactcggagcaggatgactcctctgaaaagatgggcctcatctctgaagcagcttccccacctgggagccctgagcagcccccacctgacctggcctcggccatcagcaactgggttcagtttgaagatgacacaccctgggccagcacatctccacctcatcaggaaacagctgagacagccctaccattgaccatgccctgctggacatgcccttcctttgactccctggggagatgccctctgacttctgagagcagctggaccacccattctgaagacaccagcagtcctagctttggatgttcgtatacagatctgcagctcatcaatgctgaggagcagacgagtggccaggcttctggggctgactcaactgacaattcctcctcgcttcaagaagatgaagaagtagagatggaggccatcagctggcaggccagcagtccagccatgaatgggcaccctgcccctccagtgacctctgctcgttttcccagctgggtcacctttgatgacaatgaagtcagctgccctttaccaccagtcacctctcctctgaagccaaatacaccaccaagtgcatctgtgatcccagatgtaccttataattcaatgggatcatttaagaagagggaccgtcccaagagcactttgatgaacttctccaaagttcagaagctggatatttcctctttaaaccgcacgccttctgtaactgaggcttcaccttggagggcaaccaaccctttcctgaatgagactctgcaggatgtacagccctcccctatcaaccctttcagtgctttctttgaggagcaggagaggcgctcccaaaacagttccatttccagtaccacgggcaaaagccaaagagattccctcattgtcatctaccaggatgccatcagttttgatgattcaagcaaaacccagtcacactctgatgctgttgaaaaactcaaacaactccaaattgatgaccctgatcactttggcagtgcaactctacctgatgatgacccagtagcctggattgaactagatgctcacccgcctggatcagcacggtcccagcctcgtgacgggtggccaatgatgttgaggatccctgagaagaaaaacatcatgtcctccaggcactggggaccgatcttcgtcaaactgacagacactggttacctgcagctgtattatgagcagggcctagaaaaaccattccgtgagttcaagctggagatctgtcatgagatttcagaaccccggcttcaaaactatgatgagaatggcagaatccacagcttgcggatagaccgtgtcacctataaagagaagaagaaataccagcccaaacctgctgtggcccacacagcagagagggaacaggtgattaagctgggcaccaccaattacgatgacttcctgagtttcatccatgcagttcaggaccgtctcatggatctgccagtgttgtcaatggacttgagcacagttggcctcaactaccttgaagaggagattacagtggatgtcagagatgaattctctggcattgtgagcaaaggagacaaccagattctccagcaccatgtcttgacacggatccacatcctgagtttcctgtctgggctcgcagagtgccgcctgggcctcaatgacatcctcgtcaaagggaatgaaatagttttgaggcaggacatcatgcccaccaccaccacaaagtggatcaagctccatgagtgccgtttccatgggtgtgtggatgaggatgttttccacaactcacgggtcattctgttcaaccctttggatgcgtgccggtttgagctaatgcggttcaggacagtgtttgctgagaagaccttgcctttcacactcaggacggccacaagtgtcaatggggcagaggtggaggtgcagagctggctgaggatgtcaactggcttctccgccaatcgtgaccccctcactcaggttccctgtgagaatgtgatgatccgttaccctgtgcccagtgagtgggtgaaaaacttccgcagggaaagtgtcctgggggaaaagtctttgaaagccaaagtgaaccggggggcaagttttggctccactagtgtttctggctctgagcctgtcatgagagtaactctgggaactgccaagtacgagcatgccttcaactccattgtgtggaggataaaccgactgccggacaaaaactcagcttccggtcacccacactgtttcttttgccaccttgaactcggctctgaccgggaagtgccttccagatttgccaatcacgtgaatgtcgagttcagcatgcccacaacttctgcctccaaagccagcgtgagatctatctctgtagaagacaagactgacgtcaggaagtgggtcaattattctgcacactacagctaccagacaacagaaacagacaaccttccaaatcctctatattgcagttgccttccacacacagatttaaaaagaggatcaaagagggtggtgaagatcaggtggaatgcttctttggaagttccactggcatcatctatcagaacaatggtgtgagcatgaagaggcacagacaggtctccaaaatagatgttaggatttgggtgctacctgacacagaagtaggtctaaccctccaagtactggggatgataggataatcaatgaggtatatatatatttgtcattttgtataaaatattgtgaaaattgaaggaggacactcagtaaacatcctgggactatttgtaagttatggcaaaaccagatgagagaaaagggacagtcccctctgtatcctcgttgtctcttagtaacatcaaattgtagttaaaaaaattttaaactatgtacaagctacaaaatagcatctctttcatggtatgtttgagtgtgtaattttagtttcttttctggttgtatttgtggtagtcagatgtgttggattgattccaactggacagagtaaggaattccagcatcctcttcctgcttgctcgtgttaccccacagatcaaaccctcaattctagttggggatgctgtctagccccacaccatgactgaagccttaagcactgttgcgcctccatgtgctttggatcagcaaccccagtggtattctaccagagcattgtgggaaagcagatgtatagtcaggtcccaacagcaaattgttgggtgtgagagttctaaagtataggggtgagggaagagaaggatatgaactcctctgaccttaagccagcattcatttaacttttatgtctacttaacaagagaacctggagaaaactaccgtattcaagagattaatcaaaatcagtgttttagccaggcgatgacagagaagcaccattcctcaccctccattcttgtaatgtctgtaataaatttcagtgcgtcaggatggatgaacccaagatccagtgaatgattcagctgttccaagccttacattttccatcattcatcatccattctcattcagtgtaacctcttgcactattgtggttaattttatgtaaaaccagtttatgtttttttttttttaatatgtgcctatgtaataaagtctacacactggctatctctgtagaggtgaggttttgtttttagttgttctactgattatatccttttctgagctatgaaaatgaattattaataaaaaatttttgaac

SEQ ID NO: 20901 - DNA, 686 bp, Homo sapiens
  ENST00000553821
ggaggataaaccgactgccggacaaaaactcagcttccggtcacccacactgtttcttttgccaccttgaactcggctctgaccgggaagtgccttccagatttgccaatcacgtgaatgtcgagttcagcatgcccacaacttctgcctccaaagccagcgtgagatctatctctgtagaagacaagactgacgtcaggaagtgggtcaattattctgcacactacagctaccaggtggaaattgagcaaaaaaagagtttgaagccggactttgaaggagatgaaatggaaaatcccaaggagtgtggagtgcagtgacaaagccttgcggcaaggaatcctgatcccagagtcatgatagggtgtcttcctgagtcatgatagggtgtcttcctgagtagctgaagttgcagtcaatacctgctgtggccactgcatgttgggaacagtataccagatcttcctgtttgcagttacttgtattttaccaggaaaccctgagaatggtggcttttggagaggctctttgattctggtcatgcctaaagcacgaggttcacctgactgttggagcttactgtataattaagcctccttgtcttgtctctgcttatctcacagcactggtatgtggtttgttgtgactgttacagtcaggaaaagaacctcccacatcagtgttag

SEQ ID NO: 20902 - DNA, 2362 bp, Homo sapiens
  ENST00000555284
tccctcattcctatacttcagttttccttacctctagagcccctgaacagtagctcatatgttctccttttccttttagacaattcctcctcgcttcaagaagatgaagaagtagagatggaggccatcagctggcaggccagcagtccagccatgaatgggcaccctgcccctccagtgacctctgctcgttttcccagctgggtcacctttgatgacaatgaagtcagctgccctttaccaccagtcacctctcctctgaagccaaatacaccaccaagtgcatctgtgatcccagatgtaccttataattcaatgggatcatttaagaagagggaccgtcccaagagcactttgatgaacttctccaaagttcagaagctggatatttcctctttaaaccgcacgccttctgtaactgaggcttcaccttggagggcaaccaaccctttcctgaatgagactctgcaggatgtacagccctcccctatcaaccctttcagtgctttctttgaggagcaggagaggcgctcccaaaacagttccatttccagtaccacgggcaaaagccaaagagattccctcattgtcatctaccaggatgccatcagttttgatgattcaagcaaaacccagtcacactctgatgctgttgaaaaactcaaacaactccaaattgatgaccctgatcactttggcagtgcaactctacctgatgatgacccagtagcctggattgaactagatgctcacccgcctggatcagcacggtcccagcctcgtgacgggtggccaatgatgttgaggatccctgagaagaaaaacatcatgtcctccaggcactggggaccgatcttcgtcaaactgacagacactggttacctgcagctgtattatgagcagggcctagaaaaaccattccgtgagttcaagctggagatctgtcatgagatttcagaaccccggcttcaaaactatgatgagaatggcagaatccacagcttgcggatagaccgtgtcacctataaagagaagaagaaataccagcccaaacctgctgtggcccacacagcagagagggaacaggtgattaagctgggcaccaccaattacgatgacttcctgagtttcatccatgcagttcaggaccgtctcatggatctgccagtgttgtcaatggacttgagcacagttggcctcaactaccttgaagaggagattacagtggatgtcagagatgaattctctggcattgtgagcaaaggagacaaccagattctccagcaccatgtcttgacacggatccacatcctgagtttcctgtctgggctcgcagagtgccgcctgggcctcaatgacatcctcgtcaaagggaatgaaatagttttgaggcaggacatcatgcccaccaccaccacaaagtggatcaagctccatgagtgccgtttccatgggtgtgtggatgaggatgttttccacaactcacgggtcattctgttcaaccctttggatgcgtgccggtttgagctaatgcggttcaggacagtgtttgctgagaagaccttgcctttcacactcaggacggccacaagtgtcaatggggcagaggtggaggtgcagagctggctgaggatgtcaactggcttctccgccaatcgtgaccccctcactcaggttccctgtgagaatgtgatgatccgttaccctgtgcccagtgagtgggtgaaaaacttccgcagggaaagtgtcctgggggaaaagtctttgaaagccaaagtgaaccggggggcaagttttggctccactagtgtttctggctctgagcctgtcatgagagtaactctgggaactgccaagtacgagcatgccttcaactccattgtgtggaggataaaccgactgccggacaaaaactcagcttccggtcacccacactgtttcttttgccaccttgaactcggctctgaccgggaagtgccttccagatttgccaatcacgtgaatgtcgagttcagcatgcccacaacttctgcctccaaagccagcgtgagatctatctctgtagaagacaagactgacgtcaggaagtgggtcaattattctgcacactacagctaccaggtagccttgggaagcatctggctaatgcttccaactccatttgttcaccccactaccctccccctcttattccttttagccatgcttactatgttcgcctggtaacctcttactgccttagaggaagttcaccatacatagctgtgggtgcgtctgctctgatttaaatgcataatctggctagtggatgagagaaaggttggaaaaaaataaagaggctcatcaaagaggagaatataat

SEQ ID NO: 20903 - DNA, 2977 bp, Homo sapiens
  ENST00000267540
cagatttctgcctggcagattaaccaacggcaagagaggctgatctgtctacattctgagtactgcccttggcaagacacctagaacagaccctggacccaagtctaccgtactaccatacccctactccagcccaccccagacagtattctggggttcacctgaggtcagcagtgtgaagatgaccagtgcctttttagcatgacgactttggaccatgtgattgccacccaccagtcagaatgggtctccttcaatgaagagccaccctttcctgcccactcgcaggggggcacggaagagcacctcccaggactgtcatcttccccagaccagtccgagagctcctccggggagaaccatgtggtggatggaggctctcaagaccattcccactcggagcaggatgactcctctgaaaagatgggcctcatctctgaagcagcttccccacctgggagccctgagcagcccccacctgacctggcctcggccatcagcaactgggttcagtttgaagatgacacaccctgggccagcacatctccacctcatcaggaaacagctgagacagccctaccattgaccatgccctgctggacatgcccttcctttgactccctggggagatgccctctgacttctgagagcagctggaccacccattctgaagacaccagcagtcctagctttggatgttcgtatacagatctgcagctcatcaatgctgaggagcagacgagtggccaggcttctggggctgactcaactgacaattcctcctcgcttcaagaagatgaagaagtagagatggaggccatcagctggcaggccagcagtccagccatgaatgggcaccctgcccctccagtgacctctgctcgttttcccagctgggtcacctttgatgacaatgaagtcagctgccctttaccaccagtcacctctcctctgaagccaaatacaccaccaagtgcatctgtgatcccagatgtaccttataattcaatgggatcatttaagaagagggaccgtcccaagagcactttgatgaacttctccaaagttcagaagctggatatttcctctttaaaccgcacgccttctgtaactgaggcttcaccttggagggcaaccaaccctttcctgaatgagactctgcaggatgtacagccctcccctatcaaccctttcagtgctttctttgaggagcaggagaggcgctcccaaaacagttccatttccagtaccacgggcaaaagccaaagagattccctcattgtcatctaccaggatgccatcagttttgatgattcaagcaaaacccagtcacactctgatgctgttgaaaaactcaaacaactccaaattgatgaccctgatcactttggcagtgcaactctacctgatgatgacccagtagcctggattgaactagatgctcacccgcctggatcagcacggtcccagcctcgtgacgggtggccaatgatgttgaggatccctgagaagaaaaacatcatgtcctccaggcactggggaccgatcttcgtcaaactgacagacactggttacctgcagctgtattatgagcagggcctagaaaaaccattccgtgagttcaagctggagatctgtcatgagatttcagaaccccggcttcaaaactatgatgagaatggcagaatccacagcttgcggatagaccgtgtcacctataaagagaagaagaaataccagcccaaacctgctgtggcccacacagcagagagggaacaggtgattaagctgggcaccaccaattacgatgacttcctgagtttcatccatgcagttcaggaccgtctcatggatctgccagtgttgtcaatggacttgagcacagttggcctcaactaccttgaagaggagattacagtggatgtcagagatgaattctctggcattgtgagcaaaggagacaaccagattctccagcaccatgtcttgacacggatccacatcctgagtttcctgtctgggctcgcagagtgccgcctgggcctcaatgacatcctcgtcaaagggaatgaaatagttttgaggcaggacatcatgcccaccaccaccacaaagtggatcaagctccatgagtgccgtttccatgggtgtgtggatgaggatgttttccacaactcacgggtcattctgttcaaccctttggatgcgtgccggtttgagctaatgcggttcaggacagtgtttgctgagaagaccttgcctttcacactcaggacggccacaagtgtcaatggggcagaggtggaggtgcagagctggctgaggatgtcaactggcttctccgccaatcgtgaccccctcactcaggttccctgtgagaatgtgatgatccgttaccctgtgcccagtgagtgggtgaaaaacttccgcagggaaagtgtcctgggggaaaagtctttgaaagccaaagtgaaccggggggcaagttttggctccactagtgtttctggctctgagcctgtcatgagagtaactctgggaactgccaagtacgagcatgccttcaactccattgtgtggaggataaaccgactgccggacaaaaactcagcttccggtcacccacactgtttcttttgccaccttgaactcggctctgaccgggaagtgccttccagatttgccaatcacgtgaatgtcgagttcagcatgcccacaacttctgcctccaaagccagcgtgagatctatctctgtagaagacaagactgacgtcaggaagtgggtcaattattctgcacactacagctaccaggtagccttgggaagcatctggctaatgcttccaactccatttgttcaccccactaccctccccctcttattccttttagccatgcttactatgttcgcctggtaacctcttactgccttagaggaagttcaccatacatagctgtgggtgcgtctgctctgat

SEQ ID NO: 20904 - DNA, 564 bp, Homo sapiens
  ENST00000556280
gtggacattttaatagataggcacctctgactaattgaaatgtagcttaagtgtcaagatagctttgtaatagaccaaggtgatgttttgtctcaaaacaaacaaaaagagaccctttatttaaaggagttcagtgtggaacggaagatgcaaggtggggtttgaggaaaagagttacaagagccaatgagatgaaaatgccattgtttttcctaatgtggtgtcaaggcagaaccatctctggggatgtcaggaagtcatcctgcagtcgtgaaaggatgaggactgaaatccgtgaagacaattcctcctcgcttcaagaagatgaagaagtagagatggaggccatcagctggcaggccagcagtccagccatgaatgggcaccctgcccctccagtgacctctgctcgttttcccagctgggtcacctttgatgacaatgaagtcagctgccctttaccaccagtcacctctcctctgaagccaaatacaccaccaagtgcatctgtgatcccagatgtaccttataattcaatgggatcatttaagaagagggaccgtc

SEQ ID NO: 20905 - DNA, 1606 bp, Homo sapiens
  ENST00000555226
ctctctttgcctgctgccatccatgtaagatgtgacttgctcctccttcccttctgccatgattgtgaggcttccccagccatgtggaactatttctgcctggcagattaaccaacggcaagagaggctgatctgtctacattctgagtactgcccttggcaagacacctagaacagaccctggacccaagtctaccgtactaccatacccctactccagcccaccccagacagtattctggggttcacctgaggtcagcagtgtgaagatgaccagtgcctttttagcatgacgactttggaccatgtgattgccacccaccagtcagaatgggtctccttcaatgaagagccaccctttcctgcccactcgcaggggggcacggaagagcacctcccaggactgtcatcttccccagaccagtccgagagctcctccggggagaaccatgtggtggatggaggctctcaagaccattcccactcggagcaggatgactcctctgaaaagatgggcctcatctctgaagcagcttccccacctgggagccctgagcagcccccacctgacctggcctcggccatcagcaactgggttcagtttgaagatgacacaccctgggccagcacatctccacctcatcaggaaacagctgagacaggtgaggaggtaggaagggcccggcttgggtttgtggtcagcagggatgcttttcagtgagaggtctatagggctgccaggattccatttcatctgccccctaaccctgaagcactggtcgcataggggagagcagacggagttctcatctggtttaattctgtaacttgtttttgttgacataagcatacaaaagaatgtatgtgttctaggacatttctagtcctttactcttgtccctggctgttgacttgtctttaaaataatgcatatatatttttctattagggattggaattatatttactcagcccctaaactgtaagcaccttacatacagaaatgaatgtttctgctgggtgcggtggctcatgcctataatttcatcactttgagaggccgagaagggtggctcacttgaggtcaggagtttgagacccacctggctaacacggagaaaccccgtctctgccaaaaatacaaaaattagctgggcgtggtcgtgcacttctgtaatcccagccactcaggaggctgaggcatgtgaattgctgaacctgggagcggaggttgcagtaagctgaggtcgcgccactgcactccaggctgggtgacagagctagactctgtctccaaaaaataaaaacagaaatgaatgtgtgttaaagtgtggaccactgaccatgtctaaccaagtcaccaataggatttgttaaacatggatattctcacacttcagaactcttgaatccaaatcctcatgggtagggatggttgttcatgagaaatctcttattttgtggcatttcaatggccagaagctgcactggggagcttagtaaagctgtaggacttgttagtccccatcctggtgacctggctacttctttattgtgcactgaagtatgccacaggtgattggataagctttgggactgtattagt

SEQ ID NO: 20906 - DNA, 603 bp, Homo sapiens
  ENST00000557055
gagtctggagccggcgtcggcgctgcggccgggagggatcgtggcgagagcagtgcggccgggtgggtatcccgcggccagagaagccggctttgccgcggcgacctttcggcggacgccggggaccctgcggaccgcggcgcaggaaaacaactcacgaggcaaaaaagtacatctcgtggatggagcagggcgaagtggttacaagtacagactctggagccagactgcctgggtttgaattgtgcggtttcagatttctgcctggcagattaaccaacggcaagagaggctgatctgtctacattctgagtactgcccttggcaagacacctagaacagaccctggacccaagtctaccgtactaccatacccctactccagcccaccccagacagtattctggggttcacctgaggtcagcagtgtgaagatgaccagtgcctttttagcatgacgactttggaccatgtgattgccacccaccagtcagaatgggtctccttcaatgaagagccaccctttcctgcccactcgcaggggggcacggaagagcacctcccaggactgtcatcttccccagaccagtccgagagctcctc

SEQ ID NO: 20907 - DNA, 439 bp, Homo sapiens
  ENST00000554710
ctagcgccgctgtgccccctggcgcccccgagcctgcctggtcgagccacgcggaggcgcggcgtttccaccagccgcgggcgtcccggggtgggggaggacgaggggactctgcttaaggaaaacaactcacgaggcaaaaaagtacatctcgtggatggagcagggcgaagtggttacaagtacagactctggagccagactgcctgggtttgaattgtgcggtttcagatttctgcctggcagattaaccaacggcaagagaggctgatctgtctacattctgagtactgcccttggcaagacacctagaacagaccctggacccaagtctaccgtactaccatacccctactccagcccaccccagacagtattctggggttcacctgaggtcagcagtgtgaagatgaccagtgcctttttagcatgacgactt

SEQ ID NO: 20908 - DNA, 2964 bp, Homo sapiens
  ENST00000614646
cagatttctgcctggcagattaaccaacggcaagagaggctgatctgtctacattctgagtactgcccttggcaagacacctagaacagaccctggacccaagtctaccgtactaccatacccctactccagcccaccccagacagtattctggggttcacctgaggtcagcagtgtgaagatgaccagtgcctttttagcatgacgactttggaccatgtgattgccacccaccagtcagaatgggtctccttcaatgaagagccaccctttcctgcccactcgcaggggggcacggaagagcacctcccaggactgtcatcttccccagaccagtccgagagctcctccggggagaaccatgtggtggatggaggctctcaagaccattcccactcggagcaggatgactcctctgaaaagatgggcctcatctctgaagcagcttccccacctgggagccctgagcagcccccacctgacctggcctcggccatcagcaactgggttcagtttgaagatgacacaccctgggccagcacatctccacctcatcaggaaacagctgagacagccctaccattgaccatgccctgctggacatgcccttcctttgactccctggggagatgccctctgacttctgagagcagctggaccacccattctgaagacaccagcagtcctagctttggatgttcgtatacagatctgcagctcatcaatgctgaggagcagacgagtggccaggcttctggggctgactcaactgacaattcctcctcgcttcaagaagatgaagaagtagagatggaggccatcagctggcaggccagcagtccagccatgaatgggcaccctgcccctccagtgacctctgctcgttttcccagctgggtcacctttgatgacaatgaagtcagctgccctttaccaccagtcacctctcctctgaagccaaatacaccaccaagtgcatctgtgatcccagatgtaccttataattcaatgggatcatttaagaagagggaccgtcccaagagcactttgatgaacttctccaaagttcagaagctggatatttcctctttaaaccgcacgccttctgtaactgaggcttcaccttggagggcaaccaaccctttcctgaatgagactctgcaggatgtacagccctcccctatcaaccctttcagtgctttctttgaggagcaggagaggcgctcccaaaacagttccatttccagtaccacgggcaaaagccaaagagattccctcattgtcatctaccaggatgccatcagttttgatgattcaagcaaaacccagtcacactctgatgctgttgaaaaactcaaacaactccaaattgatgaccctgatcactttggcagtgcaactctacctgatgatgacccagtagcctggattgaactagatgctcacccgcctggatcagcacggtcccagcctcgtgacgggtggccaatgatgttgaggatccctgagaagaaaaacatcatgtcctccaggcactggggaccgatcttcgtcaaactgacagacactggttacctgcagctgtattatgagcagggcctagaaaaaccattccgtgagttcaagctggagatctgtcatgagatttcagaaccccggcttcaaaactatgatgagaatggcagaatccacagcttgcggatagaccgtgtcacctataaagagaagaagaaataccagcccaaacctgctgtggcccacacagcagagagggaacaggtgattaagctgggcaccaccaattacgatgacttcctgagtttcatccatgcagttcaggaccgtctcatggatctgccagtgttgtcaatggacttgagcacagttggcctcaactaccttgaagaggagattacagtggatgtcagagatgaattctctggcattgtgagcaaaggagacaaccagattctccagcaccatgtcttgacacggatccacatcctgagtttcctgtctgggctcgcagagtgccgcctgggcctcaatgacatcctcgtcaaagggaatgaaatagttttgaggcaggacatcatgcccaccaccaccacaaagtggatcaagctccatgagtgccgtttccatgggtgtgtggatgaggatgttttccacaactcacgggtcattctgttcaaccctttggatgcgtgccggtttgagctaatgcggttcaggacagtgtttgctgagaagaccttgcctttcacactcaggacggccacaagtgtcaatggggcagaggtggaggtgcagagctggctgaggatgtcaactggcttctccgccaatcgtgaccccctcactcaggttccctgtgagaatgtgatgatccgttaccctgtgcccagtgagtgggtgaaaaacttccgcagggaaagtgtcctgggggaaaagtctttgaaagccaaagtgaaccggggggcaagttttggctccactagtgtttctggctctgagcctgtcatgagagtaactctgggaactgccaagtacgagcatgccttcaactccattgtgtggaggataaaccgactgccggacaaaaactcagcttccggtcacccacactgtttcttttgccaccttgaactcggctctgaccgggaagtgccttccagatttgccaatcacgtgaatgtcgagttcagcatgcccacaacttctgcctccaaagccagcgtgagatctatctctgtagaagacaagactgacgtcaggaagtgggtcaattattctgcacactacagctaccagacaacagaaacagacaaccttccaaatcctctatattgcagttgccttccacacacagatttaaaaagaggatcaaagagggtggtgaagatcaggtggaatgcttctttggaagttccactggcatcatctatcagaacaatggtgtga

SEQ ID NO: 20909 - DNA, 807 bp, Homo sapiens
  ENST00000513034
atgcctgggaagatggagaagtttctgcagatcgcgcctcactccctggccatcgtcctgggcccggcagaggcgccggcgggggaaaggccaggggcagcccggcccgcgcccccggcccagccccgccagctcgcccggcaccacatcggctacgagatcttcgccgacttcaaagccgagaacatgcagcacttctggaacaagaaggtcacggccgcggtggccgagaccttcttcctgggctggatcgacgagcaggtcctgctgatccagggcaaggaggaacatctggaggcgctgcgcgaaggctggacgcgccgggccctgcggccgccctcgggcttccacatccgctgcctgggtgatgtatcacccatcagtatgtctcccatcagtcagtctcagtttattccactcggggagatcctctgcttggccatctcagcaatgaactcggcaagaaagcctgtcacccaagaagcactgatggagcacctgaccacgtgcttcccagtactcgggagagcctggcttccaacacatcaagcattgttgaaagtaaccgtcgtcagaaccccgctttgagcccggcccatggtggagctggtccagccttcaacttccgagcgagcgcggagcccccgacaaatgaagctgagaagctacagaaaccttccaactgcttgcaagcttctgttactagcgtgtgattgtccttctgcctcagatcttctgtctcattcgatacagcaaagtttacgacactgggactgatgtttacatctttggaaagacaagcatctc

SEQ ID NO: 20910 - DNA, 496 bp, Homo sapiens
  ENST00000511250
agagcaaccagggaagggacgaaatgtctgaaggtagaaatgaattgcattaggatttattttaatgcagcctggaaacacacaactttaaatctctgggctgcttaaggagatcccacacctttccttggagggaaaaagaaaaagaggattgaaaaatatacagactacagctatctttaatgtttaagttagctatcaggaaactcgaaatagtgaatgtaataaaatgttgacagcagtttcacttaacatgcggtaactctggactagaacgacatctttggcaccaaaggaaatcgagagaataaaagcagcagtcgtcaggatttgaaggaagccacagattattaccatctgtacattttacagacctcttacaaaaaccagaaacccaggacccagactggagtgtgatgtatcacccatcagtatgtctcccatcagtcagtctcagtttattccactcggggagatcctctgcttggccatctca

SEQ ID NO: 20911 - DNA, 10458 bp, Homo sapiens
  ENST00000308497
gcagcgtagcgggctggcggtgacttacaccgggactccagagggagagaggaagcgctgcaggccacttgcattgcgtcttccaggctgcgtggacccggcgccccggcgtgtgcggttgtgggggagctcgccgtggcctcccctccctctggctttagcttcctttggggttggcgcaggtgggccaggcagcgcaccgcagatctccccgttcccacgaaggctggctcgctgtctctctccgagcgggagggaccatcctaaaaatatgtaaatatccaagcgctggctccaggctggggcagctgccaaggtccccgcgccgccgccgggtgttttacatgaaaatgagaagcctgatgggaaccgcgttctaacttaaggcagcctggtgattagcatgagactgggcggctgtcctgcttcctgcccttcaatagccgttccgcgcgctcgcgccggagcagcgctgccgccgcgcgggggtcgatcgcaggctcggcgtccttggcagccatggctccggcgccgcctcggccagtaagtaggagcatgcatgtgtagggggcacatgcgtgtcggcgcacccacccagccatccacccgcgcgcacgcacagcgcccggagcctcggcaaggggaagattgacgaggcgctgcagtcgcggggacgacgcgggctcttcctggattccgcaggagcccgcccgccgcagctgctgtctgcagagcctgctcggatcctgtgcacacgcgccccccgctcgagcctctgtgatgaagactgtctcccggggactgcagcggaggcagagccagccagcgccggggactgcgggccgtgcggctgataggcccgcggggacacgactcggacactgtcatccccacgcctcgcgctgagctgcccggcgcggagggtctgccgccgcccctccggcctcccgcacgcccgatcccgggtcagccccggaggcctcggctgcctcatttgtttgggtcttttgtgccgtggctcccagttggccaagcactcctgcgctgaatcgggccattgtctgcgctcccattgccttcacgctgcaagtctcggcgcccccaccccgcccgccccctccccgcctcctcccggccggggagcctcctaacgtgcctttccccccaggaatctggaagctataagccgggcggattgcaaatgaagtgtaatgcattgtgggacgtgtgtaaaatcggagccttcgccgtgggggtgtgggggggcgtggggagggccggacccgccgctggcggtgtagacgccgacgaggaggggctgggaaaatgtgcgcagagtccgcccgggtcgtgcccgccgtagacggatgaaggagcgcgctgcgccccggcgctgaggccccgaggatcggggcggcaggtcgccctccccaccatgaagaagacccggagcacaaccttgcggcgagcctggcctagctcggatttctcggaccgggcctcggaccgcatgaggtcccgcagcgagaaggactaccgcctgcacaagcgtttccccgcggccttcgcgccccaggcttcgcggggctacatgacatcaggtgatgtatcacccatcagtatgtctcccatcagtcagtctcagtttattccactcggggagatcctctgcttggccatctcagcaatgaactcggcaagaaagcctgtcacccaagaagcactgatggagcacctgaccacgtgcttcccaggtgttccaacgccaagccaagaaattctgcggcacacgctgaacacgctggtacgggagaggaagatctacccaactccagatggctacttcatcgtgaccccacagacttatttcataactccttccctcataagaactaacagtaaatggtaccatttggacgagaggatacctgaccggtctcagtgcacctctccgcaacccgggaccatcacgccctctgcctcaggctgtgtcagggaaaggacattgccccgaaaccactgcgactcttgccactgctgcagagaagacgtgcacagcacgcatgcacccaccctgcaaaggaagtctgccaaggactgcaaagacccttactgtcccccttctctgtgccaggtgccacccactgaaaagagcaaaagtactgtaaatttttcctataagacagaaactctctcaaaacctaaagatagtgaaaagcagtcaaaaaaattcgggctaaagttattccggttaagttttaaaaaagacaagaccaaacagctggccaatttttctgcccagtttcctcctgaagagtggcccctgcgagacgaggacacgccagctacgatccctcgggaagtagagatggaaatcattaggcgcattaacccagacctgaccgtggaaaatgtcatgcggcacaccgcgctcatgaagaaactggaagaagaaaaggcccagaggagtaaagccgggtcctctgcccatcacagcggaaggagtaaaaagagtaggactcatcggaagtcccatggaaagtctcggtctcacagcaagacacgggtgtctaaaggagacccttccgacggttcacatctggatatcccagctgaaagagagtatgacttttgtgatcctcttaccagggtgcccagggagggctgcttcatcattgaacacaaaggagataacttcatcatgcacagcaacacaaacgtgctcgagtcccacttccccatgacaccagaatgggatgtgtctggtgaattggctaaaaggagaactgagatgccttttcctgaaccttctaggggaagctcccactcaaaagtgcaccgaagccacagccatacacaggaccggaggtccaggaatgagagatccaacaaagccaaggagagatccaggtcgatggataactccaaaggccctctgggtgcttcttctctagggacgccggaagaccttgctgaaggctgcagccaagacgaccagacccccagccaatcctacattgacgacagtactttaaggcctgcacagaccgttagtctccaaagggctcacatttcgtccacaagctataaagaggtgtgtattccagagatagtcagtggcagcaaggaaccgtccagcgcttgcagccttttggagccaggaaaaccacccgagagtttgccatcctatggcgaactcaactcttgtccaacaaaaacagccacagatgactatttccagtgcaacacctctagtgagacggtgctcacggcaccatcacctctgggaaagaataaggaggaccatgacactctgactttggcagaaggggtgaaaaagctctccccttctgataggcaggtcccccactcctccagggagcctgtggggcacaaggaggagtcaccaaaagggccgggtgggggccccgctgcttcgggaggagtggctgaagggatcgccaacggacgcctcgtccagcaccatggtgccgagcccagcagcttggacaagaggaaagagatatttagcaaagacacactgttcaaacctcttcacagcaccttgtctgtaaacagctatcacaagtcgagcctgtccctcctcaaatctcacccgaagacacctgctgacacattgccaggccgatgtgagaaactggaaccgtccctggggacctcggcggcacaagccatgcctgcttcccagcgtcagcaggagtcaggagggaaccaggaagcctcttttgactattacaacgtctctgatgatgacgactctgaggaaggggcaaacaagaacacagaggaggagaaaaatagagaggacgtaggcaccatgcagtggctcctcgagcgggagaaggaaagagacttgcagaggaaatttgaaaagaacctcacccttcttgctccaaaagaaaccgacagcagcagcaaccagagagccacccattcagcccggctcgacagcatggacagcagcagcatcacagtggacagtggattcaactccccacgtactcgggagagcctggcttccaacacatcaagcattgttgaaagtaaccgtcgtcagaaccccgctttgagcccggcccatggtggagctggtccagccttcaacttccgagcgagcgcggagcccccgacaaatgaagctgagaagctacagaaaccttccaactgcttgcaagcttctgttactagcgtgtgattgtccttctgcctcagatcttctgtctcattcgatacagcaaagtttacgacactgggactgatgtttacatctttggaaagacaagcatctcaaccacagtttttgtgtttacttaaactgtgctgctaagtagggctagggcaaaaaaacaaaaaatctttatttcagagtattgcttttcacatttatggctctgtagcaactgagtaacagtaggggtgatatgtatacttttgcttcactaattgtatctgagcacacataggaaagtctagacactgtaagtgtaatacgcattttcaatgtcatgcagttgccaattccattttaaaatgccacagatgcgtgttgctcccagtctgtggttaaacggtgccacagaactgatccttgacacttccaaaaaaaaaaaaacaaaacaaaacaaaaaaaatttaaaaaaaaaaaacaaaaaacaaaactaagctaccacgaaatgtcaaatgcaagggtccaccttgagggaaatagatgccaaactaactagaagggaccccggccctttgtgtgtgaattgtttatgcaccagtcatttttcactgtgagttttcgtgacactattttgcaggagcccatggaagtgtgtgagaaggggtcgcaatggagatcactgggagtgaatgttttcagggttttgttttgaagtgtcacagatgcttgtctgatttttttaaccttccgtgatcacaaacaggaatataggcctttgaatctgaagtggacaaaggaaagcaatttccagtctggctggggcacagcattaggtgattgaaaaggtgatgtggacttgtaaaaggtgttactcaaatattgaaggaagagaatttcctccttgtgatacttaggatgaccctatcttactctaatagatacaataattagtttgtttaaaagcaaaatgttctttgtgatacaaatgaagagtagggcctgaggatgttattctttctaatggaaggacataaatctattttatgtagttttaaatagaatgcctaaattaggctgtgggagataatttttagtggttgtaggaaagagcaaatttagggagtgttgaacttcaggccttttattcctgggaagatatgtatagagaaaacttttaaaataatttttgattagaaatatacatgtgcccatgtaataaacaacagaatgtgctcattctgctagtgcggtataatccgaatttgtactcccctaaaatttatcagaataacaattatgcatacatgaactatgccagagtaatgtttacagatactttgtaaccaatttcaggaggcgtttttagctggatgtgtagttaattagaccaacttatttccaaatggtttgttaacattttgctttggtttacaatgtcatgttgaacacaaagaagacccagcagcaaagggatgaccaataatttcatcttatagcaaggagacattccaacgttcccatgttttattttctgagaacagtgggacagatctgtagtaatggaatattatttgcaaaagggttacatatgacacaagtaagtgttctgacataaagttttatttagttcagtggcatgtgctgttgggagccatacaccataaaatatatatatcccaaaataaatctagaatattttcacctccaatttcagtaattggcatatgatttgtgagacgcatctgtttttgtatgaggtttaatcactagcaatctgtttaaagaatccagtcctatacacagttggactcattcttgaaacctttaaatgctccctcatagtttttcagttatttggaagttgcattgggtcaaactgaactccttgagtttggtgtaaattccttttttctgcttattatagtgaaacttcagcatgtttcttagtaaactcccataccattgaaatgcttaagccagttggctttcagtctcatgccttatttcctccaaggcatgcctcaacgcattgtttgtctcattgcttaaatatgtccagaaggaatgatcatgtatctaatagactacatagttggttcccttggggagttatatatcatacagttactaaatatttgtctaaattcattttttccaaaaacctgctctcaaatttttcttctactctcagttcataaataatataaccattgaaacaacacatcagcctctagctgatcctctgaaagtagccattgaaataatcgaatactgtgtgaacaggaaaggaaagcgttacctttaagagaagctttaaaataggaatttattgatatttcacaagatataggtttacagaagacattattcaaataaatatgtacactatttgcctgatgctatggggtacataattttttaaaaactcccttagaccagcagccattagtgtagaaatgatggactttaaaggtgataccatgtaagcagatgttgcatataaaaatattcctgcctgaatctgatcgagattcttgaatgggggaggagtggcagccggcagcacattgcaaatgtcattcgaggtcacggtgaggctctcggtcccggaacagtgggggcctcgccaggcgttgccagtatccctttcctcctgtaaaatcatagctttgtgttacacgactgcttatccagtcttagggtttagcagctgaaaggtttacaaaactgaatctggttgaatctctgtgaaagggtcaacacatctgtcggcattttgcacacttatgtattattatgatacaacatattactttatggtaatttttatttttacatataactacctccataaatttgatgaaatggcagccgtgtgttaaagtgtatcgttcagaagagcaaagttgaacacttccttcaacattagggcatggcgtgctgtgtgtgtcagtgattgcctctgtggactcatgactttccatcgccatggctttctcttacgccgctgtttggctttcagatgtaatcctgtcttctcctctcttccccacgaaagcgcactcgattttgttaggaatgaacggaagtttaaaaattcttgtgcccacccccgccctccacccattcctgttaaaagttctctggcgaagagccaatgggtgaacgtaattgaaagagctatttactcttttggaaatctgatttgaagtctaagttttcagtaacagaagacacacaagcaatgtggactgccaagcttgaagcacttcgggctctgccttcactcgcatgctaccatgtcgagcccaaactccactttaattaaaagagctgtgctgtgaattccacaacttctgttaaataatttgtattccattatatatattttgcacatctcaggggaccataatgaacatatgaaaggggggggggtgccatcaaatagagaaaacaaatagaagaggtgaatggagactagctggataaaaataacaaattacttcttctctgatgttgtgaaggtcaggttcaggaagcatcaattcacagttaatccggagtaacaatgatctgaacaccagctgttcccaggtccctctttttcatagcccaaccagcatctaaaatgtaaatttaaattacattgcagtcaccatggggagaagaaacctgttcagtggaagcagaagcattgttccttttttaggttggcgcagctttgcaaaactctacccaggataaaccacttatcaccaccaagtgtacttgaaaataaagtttttaacttaaattacaagcatattgctcataatacaatagtgatcattttttgaaagtcttgccatttataacatgggcagtatttggagcttcatttaaaaaccaacaacaaccgataatgactttgcacgattcactttgggatctcaaagtgcttccaaagcattcagatttacaaacaattcacaagacaggtcatctttgtaatacgcatacttacaacgaattaacaaaaggagtgacttaagattctccaggaacacagtggcagctattgatgatctgttttctatctgtttgatagagcatcatgagaaatcacaaaatacaatgctatttttctgatgtgtgctaataaagtcaaagaaaacaaatacatcttgacacttttgtccattttcattaaaaaaaaaaaagttcagggtgtttggaattttacatctcagcacaccttactggtatcaatggataaagcgggtgattgacagatccacccaaatgccactgcagtcagaagcagatctggacacacccttgtttacagtttcatattgggttgctatagttcccgtgctaaatcaccagctttcaggaacatgactgctcctggcagtggaaggtgctgaaacagaaattttaattaaaaactttatcaagtactcttcacagtgctgcttggcaccatagaaaatcagtacaatatatcgagccctactttggaggagctggatttctgagggagctgatccagttctaagtgtcttctcgaattaggagatagatgatctttgatggggatctcctccgtcaccacaggccagtcacagaaccaactagccacgtgctgccagacctcagtgggcccaagcaggagcaatctcttctatcccccatctcccccaggaccatcccgcccattgtcaacgtcatccagggctcttctggtagtgagtgacttttctgcacatgtttagggcttgggggagctagaacacaggaaacatgaatgcaaaaggcatggaaaacactgttttgctttgggttagtaaaatgtgggcaggacaaagattactattggtctgagctttgccaagtgagatagaatcaactgtcaccccattcctttcccagaaggtcttatggtattaaggatacatccagtattttcccacagatttttattcaggcgatgtttcataaattacatatatgaaaacattcattattacatttccttgtgtgtttcaaacagacattggcaccttcctattgagttaattctctgcatcttttgcagcagcagcccacaaggagattcccagagatggctcccctaacacacagtcctgtgattttacagttctatgacttacagttgatgattcacaagattcaggattctacaagactcaagggggaactaaactttcttacgattgtacatgatcagttatagggctgtaatcattaattgttggcttcaaatgtggacacacacacacacacatcatgccaaggagggaatggggtgtttcaagtcaggcagcgatgattctggaaggttggaaatgtaaggttagaagcttggctggtcttagtaaacttgttcccttgctcccaccaagaagaggtaccaaatgtgagacctgagatctcctccaatatctgtcctctgcagttccgggaaactaatcatgaagtacacatgcagcagctcctccacttcctttcctccgaggtcctcctttccattctcccacctagatactgacacaccgccacggtttccacattggaagggcagaacactgtgcagtatcgtgcacacttgctgggttaggaatagagctgccctagggtcaccttcatgcaagtattgacagctacaaattaaagtccttagagcagttgacacagatactacgttctagaagagaattaaatttaaacgtcaagtttaaagggatcataattctgcaggtatctttctctgagtgactgaatgtgactattgcattagggtaaatgaattaagacgtgcaagtgggatttactgtatgttagaaaggagttttgcagccaagactgccttgaataaaatgtgtttgcactgaaaaaaaattttaaattacttggtctctggttgctgtaaaggtcatccaagatggatgttctgtttatattgtatagtatttcatatgaaataattacagttcatgaaatgtcttccctaatgttactgatttataacagcacatttgtaacatggtttttatcgtgtcagtgtaccatactgtaaatgatgattacttgtcatgcttagtataataacttaaaagaaaaaaaaggacagggatttttgtaagtctatatttgaaagtccctccctatggtgatactgtgttcatgttgtttatgtagtgttgtgtgaaatatccattttggattgtgttactttttaagatattaaataacatttggttata

SEQ ID NO: 20912 - DNA, 518 bp, Homo sapiens
  ENST00000512520
gaatgctcagcttgtctcaaggctgcaatgaggtgatgtatcacccatcagtatgtctcccatcagtcagtctcagtttattccactcggggagatcctctgcttggccatctcagcaatgaactcggcaagaaagcctgtcacccaagaagcactgatggagcacctgaccacgtgcttcccaggtgttccaacgccaagccaagaaattctgcggcacacgctgaacacgctggtacgggagaggaagatctacccaactccagatggctacttcatcgtgaccccacagacttatttcataactccttccctcataagaactaacagtaaatggtaccatttggacgagaggatacctgaccggtctcagtgcacctctccgcaacccgggaccatcacgccctctgcctcaggctgtgtcagggaaaggacattgccccgaaaccactgcgactcttgccactgctgcagagaagacgtgcacagcacgcatgcacccaccctgcaaaggaagt

SEQ ID NO: 20913 - DNA, 1055 bp, Homo sapiens
  ENST00000506529
ctcctccagggagcctgtggggcacaaggaggagtcaccaaaagggccgggtgggggccccgctgcttcgggaggagtggctgaagggatcgccaacggacgcctcgtccagcaccatggtgccgagcccagcagcttggacaagaggaaagagatatttagcaaagacacactgttcaaacctcttcacagcaccttgtctgtaaacagctatcacaagtcgagcctgtccctcctcaaatctcacccgaagacacctgctgacacattgccaggccgatgtgagaaactggaaccgtccctggggacctcggcggcacaagccatgcctgcttcccagcgtcagcaggagtcaggagggaaccaggaagcctcttttgactattacaacgtctctgatgatgacgactctgaggaaggggcaaacaagaacacagaggaggagaaaaatagagaggacgtaggcaccatgcagtggctcctcgagcgggagaaggaaagagacttgcagaggaaatttgaaaagaacctcacccttcttgctccaaaagaaaccgacagcagcagcaaccagagagccacccattcagcccggctcgacagcatggacagcagcagcatcacagtggacagtggattcaactccccacggaattgaaaaaaatgtttctgcacctgtagagatcaccaatctggactgtactcgggagagcctggcttccaacacatcaagcattgttgaaagtaaccgtcgtcagaaccccgctttgagcccggcccatggtggagctggtccagccttcaacttccgagcgagcgcggagcccccgacaaatgaagctgagaagctacagaaaccttccaactgcttgcaagcttctgttactagcgtgtgattgtccttctgcctcagatcttctgtctcattcgatacagcaaagtttacgacactgggactgatgtttacatctttggaaagacaagcatctcaaccacagtttttgtgtttacttaaactgtgctgctaagtagggctagggcaaaaaaacaaaaaa

SEQ ID NO: 20914 - DNA, 1698 bp, Homo sapiens
  ENST00000541731
gtcacttcctgccgatgccggtgtggacgctgtgaatcgtggctggcccggttctccgcttctccccatcccctactttcctccctccctccctttccctccctcgtcgactgttgcttgctggtcgcagactccctgacccctccctcacccctccctaacctcggtgccaccggattgcccttcttttcctgttgcccagcccagccctagtgtcagggcgggggcctggagcagcccgaggcactgcagcagaagagagaaaagacaacgacgaccctcagctcgccagtccggtcgctggcttcgccgccgccatggcaatgagacagacgccgctcacctgctctggccacacgcgacccgtggttgatttggccttcagtggcatcacgccttatgggtatttcttaatcagcgcttgcaaagcaaagtgtgggatgctgtctcaggagatgaattgatgaccctggctcataaacacattgtcaagactgtggatttcacgcaggatagtaattatttgttaaccgggggacaggataaactgttacgcatatatgacttgaacaaacctgaagcagaacctaaggaaattagtggtcatacttctggtataaaaaaagctctgtggtgcagtgaggataaacagattctttctgctgatgacaaaactgttcgactttgggatcatgctactatgacagaagtgaaatctctaaattttaatatgtctgttagtagtatggaatatattcctgagggagagattttggttataacttatggacgatctattgcttttcatagtgcagtaagtttggacccaattaaatcctttgaagctcctgcaaccatcaattctgcatctcttcatcctgagaaagaatttcttgttgcaggcggtgaagattttaaactttataagtatgattataatagtggagaagaattagaatcctacaagggacactttggtcctattcactgtgtgagatttagtcctgatggagaactctatgccagtggttcagaagatggaacattgagactatggcaaactgtggtaggaaaaacgtatggcctttggaaatgtgtgcttcctgaagaagatagtggtgagctggcaaagccaaagattggttttccagagacaacagaagaggagctagaagaaattgcttcagagaattcagattgcatctttccttcagctcctgatgttaaggcctgagcgtcaatcatatgtgcagttagtatacaactgactaaaacaagcaagcagagaaaagcatcagccttccagagttactgtctgcttaaggcagaaacagcagtaaataatgaggaaaatgaattagctccagtgctggaacaactaactaacttggtgttacctgtaagtgaaaactcaagtgtcagatgaagggaggtggagttatcctcttatagtacagtggcctgttatctttttaatgaatatatacaagccaacatccaatttctattattacaattagggttcttgtagctgtttatgttaatatggagaagaaaactatattggctgattttttctgatcttaaagcagaatgccttttctttttttgcttcagttgtaaagaagagggaatacatgataaagtaactggtttgatttctcgttcattgtacactgcctctgaacatctaattgt

SEQ ID NO: 20915 - DNA, 1442 bp, Homo sapiens
  ENST00000025399
acttcctgccgatgccggtgtggacgctgtgaatcgtggctggcccggttctccgcttctccccatcccctactttcctccctccctccctttccctccctcgtcgactgttgcttgctggtcgcagactccctgacccctccctcacccctccctaacctcggtgccaccggattgcccttcttttcctgttgcccagcccagccctagtgtcagggcgggggcctggagcagcccgaggcactgcagcagaagagagaaaagacaacgacgaccctcagctcgccagtccggtcgctggcttcgccgccgccatggcaatgagacagacgccgctcacctgctctggccacacgcgacccgtggttgatttggccttcagtggcatcacgccttatgggtatttcttaatcagcgcttgcaaaggagctggtcagcatttgcctagactctcgggacaacacgatggtaaacctatgctacgccagggagatacaggagactggattggaacatttttgggtcataaaggtgctgtttggggtgcaacactgaataaggatgccaccaaagcagctacagcagctgcagatttcacagccaaagtgtgggatgctgtctcaggagatgaattgatgaccctggctcataaacacattgtcaagactgtggatttcacgcaggatagtaattatttgttaaccgggggacaggataaactgttacgcatatatgacttgaacaaacctgaagcagaacctaaggaaattagtggtcatacttctggtataaaaaaagctctgtggtgcagtgaggataaacagattctttctgctgatgacaaaactgttcgactttgggatcatgctactatgacagaagtgaaatctctaaattttaatatgtctgttagtagtatggaatatattcctgagggagagattttggttataacttatggacgatctattgcttttcatagtgcagtaagtttggacccaattaaatcctttgaagctcctgcaaccatcaattctgcatctcttcatcctgagaaagaatttcttgttgcaggcggtgaagattttaaactttataagtatgattataatagtggagaagaattagaatcctacaagggacactttggtcctattcactgtgtgagatttagtcctgatggagaactctatgccagtggttcagaagatggaacattgagactatggcaaactgtggtaggaaaaacgtatggcctttggaaatgtgtgcttcctgaagaagatagtggtgagctggcaaagccaaagattggttttccagagacaacagaagaggagctagaagaaattgcttcagagaattcagattgcatctttccttcagctcctgatgttaaggcctgagcgtcaatcatatgtgcagttagtatacaactgact

SEQ ID NO: 20916 - DNA, 1866 bp, Homo sapiens
  ENST00000419869
cttcctgccgatgccggtgtggacgctgtgaatcgtggctggcccggttctccgcttctccccatcccctactttcctccctccctccctttccctccctcgtcgactgttgcttgctggtcgcagactccctgacccctccctcacccctccctaacctcggtgccaccggattgcccttcttttcctgttgcccagcccagccctagtgtcagggcgggggcctggagcagcccgaggcactgcagcagaagagagaaaagacaacgacgaccctcagctcgccagtccggtcgctggcttcgccgccgccatggcaatgagacagacgccgctcacctgctctggccacacgcgacccgtggttgatttggccttcagtggcatcacgccttatgggtatttcttaatcagcgcttgcaaagatggtaaacctatgctacgccagggagatacaggagactggattggaacatttttgggtcataaaggtgctgtttggggtgcaacactgaataaggatgccaccaaagcagctacagcagctgcagatttcacagccaaagtgtgggatgctgtctcaggagatgaattgatgaccctggctcataaacacattgtcaagactgtggatttcacgcaggatagtaattatttgttaaccgggggacaggataaactgttacgcatatatgacttgaacaaacctgaagcagaacctaaggaaattagtggtcatacttctggtataaaaaaagctctgtggtgcagtgaggataaacagattctttctgctgatgacaaaactgttcgactttgggatcatgctactatgacagaagtgaaatctctaaattttaatatgtctgttagtagtatggaatatattcctgagggagagattttggttataacttatggacgatctattgcttttcatagtgcagtaagtttggacccaattaaatcctttgaagctcctgcaaccatcaattctgcatctcttcatcctgagaaagaatttcttgttgcaggcggtgaagattttaaactttataagtatgattataatagtggagaagaattagaatcctacaagggacactttggtcctattcactgtgtgagatttagtcctgatggagaactctatgccagtggttcagaagatggaacattgagactatggcaaactgtggtaggaaaaacgtatggcctttggaaatgtgtgcttcctgaagaagatagtggtgagctggcaaagccaaagattggttttccagagacaacagaagaggagctagaagaaattgcttcagagaattcagattgcatctttccttcagctcctgatgttaaggcctgagcgtcaatcatatgtgcagttagtatacaactgactaaaacaagcaagcagagaaaagcatcagccttccagagttactgtctgcttaaggcagaaacagcagtaaataatgaggaaaatgaattagctccagtgctggaacaactaactaacttggtgttacctgtaagtgaaaactcaagtgtcagatgaagggaggtggagttatcctcttatagtacagtggcctgttatctttttaatgaatatatacaagccaacatccaatttctattattacaattagggttcttgtagctgtttatgttaatatggagaagaaaactatattggctgattttttctgatcttaaagcagaatgccttttctttttttgcttcagttgtaaagaagagggaatacatgataaagtaactggtttgatttctcgttcattgtacactgcctctgaacatctaattgtttttagttgtctaaataaaatgcctctaaaacaaaa

SEQ ID NO: 20917 - DNA, 434 bp, Homo sapiens
  ENST00000536737
ttataacttatggacgatctattgcttttcatagtgcagtaagtttggacccaattaaatcctttgaagctcctgcaaccatcaattctgcatctcttcatcctgagaaagaatttcttgttgcaggcggtgaagattttaaactttataagtatgattataatagtggagaagaattaggtgagttgtccccttacagtgatgtggttacctttatcatatgttaagtcccagtaattaacacctcatttatatatatatatatgttacatatatatgttgaaagtaaatttttcagctaacttaagcttggtgcttacaagtgaaaaagtaaaggagttttaaccatttgggtcagatgcttttatagatctgtaaacaaagtatgcagaaatttatccttttaactaaagttcatcattatgctgatgtta

SEQ ID NO: 20918 - DNA, 648 bp, Homo sapiens
  ENST00000538718
gaaagaatttcttgttgcaggcggtgaagattttaaactttataagtatgattataatagtggagaagaattagaatcctacaagggacactttggtcctattcactgtgtgagatttagtcctgatggagaactctatgccagtggttcagaagatggaacattgagactatggcaaactgtggtaggaaaaacgtatggcctttggaaatgtgtgcttcctgaagaaattgcttcagagaattcagattgcatctttccttcagctcctgatgttaaggcctgagcgtcaatcatatgtgcagttagtatacaactgactaaaacaagcaagcagagaaaagcatcagccttccagagttactgtctgcttaaggcagaaacagcagtaaataatgaggaaaatgaattagctccagtgctggaacaactaactaacttggtgttacctgtaagtgaaaactcaagtgtcagatgaagggaggtggagttatcctcttatagtacagtggcctgttatctttttaatgaatatatacaagccaacatccaatttctattattacaattagggttcttgtagctgtttatgttaatatggagaagaaaactatattggctgattttttctgatcttaaagcagaatg

SEQ ID NO: 20919 - DNA, 676 bp, Homo sapiens
  ENST00000539887
actttaatagtgtaagtcatataatcgtcattgcttttctttttacagaagaagatagtggtgagctggcaaagccaaagattggttttccagagacaacagaagaggagctagaagaaattgcttcagagaattcagattgcatctttccttcagctcctgatgttaaggcctgagcgtcaatcatatgtgcagttagtatacaactgactaaaacaagcaagcagagaaaagcatcagccttccagagttactgtctgcttaaggcagaaacagcagtaaataatgaggaaaatgaattagctccagtgctggaacaactaactaacttggtgttacctgtaagtgaaaactcaagtgtcagatgaagggaggtggagttatcctcttatagtacagtggcctgttatctttttaatgaatatatacaagccaacatccaatttctattattacaattagggttcttgtagctgtttatgttaatatggagaagaaaactatattggctgattttttctgatcttaaagcagaatgccttttctttttttgcttcagttgtaaagaagagggaatacatgataaagtaactggtttgatttctcgttcattgtacactgcctctgaacatctaattgtttttagttgtctaaataaaatgcctctaaaacaaaa

SEQ ID NO: 20920 - DNA, 5680 bp, Homo sapiens
  ENST00000450892
gccctgccctcacctggctatcccacacaggtgagaataaccagaactcacctccggtaccagtgttcacttggaaacatggctctcagcctctggcccctgctgctgctgctgctgctgctgctgctgctgtcctttgcagtgactctggcccctactgggcctcattccctggaccctggtctctccttcctgaagtcattgctctccactctggaccaggctccccagggctccctgagccgctcacggttctttacattcctggccaacatttcttcttcctttgagcctgggagaatgggggaaggaccagtaggagagcccccacctctccagccgcctgctctgcggctccatgattttctagtgacactgagaggtagccccgactgggagccaatgctagggctgctaggggatatgctggcactgctgggacaggagcagactccccgagatttcctggtgcaccaggcaggggtgctgggtggacttgtggaggtgctgctgggagccttagttcctgggggcccccctaccccaactcggcccccatgcacccgtgatgggccgtctgactgtgtcctggctgctgactggttgccttctctgctgctgttgttagagggcacacgctggcaagctctggtgcaggtgcagcccagtgtggaccccaccaatgccacaggcctcgatgggagggaggcagctcctcactttttgcagggtctgttgggtttgcttaccccaacaggggagctaggctccaaggaggctctttggggcggtctgctacgcacagtgggggcccccctctatgctgcctttcaggaggggctgctccgtgtcactcactccctgcaggatgaggtcttctccattttggggcagccagagcctgataccaatgggcagtgccagggaggtaaccttcaacagctgctcttatggggcgtccggcacaacctttcctgggatgtccaggcgctgggctttctgtctggatcaccacccccaccccctgccctccttcactgcctgagcacgggcgtgcctctgcccagagcttctcagccgtcagcccacatcagcccacgccaacggcgagccatcactgtggaggccctctgtgagaaccacttaggcccagcaccaccctacagcatttccaacttctccatccacttgctctgccagcacaccaagcctgccactccacagccccatcccagcaccactgccatctgccagacagctgtgtggtatgcagtgtcctgggcaccaggtgcccaaggctggctacaggcctgccacgaccagtttcctgatgagtttttggatgcgatctgcagtaacctctccttttcagccctgtctggctccaaccgccgcctggtgaagcggctctgtgctggcctgctcccaccccctaccagctgccctgaaggcctgccccctgttcccctcaccccagacatcttttggggctgcttcttggagaatgagactctgtgggctgagcgactgtgtggggaggcaagtctacaggctgtgccccccagcaaccaggcttgggtccagcatgtgtgccagggccccaccccagatgtcactgcctccccaccatgccacattggaccctgtggggaacgctgcccggatgggggcagcttcctggtgatggtctgtgccaatgacaccatgtatgaggtcctggtgcccttctggccttggctagcaggccaatgcaggataagtcgtgggggcaatgacacttgcttcctagaagggctgctgggcccccttctgccctctctgccaccactgggaccatccccactctgtctgacccctggccccttcctccttggcatgctatcccagttgccacgctgtcagtcctctgtcccagctcttgctcaccccacacgcctacactatctcctccgcctgctgaccttcctcttgggtccaggggctgggggcgctgaggcccaggggatgctgggtcgggccctactgctctccagtctcccagacaactgctccttctgggatgcctttcgcccagagggccggcgcagtgtgctacggacgattggggaatacctggaacaagatgaggagcagccaaccccatcaggctttgaacccactgtcaaccccagctctggtataagcaagatggagctgctggcctgctttagtcctgtgctgtgggatctgctccagagggaaaagagtgtttgggccctgcagattctagtgcaggcgtacctgcatatgcccccagaaaacctccagcagctggtgctttcagcagagagggaggctgcacagggcttcctgacactcatgctgcaggggaagctgcaggggaagctgcaggtaccaccatccgaggagcaggccctgggtcgcctgacagccctgctgctccagcggtacccacgcctcacctcccagctcttcattgacctgtcaccactcatccctttcttggctgtctctgacctgatgcgcttcccaccatccctgttagccaacgacagtgtcctggctgccatccgggattacagcccaggaatgaggcctgaacagaaggaggctctggcaaagcgactgctggcccctgaactgtttggggaagtgcctgcctggccccaggagctgctgtgggcagtgctgcccctgctcccccacctccctctggagaactttttgcagctcagccctcaccagatccaggccctggaggatagctggccagcagcaggtctggggccagggcatgcccgccatgtgctgcgcagcctggtaaaccagagtgtccaggatggtgaggagcaggtacgcaggcttgggcccctcgcctgtttcctgagccctgaggagctgcagagcctagtgcccctgagtgatccaacggggccagtagaacgggggctgctggaatgtgcagccaatgggaccctcagcccagaaggacgggtggcatatgaacttctgggtgtgttgcgctcatctggaggagcggtgctgagcccccgggagctgcgggtctgggcccctctcttctctcagctgggcctccgcttccttcaggagctgtcagagccccagcttagagccatgcttcctgtcctgcagggaactagtgttacacctgctcaggctgtcctgctgcttggacggctccttcctaggcacgatctatccctggaggaactctgctccttgcaccttctgctaccaggcctcagcccccagacactccaggccatccctaggcgagtcctggtcggggcttgttcctgcctggcccctgaactgtcacgcctctcagcctgccagaccgcagcactgctgcagacctttcgggttaaagatggtgttaaaaatatgggtacaacaggtgctggtccagctgtgtgtatccctggtcagcctattcccaccacctggccagactgcctgcttcccctgctcccattaaagctgctacaactggattccttggctcttctggcaaatcgaagacgctactgggagctgccctggtctgagcagcaggcacagtttctctggaagaagatgcaagtacccaccaaccttaccctcaggaatctgcaggctctgggcaccctggcaggaggcatgtcctgtgagtttctgcagcagatcaactccatggtagacttccttgaagtggtgcacatgatctatcagctgcccactagagttcgagggagcctgagggcctgtatctgggcagagctacagcggaggatggcaatgccagaaccagaatggacaactgtagggccagaactgaacgggctggatagcaagctactcctggacttaccgatccagttgatggacagactatccaatgaatccattatgttggtggtggagctggtgcaaagagctccagagcagctgctggcactgacccccctccaccaggcagccctggcagagagggcactacaaaacctggctccaaaggagactccagtctcaggggaagtgctggagaccttaggccctttggttggattcctggggacagagagcacacgacagatccccctacagatcctgctgtcccatctcagtcagctgcaaggcttctgcctaggagagacatttgccacagagctgggatggctgctattgcaggagtctgttcttgggaaaccagagttgtggagccaggatgaagtagagcaagctggacgcctagtattcactctgtctactgaggcaatttccttgatccccagggaggccttgggtccagagaccctggagcggcttctagaaaagcagcagagctgggagcagagcagagttggacagctgtgtagggagccacagcttgctgccaagaaagcagccctggtagcaggggtggtgcgaccagctgctgaggatcttccagaacctgtgccaaattgtgcagatgtacgagggacattcccagcagcctggtctgcaacccagattgcagagatggagctctcagactttgaggactgcctgacattatttgcaggagacccaggacttgggcctgaggaactgcgggcagccatgggcaaagcaaaacagttgtggggtcccccccggggatttcgtcctgagcagatcctgcagcttggtaggctcttaataggtctaggagatcgggaactacaggagctgatcctagtggactggggagtgctgagcaccctggggcagatagatggctggagcaccactcagctccgcattgtggtctccagtttcctacggcagagtggtcggcatgtgagccacctggacttcgttcatctgacagcgctgggttatactctctgtggactgcggccagaggagctccagcacatcagcagttgggagttcagccaagcagctctcttcctcggcaccctgcatctccagtgctctgaggaacaactggaggttctggcccacctacttgtactgcctggtgggtttggcccaatcagtaactgggggcctgagatcttcactgaaattggcaccatagcagctgggatcccagacctggctctttcagcactgctgcggggacagatccagggcgttactcctcttgccatttctgtcatccctcctcctaaatttgctgtggtgtttagtcccatccaactatctagtctcaccagtgctcaggctgtggctgtcactcctgagcaaatggcctttctgagtcctgagcagcgacgagcagttgcatgggcccaacatgagggaaaggagagcccagaacagcaaggtcgaagtacagcctggggcctccaggactggtcacgaccttcctggtccctggtattgactatcagcttccttggccacctgctatgagcctgtctctacagtagaaggagattgtggggagagaaatcttaagtcataatgaataaagtgcaaacagaagtgcatcctgattattttcagaagctgatgaggaatatgggtaaaatgttaatgctttccacccacctgagaatcagtgttcctgggttgccatatctggagtctctttccatcataaataatcccactgcctcttttcatttcctgaaggctgctccctcctcaccccaccattagaagtaacacagacagctgcagcata

SEQ ID NO: 20921 - DNA, 3364 bp, Homo sapiens
  ENST00000471703
agtgctgcccctgctcccccacctccctctggagaactttttgcagctcagccctcaccagatccaggccctggaggatagctggccagcagcaggtctggggccagggcatgcccgccatgtgctgcgcagcctggtaaaccagagtgtccaggatggtgaggagcaggagctgtcagagccccagcttagagccatgcttcctgtcctgcagggaactagtgttacacctgctcaggctgtcctgctgcttggacggctccttcctaggcacgatctatccctggaggaactctgctccttgcaccttctgctaccaggcctcagcccccagacactccaggccatccctaggcgagtcctggtcggggcttgttcctgcctggcccctgaactgtcacgcctctcagcctgccagaccgcagcactgctgcagacctttcgggtatgagagtggcaaggaggatgagataatcagggataccggctctttctggttgggaggaaggcatcttccctgaggccagggaaggcctttcatacctccccacttacacacacacacacacacacacacacacacacacacacaaccaattctcatgcaggttaaagatggtgttaaaaatatgggtacaacaggtgctggtccagctgtgtgtatccctggtcaggtaagtgtgagatctcccaactgagctcctctccccattctggggcagtttcatatggctggtgctacctcccacactaccctgcagtggccctgagagttctggttagctctgtgcccattagcagccctccccagtgccagatgcaggacagcatgatccactcacattgtcctagactaatgtcaaagctggaagggcctgagaaatcttccaggccacccaccctgctttcagatgaaaagaccaaggctgggagaagctaagggactttgtttgcctggtgcctaactagcagcaacacttgaccacagcagcctgcagtgtgaggctcttaggcgtttattgctacagtggcaaatgccattccacttctgtcctagctttggtccctttccacccccatggttccttttctctgagtgctaagtacagactctctcacctatcactacactgctatacccatcaccgccagcagcctattcccaccacctggccagactgcctgcttcccctgctcccattaaagctgctacaactggattccttggctcttctggcaaatcgaagacgctactgggagctgccctggtctgagcagcaggcacagtttctctggaagaagatgcaagtacccaccaaccttaccctcaggaatctgcaggctctgggcaccctggcaggaggcatgtcctgtgagtttctgcagcagatcaactccatggtagacttccttgaagtggtgcacatgatctatcagctgcccactagagttcgagggagcctgagggcctgtatctgggcagagctacagcggaggatggcaatgccagaaccagaatggacaactgtagggccagaactgaacgggctggatagcaagctactcctggacttaccgatccagttgatggacagactatccaatgaatccattatgttggtggtggagctggtgcaaagagctccagagcagctgctggcactgacccccctccaccaggcagccctggcagagagggcactacaaaacctgattcctgtctacaaggcctggcccctgttttgcctctgggttctgttccttgataatatgcttcacgttacttgtccatacctcttggagtccgagaaatctcttggagtccacctctcagtctttctgcctgctcctatctgggctcattgcttaaggaagtgaacaaaggctccaaaggagactccagtctcaggggaagtgctggagaccttaggccctttggttggattcctggggacagagagcacacgacagatccccctacagatcctgctgtcccatctcagtcagctgcaaggcttctgcctaggagagacatttgccacagagctgggatggctgctattgcaggagtctgttcttgggaaaccagagttgtggagccaggatgaagtagagcaagctggacgcctagtattcactctgtctactgaggcaatttccttgatccccagggaggccttgggtccagagaccctggagcggcttctagaaaagcagcagagctgggagcagagcagagttggacagctgtgtagggagccacagcttgctgccaagaaagcagccctggtagcaggggtggtgcgaccagctgctgaggatcttccagaacctgtgccaaattgtgcagatgtacgagggacattcccagcagcctggtctgcaacccagattgcagagatggagctctcagactttgaggactgcctgacattatttgcaggagacccaggacttgggcctgaggaactgcgggcagccatgggcaaagcaaaacagttgtggggtcccccccggggatttcgtcctgagcagatcctgcagcttggtaggctcttaataggtctaggagatcgggaactacaggagctgatcctagtggactggggagtgctgagcaccctggggcagatagatggctggagcaccactcagctccgcattgtggtctccagtttcctacggcagagtggtcggcatgtgagccacctggacttcgttcatctgacagcgctgggttatactctctgtggactgcggccagaggagctccagcacatcagcagttgggagttcagccaagcagctctcttcctcggcaccctgcatctccagtgctctgaggaacaactggaggttctggcccacctacttgtactgcctggtgggtttggcccaatcagtaactgggggcctgagatcttcactgaaattggcaccatagcagctgggatcccagacctggctctttcagcactgctgcggggacagatccagggcgttactcctcttgccatttctgtcatccctcctcctaaatttgctgtggtgtttagtcccatccaactatctagtctcaccagtgctcaggctgtggctgtcactcctgagcaaatggcctttctgagtcctgagcagcgacgagcagttgcatgggcccaacatgagggaaaggagagcccagaacagcaaggtcgaagtacagcctggggcctccaggactggtcacgaccttcctggtccctggtattgactatcagcttccttggccacctgctatgagcctgtctctacagtagaaggagattgtggggagagaaatcttaagtcataatgaataaagtgcaaacagaagtgcatcctg

SEQ ID NO: 20922 - DNA, 2518 bp, Homo sapiens
  ENST00000448437
agaaggaggctctggcaaagcgactgctggcccctgaactgtttggggaagtgcctgcctggccccaggagctgctgtgggcagtgctgcccctgctcccccacctccctctggagaactttttgcagctcagccctcaccaggtggcatatgaacttctgggtgtgttgcgctcatctggaggagcggtgctgagcccccgggagctgcgggtctgggcccctctcttctctcagctgggcctccgcttccttcaggagctgtcagagccccagcttagagccatgcttcctgtcctgcagggaactagtgttacacctgctcaggctgtcctgctgcttggacggctccttcctaggcacgatctatccctggaggaactctgctccttgcaccttctgctaccaggcctcagcccccagacactccaggccatccctaggcgagtcctggtcggggcttgttcctgcctggcccctgaactgtcacgcctctcagcctgccagaccgcagcactgctgcagacctttcgggtatgagagtggcaaggaggatgagataatcagggataccggctctttctggttgggaggaaggcatcttccctgaggccagggaaggcctttcatacctccccacttacacacacacacacacacacacacacacacacacacacaaccaattctcatgcaggttaaagatggtgttaaaaatatgggtacaacaggtgctggtccagctgtgtgtatccctggtcaggtaagtgtgagatctcccaactgagctcctctccccattctggggcagtttcatatggctggtgctacctcccacactaccctgcagtggccctgagagttctggttagctctgtgcccattagcagccctccccagtgccagatgcaggacagcatgatccactcacattgtcctagactaatgtcaaagctggaagggcctgagaaatcttccaggccacccaccctgctttcagatgaaaagaccaaggctgggagaagctaagggactttgtttgcctggtgcctaactagcagcaacacttgaccacagcagcctgcagtgtgaggctcttaggcgtttattgctacagtggcaaatgccattccacttctgtcctagctttggtccctttccacccccatggttccttttctctgagtgctaagtacagactctctcacctatcactacactgctatacccatcaccgccagcagcctattcccaccacctggccagactgcctgcttcccctgctcccattaaagctgctacaactggattccttggctcttctggcaaatcgaagacgctactgggagctgccctggtctgagcagcaggcacagtttctctggaagaagatgcaagtacccaccaaccttaccctcaggaatctgcaggctctgggcaccctggcaggaggcatgtcctgtgagtttctgcagcagatcaactccatggtagacttccttgaagtggtgcacatgatctatcagctgcccactagagttcgagggagcctgagggcctgtatctgggcagagctacagcggaggatggcaatgccagaaccagaatggacaactgtagggccagaactgaacgggctggatagcaagctactcctggacttaccttgtggggtcccccccggggatttcgtcctgagcagatcctgcagcttggtaggctcttaataggtctaggagatcgggaactacaggagctgatcctagtggactggggagtgctgagcaccctggggcagatagatggctggagcaccactcagctccgcattgtggtctccagtttcctacggcagagtggtcggcatgtgagccacctggacttcgttcatctgacagcgctgggttatactctctgtggactgcggccagaggagctccagcacatcagcagttgggagttcagccaagcagctctcttcctcggcaccctgcatctccagtgctctgaggaacaactggaggttctggcccacctacttgtactgcctggtgggtttggcccaatcagtaactgggggcctgagatcttcactgaaattggcaccatagcagctgggatcccagacctggctctttcagcactgctgcggggacagatccagggcgttactcctcttgccatttctgtcatccctcctcctaaatttgctgtggtgtttagtcccatccaactatctagtctcaccagtgctcaggctgtggctgtcactcctgagcaaatggcctttctgagtcctgagcagcgacgagcagttgcatgggcccaacatgagggaaaggagagcccagaacagcaaggtcgaagtacagcctggggcctccaggactggtcacgaccttcctggtccctggtattgactatcagcttccttggccacctgctatgagcctgtctctacagtagaaggagattgtggggagagaaatcttaagtcataatgaataaagtgcaaacag

SEQ ID NO: 20923 - DNA, 4253 bp, Homo sapiens
  ENST00000485556
attacagcccaggaatgaggcctgaacagaaggaggctctggcaaagcgactgctggcccctgaactgtttggggaagtgcctgcctggccccaggagctgctgtgggcagtgctgcccctgctcccccacctccctctggagaactttttgcagctcagccctcaccagatccaggccctggaggatagctggccagcagcaggtctggggccagggcatgcccgccatgtgctgcgcagcctggtaaaccagagtgtccaggatggtgaggagcaggtacgcaggtggcatatgaacttctgggtgtgttgcgctcatctggaggagcggtgctgagcccccgggagctgcgggtctgggcccctctcttctctcagctgggcctccgcttccttcaggagctgtcagagccccagcttagagccatgcttcctgtcctgcagggaactagtgttacacctgctcaggctgtcctgctgcttggacggctccttcctaggcacgatctatccctggaggaactctgctccttgcaccttctgctaccaggcctcagcccccagacactccaggccatccctaggcgagtcctggtcggggcttgttcctgcctggcccctgaactgtcacgcctctcagcctgccagaccgcagcactgctgcagacctttcgggtatgagagtggcaaggaggatgagataatcagggataccggctctttctggttgggaggaaggcatcttccctgaggccagggaaggcctttcatacctccccacttacacacacacacacacacacacacacacacacacacacaaccaattctcatgcaggttaaagatggtgttaaaaatatgggtacaacaggtgctggtccagctgtgtgtatccctggtcaggtaagtgtgagatctcccaactgagctcctctccccattctggggcagtttcatatggctggtgctacctcccacactaccctgcagtggccctgagagttctggttagctctgtgcccattagcagccctccccagtgccagatgcaggacagcatgatccactcacattgtcctagactaatgtcaaagctggaagggcctgagaaatcttccaggccacccaccctgctttcagatgaaaagaccaaggctgggagaagctaagggactttgtttgcctggtgcctaactagcagcaacacttgaccacagcagcctgcagtgtgaggctcttaggcgtttattgctacagtggcaaatgccattccacttctgtcctagctttggtccctttccacccccatggttccttttctctgagtgctaagtacagactctctcacctatcactacactgctatacccatcaccgccagcagcctattcccaccacctggccagactgcctgcttcccctgctcccattaaagctgctacaactggattccttggctcttctggcaaatcgaagacgctactgggagctgccctggtctgagcagcaggtaattctccccacttaatttcagaacttcctccctcaatgtagtctaccttctttacctatcccttagccctatttggccagcttatccctactatcctttatttgattgtttgagatacagtctcactctgttgcccaggctgcagtgcagtggcatgatcagagttcgctgtaacctcaaactcctgagctcaggcaatctttctgcctcagcctcctgaatagctaggacgacaggtggttaccaccatgcctggctaatttttaaattttttttttgttttttgagatgaagtcttgctctgtcacccaggcttgagtacagtggcacaagcttggctcactgcaacctctgtctcccgggttcaagcgattctcctgcctcagcctcccgagtagctgggactacaggcactccccacaatgcctggctaattttttttttgttttagtagagacagggtttcaccatattggccaggctggtctcgaactgctgaccttgtgatctgcctgcctctgcctctcaaagtgctgggattacaggtgtgagccaccatgcccggccaatttttaaattttttgtagagacagacaatacaaaaatgtggacactatgtggagacactatgttgaggtactatgctgtccagattggtcttgaactcctggcctcaagcaatcctcctgccttggcctcccaaagtgctgggattacagacctgagccactgcacccagccccctagtatctcttataatgtgacttgcttttctttttctttctccttcccttttctttcatttctttctcactctcgagagaagagtgggcatctgggagagtgggaggctggtgggtcccacagagtgaggaggcaggactgggtccaaggcagtcctgcctctccactctagggggtatccttggacagtgtctcttctgggaaggggctcgtctttctttctcttgtaggcacagtttctctggaagaagatgcaagtacccaccaaccttaccctcaggaatctgcaggctctgggcaccctggcaggaggcatgtcctgtgagtttctgcagcagatcaactccatggtagacttccttgaagtggtgcacatgatctatcagctgcccactagagttcgagggagcctgagggcctgtatctgggcagagctacagcggaggatggcaatgccagaaccagaatggacaactgtagggccagaactgaacgggctggatagcaagctactcctggacttaccgctccaaaggagactccagtctcaggggaagtgctggagaccttaggccctttggttggattcctggggacagagagcacacgacagatccccctacagatcctgctgtcccatctcagtcagctgcaaggcttctgcctaggagagacatttgccacagagctgggatggctgctattgcaggagtctgttcttgggaaaccagagttgtggagccaggatgaagtagagcaagctggacgcctagtattcactctgtctactgaggcaatttccttgatccccagggaggccttgggtccagagaccctggagcggcttctagaaaagcagcagagctgggagcagagcagagttggacagctgtgtagggagccacagcttgctgccaagaaagcagccctggtagcaggggtggtgcgaccagctgctgaggatcttccagaacctgtgccaaattgtgcagatgtacgagggacattcccagcagcctggtctgcaacccagattgcagagatggagctctcagactttgaggactgcctgacattatttgcaggagacccaggacttgggcctgaggaactgcgggcagccatgggcaaagcaaaacagttgtggggtcccccccggggatttcgtcctgagcagatcctgcagcttggtaggctcttaataggtctaggagatcgggaactacaggagctgatcctagtggactggggagtgctgagcaccctggggcagatagatggctggagcaccactcagctccgcattgtggtctccagtttcctacggcagagtggtcggcatgtgagccacctggacttcgttcatctgacagcgctgggttatactctctgtggactgcggccagaggagctccagcacatcagcagttgggagttcagccaagcagctctcttcctcggcaccctgcatctccagtgctctgaggaacaactggaggttctggcccacctacttgtactgcctggtgggtttggcccaatcagtaactgggggcctgagatcttcactgaaattggcaccatagcagctgggatcccagacctggctctttcagcactgctgcggggacagatccagggcgttactcctcttgccatttctgtcatccctcctcctaaatttgctgtggtgtttagtcccatccaactatctagtctcaccagtgctcaggctgtggctgtcactcctgagcaaatggcctttctgagtcctgagcagcgacgagcagttgcatgggcccaacatgagggaaaggagagcccagaacagcaaggtcgaagtacagcctggggcctccaggactggtcacgaccttcctggtccctggtattgactatcagcttccttggccacctgctatgagcctgtctctacagtagaaggagattgtggggagagaaatcttaagtcataatgaataaagtgcaaacag

SEQ ID NO: 20924 - DNA, 5386 bp, Homo sapiens
  ENST00000428650
cctgccctcacctggctatcccacacaggtgagaataaccagaactcacctccggtaccagtgttcacttggaaacatggctctcagcctctggcccctgctgctgctgctgctgctgctgctgctgctgtcctttgcagtgactctggcccctactgggcctcattccctggaccctggtctctccttcctgaagtcattgctctccactctggaccaggctccccagggctccctgagccgctcacggttctttacattcctggccaacatttcttcttcctttgagcctgggagaatgggggaaggaccagtaggagagcccccacctctccagccgcctgctctgcggctccatgattttctagtgacactgagaggtagccccgactgggagccaatgctagggctgctaggggatatgctggcactgctgggacaggagcagactccccgagatttcctggtgcaccaggcaggggtgctgggtggacttgtggaggtgctgctgggagccttagttcctgggggcccccctaccccaactcggcccccatgcacccgtgatgggccgtctgactgtgtcctggctgctgactggttgccttctctgctgctgttgttagagggcacacgctggcaagctctggtgcaggtgcagcccagtgtggaccccaccaatgccacaggcctcgatgggagggaggcagctcctcactttttgcagggtctgttgggtttgcttaccccaacaggggagctaggctccaaggaggctctttggggcggtctgctacgcacagtgggggcccccctctatgctgcctttcaggaggggctgctccgtgtcactcactccctgcaggatgaggtcttctccattttggggcagccagagcctgataccaatgggcagtgccagggaggtaaccttcaacagctgctcttatggggcgtccggcacaacctttcctgggatgtccaggcgctgggctttctgtctggatcaccacccccaccccctgccctccttcactgcctgagcacgggcgtgcctctgcccagagcttctcagccgtcagcccacatcagcccacgccaacggcgagccatcactgtggaggccctctgtgagaaccacttaggcccagcaccaccctacagcatttccaacttctccatccacttgctctgccagcacaccaagcctgccactccacagccccatcccagcaccactgccatctgccagacagctgtgtggtatgcagtgtcctgggcaccaggtgcccaaggctggctacaggcctgccacgaccagtttcctgatgagtttttggatgcgatctgcagtaacctctccttttcagccctgtctggctccaaccgccgcctggtgaagcggctctgtgctggcctgctcccaccccctaccagctgccctgaaggcctgccccctgttcccctcaccccagacatcttttggggctgcttcttggagaatgagactctgtgggctgagcgactgtgtggggaggcaagtctacaggctgtgccccccagcaaccaggcttgggtccagcatgtgtgccagggccccaccccagatgtcactgcctccccaccatgccacattggaccctgtggggaacgctgcccggatgggggcagcttcctggtgatggtctgtgccaatgacaccatgtatgaggtcctggtgcccttctggccttggctagcaggccaatgcaggataagtcgtgggggcaatgacacttgcttcctagaagggctgctgggcccccttctgccctctctgccaccactgggaccatccccactctgtctgacccctggccccttcctccttggcatgctatcccagttgccacgctgtcagtcctctgtcccagctcttgctcaccccacacgcctacactatctcctccgcctgctgaccttcctcttgggtccaggggctgggggcgctgaggcccaggggatgctgggtcgggccctactgctctccagtctcccagacaactgctccttctgggatgcctttcgcccagagggccggcgcagtgtgctacggacgattggggaatacctggaacaagatgaggagcagccaaccccatcaggctttgaacccactgtcaaccccagctctggtataagcaagatggagctgctggcctgctttagtcctgtgctgtgggatctgctccagagggaaaagagtgtttgggccctgcagattctagtgcaggcgtacctgcatatgcccccagaaaacctccagcagctggtgctttcagcagagagggaggctgcacagggcttcctgacactcatgctgcaggggaagctgcaggggaagctgcaggtaccaccatccgaggagcaggccctgggtcgcctgacagccctgctgctccagcggtacccacgcctcacctcccagctcttcattgacctgtcaccactcatccctttcttggctgtctctgacctgatgcgcttcccaccatccctgttagccaacgacagtgtacagcagggctacagagggtcagaggaaaacagtttggaggaagacaaagggttaagacccatgactcctcgcagcctggctgccatccgggattacagcccaggaatgaggcctgaacagaaggaggctctggcaaagcgactgctggcccctgaactgtttggggaagtgcctgcctggccccaggagctgctgtgggcagtgctgcccctgctcccccacctccctctggagaactttttgcagctcagccctcaccagatccaggccctggaggatagctggccagcagcaggtctggggccagggcatgcccgccatgtgctgcgcagcctggtaaaccagagtgtccaggatggtgaggagcaggtacgcaggtggcatatgaacttctgggtgtgttgcgctcatctggaggagcggtgctgagcccccgggagctgcgggtctgggcccctctcttctctcagctgggcctccgcttccttcaggagctgtcagagccccagcttagagccatgcttcctgtcctgcagggaactagtgttacacctgctcaggctgtcctgctgcttggacggctccttcctaggcacgatctatccctggaggaactctgctccttgcaccttctgctaccaggcctcagcccccagacactccaggccatccctaggcgagtcctggtcggggcttgttcctgcctggcccctgaactgtcacgcctctcagcctgccagaccgcagcactgctgcagacctttcgggttaaagatggtgttaaaaatatgggtacaacaggtgctggtccagctgtgtgtatccctggtcagcctattcccaccacctggccagactgcctgcttcccctgctcccattaaagctgctacaactggattccttggctcttctggcaaatcgaagacgctactgggagctgccctggtctgagcagcaggcacagtttctctggaagaagatgcaagtacccaccaaccttaccctcaggaatctgcaggctctgggcaccctggcaggaggcatgtcctgtgagtttctgcagcagatcaactccatggtagacttccttgaagtggtgcacatgatctatcagctgcccactagagttcgagggagcctgagggcctgtatctgggcagagctacagcggaggatggcaatgccagaaccagaatggacaactgtagggccagaactgaacgggctggatagcaagctactcctggacttaccgatccagttgatggacagactatccaatgaatccattatgttggtggtggagctggtgcaaagagctccagagcagctgctggcactgacccccctccaccaggcagccctggcagagagggcactacaaaacctgattcctgtctacaaggcctggcccctgttttgcctctgggttctgttccttgataatatgcttcacgttacttgtccatacctcttggagtccgagaaatctcttggagtccacctctcagtctttctgcctgctcctatctgggctcattgcttaaggaagtgaacaaaggctccaaaggagactccagtctcaggggaagtgctggagaccttaggccctttggttggattcctggggacagagagcacacgacagatccccctacagatcctgctgtcccatctcagtcagctgcaaggcttctgcctaggagagacatttgccacagagctgggatggctgctattgcaggagtctgttcttgggaaaccagagttgtggagccaggatgaagtagagcaagctggacgcctagtattcactctgtctactgaggcaatttccttgatccccagggaggccttgggtccagagaccctggagcggcttctagaaaagcagcagagctgggagcagagcagagttggacagctgtgtagggagccacagcttgctgccaagaaagcagccctggtagcaggggtggtgcgaccagctgctgaggatcttccagttgtggggtcccccccggggatttcgtcctgagcagatcctgcagcttggtaggctcttaataggtctaggagatcgggaactacaggagctgatcctagtggactggggagtgctgagcaccctggggcagatagatggctggagcaccactcagctccgcattgtggtctccagtttcctacggcagagtggtcggcatgtgagccacctggacttcgttcatctgacagcgctgggttatactctctgtggactgcggccagaggagctccagcacatcagcagttgggagttcagccaagcagctctcttcctcggcaccctgcatctccagtgctctgaggaacaactggaggttctggcccacctacttgtactgcctggtgggtttggcccaatcagtaactgggggcctgagatcttcactgaaattggcaccatagcagctgggatcccagacctggctctttcagcactgctgcggggacagatccagggcgttactcctcttgccatttctgtcatccctcctcctaaatttgctgtggtgtttagtcccatccaactatctagtctcaccagtgctcaggctgtggctgtcactcctgagcaaatggcctttctgagtcctgagcagcgacgagcagttgcatgggcccaacatgagggaaaggagagcccagaacagcaaggtcgaagtacagcctggggcctccaggactggtcacgaccttcctggtccctggtattgactatcagcttccttggccacctgctatgagcctgtctctacagtagaaggagattgtggggagagaaa

SEQ ID NO: 20925 - DNA, 4291 bp, Homo sapiens
  ENST00000440125
cctgccctcacctggctatcccacacaggtgagaataaccagaactcacctccggtaccagtgttcacttggaaacatggctctcagcctctggcccctgctgctgctgctgctgctgctgctgctgctgtcctttgcagtgactctggcccctactgggcctcattccctggaccctggtctctccttcctgaagtcattgctctccactctggaccaggctccccagggctccctgagccgctcacggttctttacattcctggccaacatttcttcttcctttgagcctgggagaatgggggaaggaccagtaggagagcccccacctctccagccgcctgctctgcggctccatgattttctagtgacactgagaggtagccccgactgggagccaatgctagggctgctaggggatatgctggcactgctgggacaggagcagactccccgagatttcctggtgcaccaggcaggggtgctgggtggacttgtggaggtgctgctgggagccttagttcctgggggcccccctaccccaactcggcccccatgcacccgtgatgggccgtctgactgtgtcctggctgctgactggttgccttctctgctgctgttgttagagggcacacgctggcaagctctggtgcaggtgcagcccagtgtggaccccaccaatgccacaggcctcgatgggagggaggcagctcctcactttttgcagggtctgttgggtttgcttaccccaacaggggagctaggctccaaggaggctctttggggcggtctgctacgcacagtgggggcccccctctatgctgcctttcaggaggggctgctccgtgtcactcactccctgcaggatgaggtcttctccattttggggcagccagagcctgataccaatgggcagtgccagggaggtaaccttcaacagctgctcttatggggcgtccggcacaacctttcctgggatgtccaggcgctgggctttctgtctggatcaccacccccaccccctgccctccttcactgcctgagcacgggcgtgcctctgcccagagcttctcagccgtcagcccacatcagcccacgccaacggcgagccatcactgtggaggccctctagggccggcgcagtgtgctacggacgattggggaatacctggaacaagatgaggagcagccaaccccatcaggctttgaacccactgtcaaccccagctctggtataagcaagatggagctgctggcctgctttagtcctgtgctgtgggatctgctccagagggaaaagagtgtttgggccctgcagattctagtgcaggcgtacctgcatatgcccccagaaaacctccagcagctggtgctttcagcagagagggaggctgcacagggcttcctgacactcatgctgcaggggaagctgcaggggaagctgcaggtaccaccatccgaggagcaggccctgggtcgcctgacagccctgctgctccagcggtacccacgcctcacctcccagctcttcattgacctgtcaccactcatccctttcttggctgtctctgacctgatgcgcttcccaccatccctgttagccaacgacagtgtacagcagggctacagagggtcagaggaaaacagtttggaggaagacaaagggttaagacccatgactcctcgcagcctggctgccatccgggattacagcccaggaatgaggcctgaacagaaggaggctctggcaaagcgactgctggcccctgaactgtttggggaagtgcctgcctggccccaggagctgctgtgggcagtgctgcccctgctcccccacctccctctggagaactttttgcagctcagccctcaccagatccaggccctggaggatagctggccagcagcaggtctggggccagggcatgcccgccatgtgctgcgcagcctggtaaaccagagtgtccaggatggtgaggagcaggtacgcaggcttgggcccctcgcctgtttcctgagccctgaggagctgcagagcctagtgcccctgagtgatccaacggggccagtagaacgggggctgctggaatgtgcagccaatgggaccctcagcccagaaggacgggtggcatatgaacttctgggtgtgttgcgctcatctggaggagcggtgctgagcccccgggagctgcgggtctgggcccctctcttctctcagctgggcctccgcttccttcaggagctgtcagagccccagcttagagccatgcttcctgtcctgcagggaactagtgttacacctgctcaggctgtcctgctgcttggacggctccttcctaggcacgatctgctacaactggattccttggctcttctggcaaatcgaagacgctactgggagctgccctggtctgagcagcaggcacagtttctctggaagaagatgcaagtacccaccaaccttaccctcaggaatctgcaggctctgggcaccctggcaggaggcatgtcctgtgagtttctgcagcagatcaactccatggtagacttccttgaagtggtgcacatgatctatcagctgcccactagagttcgagggagcctgagggcctgtatctgggcagagctacagcggaggatggcaatgccagaaccagaatggacaactgtagggccagaactgaacgggctggatagcaagctactcctggacttaccgatccagttgatggacagactatccaatgaatccattatgttggtggtggagctggtgcaaagagctccagagcagctgctggcactgacccccctccaccaggcagccctggcagagagggcactacaaaacctggctccaaaggagactccagtctcaggggaagtgctggagaccttaggccctttggttggattcctggggacagagagcacacgacagatccccctacagatcctgctgtcccatctcagtcagctgcaaggcttctgcctaggagagacatttgccacagagctgggatggctgctattgcaggagtctgttcttgggaaaccagagttgtggagccaggatgaagtagagcaagctggacgcctagtattcactctgtctactgaggcaatttccttgatccccagggaggccttgggtccagagaccctggagcggcttctagaaaagcagcagagctgggagcagagcagagttggacagctgtgtagggagccacagcttgctgccaagaaagcagccctggtagcaggggtggtgcgaccagctgctgaggatcttccagaacctgtgccaaattgtgcagatgtacgagggacattcccagcagcctggtctgcaacccagattgcagagatggagctctcagactttgaggactgcctgacattatttgcaggagacccaggacttgggcctgaggaactgcgggcagccatgggcaaagcaaaacagttgtggggtcccccccggggatttcgtcctgagcagatcctgcagcttggtaggctcttaataggtctaggagatcgggaactacaggagctgatcctagtggactggggagtgctgagcaccctggggcagatagatggctggagcaccactcagctccgcattgtggtctccagtttcctacggcagagtggtcggcatgtgagccacctggacttcgttcatctgacagcgctgggttatactctctgtggactgcggccagaggagctccagcacatcagcagttgggagttcagccaagcagctctcttcctcggcaccctgcatctccagtgctctgaggaacaactggaggttctggcccacctacttgtactgcctggtgggtttggcccaatcagtaactgggggcctgagatcttcactgaaattggcaccatagcagctgggatcccagacctggctctttcagcactgctgcggggacagatccagggcgttactcctcttgccatttctgtcatccctcctcctaaatttgctgtggtgtttagtcccatccaactatctagtctcaccagtgctcaggctgtggctgtcactcctgagcaaatggcctttctgagtcctgagcagcgacgagcagttgcatgggcccaacatgagggaaaggagagcccagaacagcaaggtcgaagtacagcctggggcctccaggactggtcacgaccttcctggtccctggtattgactatcagcttccttggccacctgctatgagcctgtctctacagtagaaggagattgtggggagagaaa

SEQ ID NO: 20926 - DNA, 543 bp, Homo sapiens
  ENST00000460952
taaagaaaaggcaaatgatttacctagagttatacagctaagggcagaggcaagacttaaaacccagcagtatgactcccaatccactgcttttccactcacattgttcctgtctttctcctagttgtggggtcccccccggggatttcgtcctgagcagatcctgcagcttggtaggctcttaataggtctaggagatcgggaactacaggagctgatcctagtggactggggagtgctgagcaccctggggcagatagatggctggagcaccactcagctccgcattgtggtctccagtttcctacggcagagtggtcggcatgtgagccacctggacttcgttcatctgacagcgctgggttatactctctgtggactgcggccagaggagctccagcacatcagcagttgggagttcagccaagcagctctcttcctcggcaccctgcatctccagtgctctgaggaacaactggaggttctggcccacctacttgtactgcctggtgggtttggcccaatcagtaactgggggcctga

SEQ ID NO: 20927 - DNA, 513 bp, Homo sapiens
  ENST00000493750
tgttctattatctcctaagccctatacatattactctgtaatactcctttgatccctatttctcacagtgctctatcctccaaaggttggaagactcactctatctacagatatctctctgggcatattttattactgcgctgacctcctggccctgccttcccccttcagaacctgtgccaaattgtgcagatgtacgagggacattcccagcagcctggtctgcaacccagattgcagagatggagctctcagactttgaggactgcctgacattatttgcaggagacccaggacttgggcctgaggaactgcgggcagccatgggcaaagcaaaacagttgtggggtcccccccggggatttcgtcctgagcagatcctgcagcttggtaggctcttaataggtctaggagatcgggaactacaggagctgatcctagtggactggggagtgctgagcaccctggggcagatagatggctggagcaccactcagctccgcattgtggtct

SEQ ID NO: 20928 - DNA, 1104 bp, Homo sapiens
  ENST00000455136
gcagcctggctgccatccgggattacagcccaggaatgaggcctgaacagaaggaggctctggcaaagcgactgctggcccctgaactgtttggggaagtgcctgcctggccccaggagctgctgtgggcagtgctgcccctgctcccccacctccctctggagaactttttgcagctcagccctcaccagatccaggccctggaggatagctggccagcagcaggtctggggccagggcatgcccgccatgtgctgcgcagcctggtaaaccagagtgtccaggatggtgaggagcaggtacgcaggtggcatatgaacttctgggtgtgttgcgctcatctggaggagcggtgctgagcccccgggagctgcgggtctgggcccctctcttctctcagctgggcctccgcttccttcaggagctgtcagagccccagcttagagccatgcttcctgtcctgcagggaactagtgttacacctgctcaggctgtcctgctgcttggacggctccttcctaggcacgatgcacagtttctctggaagaagatgcaagtacccaccaaccttaccctcaggaatctgcaggctctgggcaccctggcaggaggcatgtcctgtgagtttctgcagcagatcaactccatggtagacttccttgaagtggtgcacatgatctatcagctgcccactagagttcgagggagcctgagggcctgtatctgggcagagctacagcggaggatggcaatgccagaaccagaatggacaactgtagggccagaactgaacgggctggatagcaagctactcctggacttaccgatccagttgatggacagactatccaatgaatccattatgttggtggtggagctggtgcaaagagctccagagcagctgctggcactgacccccctccaccaggcagccctggcagagagggcactacaaaacctggctccaaaggagactccagtctcaggggaagtgctggagaccttaggccctttggttggattcctggggacagagagcacacgacagatccccctacagatcctgctgtcccatctcagtcagctgcaaggcttctgcctagg

SEQ ID NO: 20929 - DNA, 571 bp, Homo sapiens
  ENST00000483250
tacttgactggcccatcttctgctagtggggacaaagagtcaatggcatgtctctcagtggcccctccctgcaagaaccctatagtgaccccagtgcgagctaaccttccccatctcagatccaggccctggaggatagctggccagcagcaggtctggggccagggcatgcccgccatgtgctgcgcagcctggtaaaccagagtgtccaggatggtgaggagcaggtggcatatgaacttctgggtgtgttgcgctcatctggaggagcggtgctgagcccccgggagctgcgggtctgggcccctctcttctctcagctgggcctccgcttccttcaggagctgtcagagccccagcttagagccatgcttcctgtcctgcagggaactagtgttacacctgctcaggctgtcctgctgcttggacggctccttcctaggcacgatctatccctggaggaactctgctccttgcaccttctgctaccaggcctcagcccccagacactccaggccatccctaggcgagtcctggtcggggcttgttcctgcctggcccctgaactgtc

SEQ ID NO: 20930 - DNA, 569 bp, Homo sapiens
  ENST00000470279
gactggcccatcttctgctagtggggacaaagagtcaatggcatgtctctcagtggcccctccctgcaagaaccctatagtgaccccagtgcgagctaaccttccccatctcagatccaggccctggaggatagctggccagcagcaggtctggggccagggcatgcccgccatgtgctgcgcagcctggtaaaccagagtgtccaggatggtgaggagcaggtacgcaggtggcatatgaacttctgggtgtgttgcgctcatctggaggagcggtgctgagcccccgggagctgcgggtctgggcccctctcttctctcagctgggcctccgcttccttcaggagctgtcagagccccagcttagagccatgcttcctgtcctgcagggaactagtgttacacctgctcaggctgtcctgctgcttggacggctccttcctaggcacgatctatccctggaggaactctgctccttgcaccttctgctaccaggcctcagcccccagacactccaggccatccctaggcgagtcctggtcggggcttgttcctgcctggcccctgaa

SEQ ID NO: 20931 - DNA, 2259 bp, Homo sapiens
  ENST00000432436
acattcctggccaacatttcttcttcctttgagcctgggagaatgggggaaggaccagtaggagagcccccacctctccagccgcctgctctgcggctccatgattttctagtgacactgagaggtagccccgactgggagccaatgctagggctgctaggggatatgctggcactgctgggacaggagcagactccccgagatttcctggtgcaccaggcaggggtgctgggtggacttgtggaggtgctgctgggagccttagttcctgggggcccccctaccccaactcggcccccatgcacccgtgatgggccgtctgactgtgtcctggctgctgactggttgccttctctgctgctgttgttagagggcacacgctggcaagctctggtgcaggtgcagcccagtgtggaccccaccaatgccacaggcctcgatgggagggaggcagctcctcactttttgcagggtctgttgggtttgcttaccccaacaggggagctaggctccaaggaggctctttggggcggtctgctacgcacagtgggggcccccctctatgctgcctttcaggaggggctgctccgtgtcactcactccctgcaggatgaggtcttctccattttggggcagccagagcctgataccaatgggcagtgccagggaggtaaccttcaacagctgctcttatggggcgtccggcacaacctttcctgggatgtccaggcgctgggctttctgtctggatcaccacccccaccccctgccctccttcactgcctgagcacgggcgtgcctctgcccagagcttctcagccgtcagcccacatcagcccacgccaacggcgagccatcactgtggaggccctctgtgagaaccacttaggcccagcaccaccctacagcatttccaacttctccatccacttgctctgccagcacaccaagcctgccactccacagccccatcccagcaccactgccatctgccagacagctgtgtggtatgcagtgtcctgggcaccaggtgcccaaggctggctacaggcctgccacgaccagtttcctgatgagtttttggatgcgatctgcagtaacctctccttttcagccctgtctggctccaaccgccgcctggtgaagcggctctgtgctggcctgctcccaccccctaccagctgccctgaaggcctgccccctgttcccctcaccccagacatcttttggggctgcttcttggagaatgagactctgtgggctgagcgactgtgtggggaggcaagtctacaggctgtgccccccagcaaccaggcttgggtccagcatgtgtgccagggccccaccccagatgtcactgcctccccaccatgccacattggaccctgtggggaacgctgcccggatgggggcagcttcctggtgatggtctgtgccaatgacaccatgtatgaggtcctggtgcccttctggccttggctagcaggccaatgcaggataagtcgtgggggcaatgacacttgcttcctagaagggctgctgggcccccttctgccctctctgccaccactgggaccatccccactctgtctgacccctggccccttcctccttggcatgctatcccagttgccacgctgtcagtcctctgtcccagctcttgctcaccccacacgcctacactatctcctccgcctgctgaccttcctcttgggtccaggggctgggggcgctgaggcccaggggatgctgggtcgggccctactgctctccagtctcccagacaactgctccttctgggatgcctttcgcccagagggccggcgcagtgtgctacggacgattggggaatacctggaacaagatgaggagcagccaaccccatcaggctttgaacccactgtcaaccccagctctggtataagcaagatggagctgctggcctgctttagtgtgagtgctctgccagagggaaagctcctagaacagtgagaaggccctccaggggaattcctcgaatactcagaggcagtagtgtggggtagtagttgaagcacacagctctagagtcagacaggcttggattcatatcttggttctgtgaccagccttgaatgagttatttaacttctctgagcaatatttttctcgtctcatttataaactagggatgataatggtatatgagataatacatgctgtgggcttagcacagtgcatgatacacaaacatgcaataaatattaccttgttattctt

SEQ ID NO: 20932 - DNA, 5305 bp, Homo sapiens
  ENST00000541030
gccctgccctcacctggctatcccacacaggtgagaataaccagaactcacctccggtaccagtgttcacttggaaacatggctctcagcctctggcccctgctgctgctgctgctgctgctgctgctgctgtcctttgcagtgactctggcccctactgggcctcattccctggaccctggtctctccttcctgaagtcattgctctccactctggaccaggctccccagggctccctgagccgctcacggttctttacattcctggccaacatttcttcttcctttgagcctgggagaatgggggaaggaccagtaggagagcccccacctctccagccgcctgctctgcggctccatgattttctagtgacactgagaggtagccccgactgggagccaatgctagggctgctaggggatatgctggcactgctgggacaggagcagactccccgagatttcctggtgcaccaggcaggggtgctgggtggacttgtggaggtgctgctgggagccttagttcctgggggcccccctaccccaactcggcccccatgcacccgtgatgggccgtctgactgtgtcctggctgctgactggttgccttctctgctgctgttgttagagggcacacgctggcaagctctggtgcaggtgcagcccagtgtggaccccaccaatgccacaggcctcgatgggagggaggcagctcctcactttttgcagggtctgttgggtttgcttaccccaacaggggagctaggctccaaggaggctctttggggcggtctgctacgcacagtgggggcccccctctatgctgcctttcaggaggggctgctccgtgtcactcactccctgcaggatgaggtcttctccattttggggcagccagagcctgataccaatgggcagtgccagggaggtaaccttcaacagctgctcttatggggcgtccggcacaacctttcctgggatgtccaggcgctgggctttctgtctggatcaccacccccaccccctgccctccttcactgcctgagcacgggcgtgcctctgcccagagcttctcagccgtcagcccacatcagcccacgccaacggcgagccatcactgtggaggccctctgtgagaaccacttaggcccagcaccaccctacagcatttccaacttctccatccacttgctctgccagcacaccaagcctgccactccacagccccatcccagcaccactgccatctgccagacagctgtgtggtatgcagtgtcctgggcaccaggtgcccaaggctggctacaggcctgccacgaccagtttcctgatgagtttttggatgcgatctgcagtaacctctccttttcagccctgtctggctccaaccgccgcctggtgaagcggctctgtgctggcctgctcccaccccctaccagctgccctgaaggcctgccccctgttcccctcaccccagacatcttttggggctgcttcttggagaatgagactctgtgggctgagcgactgtgtggggaggcaagtctacaggctgtgccccccagcaaccaggcttgggtccagcatgtgtgccagggccccaccccagatgtcactgcctccccaccatgccacattggaccctgtggggaacgctgcccggatgggggcagcttcctggtgatggtctgtgccaatgacaccatgtatgaggtcctggtgcccttctggccttggctagcaggccaatgcaggataagtcgtgggggcaatgacacttgcttcctagaagggctgctgggcccccttctgccctctctgccaccactgggaccatccccactctgtctgacccctggccccttcctccttggcatgctatcccagttgccacgctgtcagtcctctgtcccagctcttgctcaccccacacgcctacactatctcctccgcctgctgaccttcctcttgggtccaggggctgggggcgctgaggcccaggggatgctgggtcgggccctactgctctccagtctcccagacaactgctccttctgggatgcctttcgcccagagggccggcgcagtgtgctacggacgattggggaatacctggaacaagatgaggagcagccaaccccatcaggctttgaacccactgtcaaccccagctctggtataagcaagatggagctgctggcctgctttagtcctgtgctgtgggatctgctccagagggaaaagagtgtttgggccctgcagattctagtgcaggcgtacctgcatatgcccccagaaaacctccagcagctggtgctttcagcagagagggaggctgcacagggcttcctgacactcatgctgcaggggaagctgcaggggaagctgcaggtaccaccatccgaggagcaggccctgggtcgcctgacagccctgctgctccagcggtacccacgcctcacctcccagctcttcattgacctgtcaccactcatccctttcttggctgtctctgacctgatgcgcttcccaccatccctgttagccaacgacagtgtacagcagggctacagagggtcagaggaaaacagtttggaggaagacaaagggttaagacccatgactcctcgcagcctggctgccatccgggattacagcccaggaatgaggcctgaacagaaggaggctctggcaaagcgactgctggcccctgaactgtttggggaagtgcctgcctggccccaggagctgctgtgggcagtgctgcccctgctcccccacctccctctggagaactttttgcagctcagccctcaccagatccaggccctggaggatagctggccagcagcaggtctggggccagggcatgcccgccatgtgctgcgcagcctggtaaaccagagtgtccaggatggtgaggagcaggtacgcaggcttgggcccctcgcctgtttcctgagccctgaggagctgcagagcctagtgcccctgagtgatccaacggggccagtagaacgggggctgctggaatgtgcagccaatgggaccctcagcccagaaggacgggtggcatatgaacttctgggtgtgttgcgctcatctggaggagcggtgctgagcccccgggagctgcgggtctgggcccctctcttctctcagctgggcctccgcttccttcaggagctgtcagagccccagcttagagccatgcttcctgtcctgcagggaactagtgttacacctgctcaggctgtcctgctgcttggacggctccttcctaggcacgatctgctacaactggattccttggctcttctggcaaatcgaagacgctactgggagctgccctggtctgagcagcaggcacagtttctctggaagaagatgcaagtacccaccaaccttaccctcaggaatctgcaggctctgggcaccctggcaggaggcatgtcctgtgagtttctgcagcagatcaactccatggtagacttccttgaagtggtgcacatgatctatcagctgcccactagagttcgagggagcctgagggcctgtatctgggcagagctacagcggaggatggcaatgccagaaccagaatggacaactgtagggccagaactgaacgggctggatagcaagctactcctggacttaccgatccagttgatggacagactatccaatgaatccattatgttggtggtggagctggtgcaaagagctccagagcagctgctggcactgacccccctccaccaggcagccctggcagagagggcactacaaaacctggctccaaaggagactccagtctcaggggaagtgctggagaccttaggccctttggttggattcctggggacagagagcacacgacagatccccctacagatcctgctgtcccatctcagtcagctgcaaggcttctgcctaggagagacatttgccacagagctgggatggctgctattgcaggagtctgttcttgggaaaccagagttgtggagccaggatgaagtagagcaagctggacgcctagtattcactctgtctactgaggcaatttccttgatccccagggaggccttgggtccagagaccctggagcggcttctagaaaagcagcagagctgggagcagagcagagttggacagctgtgtagggagccacagcttgctgccaagaaagcagccctggtagcaggggtggtgcgaccagctgctgaggatcttccagaacctgtgccaaattgtgcagatgtacgagggacattcccagcagcctggtctgcaacccagattgcagagatggagctctcagactttgaggactgcctgacattatttgcaggagacccaggacttgggcctgaggaactgcgggcagccatgggcaaagcaaaacagttgtggggtcccccccggggatttcgtcctgagcagatcctgcagcttggtaggctcttaataggtctaggagatcgggaactacaggagctgatcctagtggactggggagtgctgagcaccctggggcagatagatggctggagcaccactcagctccgcattgtggtctccagtttcctacggcagagtggtcggcatgtgagccacctggacttcgttcatctgacagcgctgggttatactctctgtggactgcggccagaggagctccagcacatcagcagttgggagttcagccaagcagctctcttcctcggcaccctgcatctccagtgctctgaggaacaactggaggttctggcccacctacttgtactgcctggtgggtttggcccaatcagtaactgggggcctgagatcttcactgaaattggcaccatagcagctgggatcccagacctggctctttcagcactgctgcggggacagatccagggcgttactcctcttgccatttctgtcatccctcctcctaaatttgctgtggtgtttagtcccatccaactatctagtctcaccagtgctcaggctgtggctgtcactcctgagcaaatggcctttctgagtcctgagcagcgacgagcagttgcatgggcccaacatgagggaaaggagagcccagaacagcaaggtcgaagtacagcctggggcctccaggactggtcacgaccttcctggtccctggtattgactatcagcttccttggccacctgctatgagcctgtctctacagtagaaggagattgtggggagagaaatcttaagtcataatgaataaagtgcaaacagaagtgcatcctgattattttcagaagctgatgaggaata

SEQ ID NO: 20933 - DNA, 5115 bp, Homo sapiens
  ENST00000249344
aaagcgagctgaaccctgaggggagccgctgaccagcagcatggaggaccccgccgcgcctgggaccgggggcccgcccgcaaatggcaatggcaacggcggcggcaaagggaagcaggcggcgcccaagggccgcgaagcgttccgaagccagcggcgggagtcagagggctctgtggactgtcccactctggagtttgagtatggagatgcagatgggcatgcagccgagttgtcagaattgtatagttacactgagaacctggaattcaccaataacaggaggtgctttgaagaagatttcaagactcaagtgcagggcaaggaatggctggagttggaagaagatgcccaaaaggcctatataatgggactcttggaccggctagaggtggtcagtagggaacggcggctgaaggtggcccgggctgttctctacctggcccaaggtacttttggggaatgtgattcagaggtcgatgtgctacactggtccaggtacaactgcttcctgctgtatcagatggggaccttctccaccttcctggagctactccacatggaaattgacaacagccaggcctgtagcagtgcccttcggaaaccagctgtctccatagctgatagcacagagctcagggtgctgctgagtgttatgtacctaatggtggaaaatattcgcctggagcgagagacagacccctgtgggtggagaacagcccgggagaccttccgcactgaattaagcttctccatgcataatgaggagccttttgcccttttactcttctccatggttaccaagttctgcagtggcctggctcctcacttccccataaagaaggtcctgctcctgctctggaaggtggtcatgtttaccctcggtggatttgagcatctgcagactctcaaagtacagaagcgggcagaattgggcctgcctccactggctgaagacagtatccaggtggtgaagagcatgcgtgctgcctccccgccctcttacactcttgacctgggagagtctcagctggcacccccaccctccaagctgcgaggccgccgtggctctcgaaggcaactcctcactaagcaggacagcctggacatctacaatgaaagggatctcttcaagactgaggagcccgccacagaggaggaagaggagtctgctggtgatggagaacgaaccttggatggagagctagacctgctagagcaggaccctctggtgccacctccaccctcacaggcacccctctctgctgagcgggtggcttttcccaagggcctgccctgggccccaaaggtcagacagaaggacattgagcacttcttggagatgagcaggaacaagttcatcggattcaccctggggcaggacacagatacattggttggattacccaggcccatccatgagagtgtgaagaccctaaagcagcacaagtatatctccatcgcagatgtgcagatcaagaatgaagaggagctggagaagtgccctatgtctttgggggaagaggtggtaccagagacgccatgtgaaatcctctaccagggaatgctgtacagccttccgcagtatatgatcgctctgcttaagattctgctggctgcagctcccacctctaaggctaagacagactctatcaatatcctggcagatgtcctacctgaggagatgcccatcactgttctccagagcatgaagctgggcatcgatgtgaacaggcacaaggagattattgtaaagagtatctctaccctgcttctgctactcctcaaacacttcaaactcaaccatatctaccagtttgaatatgtatcgcaacatttggtatttgccaactgcatccccttgatcctgaagttcttcaatcaaaatatcttgtcatacatcactgccaaaaacagcatctcagtcctggattatccttgctgtaccatccaggatttgccggagcttactactgaaagtctggaagctggagacaacagccagttctgctggaggaacctcttttcctgcatcaacctcctgaggctgctcaataaactgaccaaatggaaacattcccggaccatgatgctggtagtgtttaaatcggcaccaatcttaaagcgggccctcaaggtcaaacaggccatgctgcaactttatgtcctaaagctactaaagttacagaccaagtacctggggcgccaatggaggaaaagcaacatgaaaaccatgtcagccatttaccagaaagtgcgtcaccgcatgaacgatgactgggcttacgggaatgacatcgatgccagaccatgggacttccaagcagaagaatgtaccttgagggccaacattgaggcttttaacagccgtcgctatgacagaccccaggactctgagttttcacctgtggataactgcttgcagagcgtactggggcagaggttggatctgcctgaagatttccactattcatatgagctctggctcgagagagaggtgttttcacagcccatctgttgggaggagctgctccagaatcactgactaagttcttgtcaacaagcatcaatagatagaggtcagctccaataaactgtgctctgcctaccctgtccatacaggcgctgttaccagttcagggctcttctgggggctcttgggcctaaagatggtgcaagggtgggatcctgaatcacaataaaatgatcaacttgccctggggtcagttgggtgcccagttggccttggaaatcttttggtggatcaattctagacaagctctttggtaggaccttttcctgctttagtcttggctacaaccaggctagactttgctggctctaaaagaggaaatttgttatggcatttgacccatggcattcatcacagatagtgggaggtacaagtcataaaatagggagaaagttttcttcttgctcacactggattcctaggacttatcagagatttggaaaaaccaactttgaaattaagtttgcattttaaatttcaaatttggaagcctctttctgaaatcattagctctaagattattttagagcacctgcaccttctttgtgaaggatgatgatttactattccctcaatactgcatgttatcgaaaagtgtgttgtgtaaagtgtttttttcctcattctgtaagagatctatattcaatgtgaaaattatttccttgtgtactctgtatagggcatggaatgctctgccatttttaaagagccacaaccaatatgaaataattaggtcctctctaaggatgtttcatgtttttcttaaatgactccagtcttcaaatggctgagcatactgcagaaaattatccttttcatctaattcattttttaaatgacaagttaactacaggaggctttatttattcagatggtatgtccacttgtggtcgtgatcaatatatttttctaattgaaaagtaaaagcatcacagcttaccatttttctttttctgcagtgttgattaatgatttttttcccgtttattgctagcagtttcaaagtgtcatgtggagatttagcaatactgtctctacttaaaagtattgcacatttcattgaaaatgtgagagttgatataccagcctctttatatttctcttttacagcagaatcacatacttctcaagataaacaaggtttttaaaaaagtttctgatttagttaggatcatatgcttttttttttttttttttttttttttttttttttgagacagagtttcgctcttgttgcccaagctggagtgcaatggcacgatctcggctcactgcaacctccgcctcccgggttcaagcgattctcctgcctcagcctcccaaggagctgggattacaggcacgcaccaccatgcctggctaattttttgtatttttagtagaaacagggtttcaccatgttagccaggctgacctcaaactcctgacctcaggtgatccgcccgcctccacctcccagggtgctgggattacaggtgtgagccaccatgcccagcctcttcaagcttttttactatacatgttgcccctctcccccaacttaggcactactgaattttttatgatggcaccaggtcactttatgctgggtgatatagtcaaaatttgcttatttactctgcccctcgtcaaccacagtatcatttcaaggacatgaataaaatacttgacagtatccaaaggagctataccaaaatctaacaagtaaattttggattttgcctctttgtgctttaaagtaccaggatttctgtctctatggataggtcttggagaatgttaagtaatggatgaaactttttaaaataatttgtaaattttacctaagtaggacagtagtccttactgcaatcaaaataatttactgagcacaactcctgtaaattaatctacagtcaggctagtatgattttaatatgatttgagtaaaaagataattttcaaggaaagagtaatcatccatcaatttattataaagccagatagtattcaatttatgtcaagaacaaagaaattgcccttttaaaagcatgtacgtgaatgctttttgaggcacagaagtatgctaagctttaacattttgtatttatttacaacccttttctaagggaaggttacttctcagtgcagatggagaaactgaagcactaaggataaatgattagtttccaatcacatcatttttttccacagacttgctgggactagctttcaggtattgacagccagccccatatattaaggtaaccaggttgaatcttccaatttgagaacccatgtatgggttgcagtgagccgagatcatgccactgcactccatcctgggcaacaagaacgaaactccgtctcaaaaacaaagaaggatataataaagttaatatataaaccatgtatgtggttaggaataaattcaaattcaccagtctccaatggtgattacttttactacatagaaaaacattttagtgacttacagaggatttttatttgtgaatatttcagtaaagtttgtgttgattgttgataacactgttcatctactgaagcactttaataaaaataaaatgagctggaattagaaa

SEQ ID NO: 20934 - DNA, 2866 bp, Homo sapiens
  ENST00000435494
ccctgaggggagccgctgaccagcagcatggaggaccccgccgcgcctgggaccgggggcccgcccgcaaatggcaatggcaacggcggcggcaaagggaagcaggcggcgcccaagggccgcgaagcgttccgaagccagcggcgggagtcagagggctctgtggactgtcccactctggagtttgagtatggagatgcagatgggcatgcagccgagttgtcagaattgtatagttacactgagaacctggaattcaccaataacaggaggtgctttgaagaagatttcaagactcaagtgcagggcaaggaatggctggagttggaagaagatgcccaaaaggcctatataatgggactcttggaccggctagaggtggtcagtagggaacggcggctgaaggtggcccgggctgttctctacctggcccaaggtacttttggggaatgtgattcagaggtcgatgtgctacactggtccaggtacaactgcttcctgctgtatcagatggggaccttctccaccttcctggagctactccacatggaaattgacaacagccaggcctgtagcagtgcccttcggaaaccagctgtctccatagctgatagcacagagctcagggtgctgctgagtgttatgtacctaatggtggaaaatattcgcctggagcgagagacagacccctgtgggtggagaacagcccgggagaccttccgcactgaattaagcttctccatgcataatgaggagccttttgcccttttactcttctccatggttaccaagttctgcagtggcctggctcctcacttccccataaagaaggtcctgctcctgctctggaaggtggtcatgtttaccctcggtggatttgagcatctgcagactctcaaagtacagaagcgggcagaattgggcctgcctccactggctgaagacagtatccaggtggtgaagagcatgcgtgctgcctccccgccctcttacactcttgacctgggagagtctcagctggcacccccaccctccaagctgcgaggccgccgtggctctcgaaggcaactcctcactaagcaggacagcctggacatctacaatgaaagggatctcttcaagactgaggagcccgccacagaggaggaagaggagtctgctggtgatggagaacgaaccttggatggagagctagacctgctagagcaggaccctctggtgccacctccaccctcacaggcacccctctctgctgagcgggtggcttttcccaagggcctgccctgggccccaaaggtcagacagaaggacattgagcacttcttggagatgagcaggaacaagttcatcggattcaccctggggcaggacacagatacattggttggattacccaggcccatccatgagagtgtgaagaccctaaagcagcacaagtatatctccatcgcagatgtgcagatcaagaatgaagaggagctggagaagtgccctatgtctttgggggaagaggtggtaccagagacgccatgtgaaatcctctaccagggaatgctgtacagccttccgcagtatatgatcgctctgcttaagattctgctggctgcagctcccacctctaaggctaagacagactctatcaatatcctggcagatgtcctacctgaggagatgcccatcactgttctccagagcatgaagctgggcatcgatgtgaacaggcacaaggagattattgtaaagagtatctctaccctgcttctgctactcctcaaacacttcaaactcaaccatatctaccagtttgaatatgtatcgcaacatttggtatttgccaactgcatccccttgatcctgaagttcttcaatcaaaatatcttgtcatacatcactgccaaaaacagcatctcagtcctggattatccttgctgtaccatccaggatttgccggagcttactactgaaagtctggaagctggagacaacagccagttctgctggaggaacctcttttcctgcatcaacctcctgaggctgctcaataaactgaccaaatggaaacattcccggaccatgatgctggtagtgtttaaatcggcaccaatcttaaagcgggccctcaaggtcaaacaggccatgctgcaactttatgtcctaaagctactaaagttacagaccaagtacctggggcgccaatggaggaaaagcaacatgaaaaccatgtcagccatttaccagaaagtgcgtcaccgcatgaacgatgactgggcttacgggaatggtgagtcttcccaaagctcttgacttcctggagtttcctggggtttagacaaaactaaataaatatttatcactcctcttttggcatgaattgttacatattttagatgaaaaaatatgtgattataggtcaggcgctgatacaccaaactttaaggttatgcctcaaattctagtatgtacccttgtcctatgtaaactatgaaaatccgttttataaaacaagtaaattgagagataattaattgcctttccaaaacattcttttaaatgacagctttctccaaaagatttaaattaaaacaactttttattattacaaagcagttagaaaaaaagatagaaaatacaagtaaacaaacattttactatattatatttatgccatatttgtactatgcagaaattgccaccattaacatcttattgtatattcctccagatctttttctatgcatatacatgcatattttatcaaaatgaaagcaagttatgtatgctattttgtaattttctcttttaacattatctctaccttttcatgtcagtacattttcatttcatctaataaagttcatattcacaa

SEQ ID NO: 20935 - DNA, 587 bp, Homo sapiens
  ENST00000465033
gacatctacaatgaaagggatctcttcaagactgaggagcccgccacagaggaggaagaggagtctgctggtgatggagaacgaaccttggatggagagctagacctgctagagcaggaccctctggtgccacctccaccctcacaggcacccctctctgctgagcgggtggcttttcccaagggcctgccctgggccccaaaggtcagacagaaggacattgagcacttcttggagatgagcaggaacaagttcatcggattcaccctggggcaggacacagatacattggttggattacccaggcccatccatgagagtgtgaagaccctaaagcagcacaagtatatctccatcgcagatgtgcagatcaagaatgaagaggagctggagaagtgccctatgtctttggtgagccaaggaagccctacacaggaggagagtagaagaaaacctgtcttcagtgttgtcacagagcatgtgtgcatgcattcattcagcatattaggctgtaactgtgttccaggcaagacaaggtccctactttcatgatatattgaagttggggaagaaagataaaaaataaa

SEQ ID NO: 20936 - DNA, 8168 bp, Homo sapiens
  ENST00000263918
gcggccgccatggacgagcaggcgggtcccggcgtcttcttcagcaacaaccacccgggcgccggcggtgccaaggggctcgggcctctggcggaggctgccgcggccggcgacggggcggctgcggcgggggcggcccgagcccagtacagtctcccggggatcctgcacttcctgcagcacgagtgggcccgcttcgaggtggagagagcccagtgggaggtggagcgggcggagctgcaggcccagattgccttcctgcagggagaaaggaagggccaagaaaatttgaagaaggatcttgtgaggaggatcaaaatgttggagtatgctcttaaacaggaaagagccaaataccacaagttgaaatacgggacagaattgaatcagggagatatgaagcctccaagctatgattctgatgaaggtaatgaaacagaagtgcagccacaacaaaacagccagttaatgtggaaacaaggtcgacaactactcagacagtatctacaggaggtgggttatacagatactattctagatgtgaaatctaaacgagtgcgagctttgttgggcttttcaagtgatgtcacggacagggaagatgacaaaaatcaggactcagttgtaaatggcacagaggctgaagttaaagagacagcaatgattgcaaaatctgagttaacagattctgcctccgtgctggataatttcaaattccttgaaagtgcagctgcagatttcagtgatgaagatgaagatgatgatgttgatggaagagagaaaagcgtcattgatacttcaacaattgttaggaaaaaagcattgcctgacagcggtgaagatcgagatacaaaagaagctctaaaggagtttgacttcttggttacatcagaggaaggagacaatgaatctagaagtgcaggcgatggaacagactgggaaaaggaagaccagtgtctcatgcctgaagcctggaatgtggaccagggagtaattaccaaactcaaggaacaatacaaaaaggagagaaaggggaaaaagggggtgaagaggcccaataggtcaaaactacaagatatgcttgctaatttgagagatgttgatgaacttccttcattgcagccatctgtgggttcaccttccagacccagcagctccaggcttcctgaacatgaaattaatagggcagatgaagtggaagcattgacatttcctccttcttctggaaagtcattcatcatgggagcagatgaagcccttgaaagtgaactgggacttggagaactagcaggccttacggtggccaatgaagcagactcactaacttatgatatagcaaacaataaagatgcattgaggaagacatggaaccctaagtttacattgagaagtcactttgatggcatccgagcccttgctttccatcccattgagcctgttttgataacagcatcagaggatcacacattaaaaatgtggaatttacagaaaacagccccagccaaaaagagcacttctcttgatgtagaacctatctatacattcagagcccataaaggtccagtgctttgtgtggtaatgagcagcaatggtgagcagtgttacagtggtggtactgatggactgatccagggctggaataccactaatcccaacatcgacccctatgattcttatgatccttctgttttacgaggccctctgctaggccacacggatgcagtctggggtttggcttatagtgcagcacatcagcgtttgttgtcctgttcagcagatggcactctgcgtttatggaatacaactgaggttgctccagcactaagtgtatttaatgatactaaagaactgggaatccctgcctctgtggatctagtgagcagtgacccgagccatatggtagcatcattcagcaagggatatacaagcatttttaacatggaaacacaacaacgcattctcactttagaatccaatgtagatacaacagccaactcttcctgccaaataaatagagtcatcagtcatcctactcttccgatcagcatcactgctcatgaagacaggcacatcaaattctatgataacaatacaggcaaactgatccactcgatggtagcccacctagaagctgttacaagtttagcagttgatcccaatggcctttacttgatgtctggcagtcatgactgttcaatacgtttatggaatctagaaagtaagacgtgtatccaagaattcacagctcatcgaaaaaagtttgaagaatcgattcatgatgtagctttccacccatccaaatgctatatagccagtgctggagctgacgcactggctaaagtctttgtatgacgcaatgcatcatcttcaccttctagctgtttataagtaatcaactgcacacaagagatacagaagacgagggcaagaatcatctcgtcctgcccttttgttctgctgaaggagcacagagaacatttgttgaagtatagttttgcaattcatatactgttttctaaaactaaggtttgttcaggttgctgcaagctcagctgaatctgtgagcctgaggtctgtttcaaatttctccccaataggcgcctttatttctgaggtggttctaattcgctaggcaggcctgagcgaatacaagtttagcttgtccctgttgagtaagtagggcatgctacaatggataatttaaaagcttgatagctgggactgaatagaagaaaacgggaaacttagaccaagttctcccctgagaaatcttgttaaaacacattaagtagtcaaaatagtaatctttatcatatctgccatattaacccctttgtgtataatgaccaggcagtgttaaactgagtttttaatttgactctcctttcagctgttcacataaagcacctggcaaagcattttacctgttagggggagaaaaatgcaataatatgttaaatatattattattcagaaatgctagacaaatagtttgcaagcagatttctatattgtattacagttttgaaaacagatttggtatcattctaaagtttagctatcaagcactcaccattgtgaagaatagttgatcgactctgcttttactaacagatttaacttattcaggtttgaaattctgtttatttttaagggtaaacagggcatatctctttaataatttctattttaaaattcactttattcatgtgacatttatagtaccagagtgattatttcataccaatgaaatcttacttttcagtgactgaaaagatagaatttatttgctaataatcatttatcaacacccacctaatcatgcttcagatgatctgtgctctttcttctttgtcacgttcaagttatctgacatctaccaagaacagttcataattattaatagcccaaagagtatggttaacttcacgcagctgcttttgcagaagcactaataaaaacaaatattttgtaccctagaagtcctctattaatccctgtaagaatctcctggaaacctggatgaaagagtttaatgccaaatattggctaaaaagttctgtctttctctctccctattcctcccccattgtttaattgagatatacatgttttaatgggcagtggatcagtattgtttctggggaaatccacaccttaaaaggccaggcttccccagcccaacttacctgtgacccacctacatgtgttcaccttttgggattctgaagaccctgctatctagacctagtctcctgtcataaagacattatttctatagtggtttatgtctctcttactctttgtcccaaatgacagagaccaatctagaaattggaaataaattattaacgtccaactttccaccaaaaaacatataaataggctcttagattttaaaaatattaaatctatagatattttaaccaattaaaacaatttctacatattccattccccacattttccatcgtcataacaatgatgcttctcatgatacgtacatctactccttgaaaaagtattctggtggtggtgtggctaatgattgacaaatatttctgtaaaatttctgcctgtttgcctctagaattctgcattatacaggcaaattttctttaaagctagagacttgtgctaaatttgcctgattttcatacagatatgctgtagtaatacagctaccttttcatttcatctttgtgctttggttaacaagcaggctcaagagactgctttgtgtaattaaatgaattgacctaaacatgagctgtcaggtgaatacttaatatttccatgcagatacagaattccatattgtgttcagtaaatttcttttggttcttcacagtgaagaaagaatgtttctaacctaacatttgtagaaggatactggaaaattccttccaggaaggaaggaaggaagatgccattacttggtgtatttatgatggatgaccacaaagctattgttctaccagttattaattaccttctaagatcttcagttactgctttattaatgtcactgaaattctaaaaaccaggacattcttcccccgttcattttatgcttcatggttgaaatttttctgtcagtgagtggaaaataaccatgagatacatagactgtagcgcaaatggaactgttgaaagttccttagaaagccagtgctgtggcattggagactacggagagagtcttctctaccagcactgcatgatctcagcctagaaatgagccaaagctgtcttccaaccagagtagcatatacatgtgtctgacttttcccctagcctgttgaacattcaatgaaaattcacagaatgaacaaattcaatgtttaaacagccattgaaatgctttcatagtgcttcatttgtaaatattttgtttgaaatgtattggaatagtatgaaaattagcgggaggtttggatccctgccttattttcatatgctgtggatacatctctgggagcttgcagcacccttctcaaaactcaactgtcatatggagctcatttgctactcaaaccatagacagattatttaacaaaagtgatataatgaccttcagtatttttctattgaacaagtttaacaacttttgccattaaacaaatacttagttatgcaaaatatttcgcttttataatcattttagttatgactaaaacgggggaaattgagctgcatcactgatgatgaactttgtgagaaattttttttttaatctgactttcattccttcagtattcttgctataaatttcttttggagataatgatgaagatttatttgaaaatgtctaaaatgtatgtatattttataaatatatattatatatattgtaagaatatatataatatataaactatatatatatatatatatatatatatatatatatatatataaaccataggtgcattttactgttttgtattttcatttttggaggtagtatacacagcagataatgatgagtatgatgagtgttgtgctgtttgcttttgcagtataatatatagttctaagtgtttaaattactgtatatacaatattcattataggctagcatgcttgttttaaagactgtcattctagtgtattaaaatctgaatgtaagaaaacctggctattcaaatgtgaattgaaaaatattttattctcagtactgaactatttccattgaacattcagactttttaacaaaaacaaatatcatcaagaaggcaatagctagaaaatgagaggtgcctttaaaaaaaaaaatgcagccttacagtgaggatgaagattgagtttggggagggggtgggagggggggcacagagagagagagagagttagtgtgtgtgtgtgtgtgtgtgtgtgtgtgtgtgtgtgcatgcatgcgtgtgtgtgtgtgtgtgtgtgtttaccaatctgtgaaggtcctgatttgtgaccatcaatgtctttttaatgtatctgctcaacttctaggacttcaggggacatttcatgcgctttgtgctcttctgagcaccatatatactttccaagaattttgaatgtgaattcctagaaatttcagtagagaaaacaatagctattctttaattatagtaaagttcaggtagaaggagaaattatttgttcaccaaaattatgggatctcattaatgttggctaagtaaatgtaattttttaaaggctcactttttaatacttcatatatttccctcttacaaaacagcatgtcatgaagttcttatgtggtaaagattcaactagtaaatatttttaggttaaatacctgaactagttaaaattccacctaagaatagtcttaaaatatttaaaaagcatctctcatatctacctctttgtcattgctgccattttaactgaagcaaatctttatgacatctgaaatgatggttggatgcaattaaaaaaaaatctatgttggtgcttttctcaggctttgtcatttaagttatattgtattaagatgtcacaaatcagactgaaaggcttagaattaattttgtttttctttgaaagaattgcttaaaattaaccatcaatgtttttagcgagtggagataatgaatctttggttggtgtctgtctgtgtgatgttttcaaccaatagccaaataattattgaacttacatgaaaaagagtgctaagtataattttatttagattactttattctttgaaagtgactacaaggctattaagtacataatcattcattttatttactcagaagttgcctctccattactgttaacttgtttagtaatttatataattgcagtacttttaagtgttggacactgggattcaggttgtatacaaagtagtagctgacgaaaaatatgtatatttttgtgaaatgtatcaagccctaaagttcattttagagaaaggcccagaaaaacgtatctgtgtttaaaaacaaaggacaggtcattcgtcaatttgaatcatttttacttttgccactacaaactttttaattggcaatatccatcatccaactggatcttcatgtcagtgtcagggatgccaggttgacaaagtatttaacagatcctttcagtttttgttttgtttttttaattctaaaaaaaacaaatgttaggccaaacagatccctagatcccactcattgattctggcggtattcctaaagtggtgcttagggggtcagaattttctggatctttgctaatccaagctttagatttaatttaaccaggaccacatgcttgtcatctctctgatgcaaattttcaaaatcattttaatttagattctaatgtctgcctgggtttttaacaggctgtgaaccagtgagtgccttgttaatgtagaatgatttttcccccctgggtgggtgttagttagctcctctctgaaaatgtctcagagaatggtattttaattgacttgtagagagctgctaaatttgttattatcagcaatcagaaagtctttggtctaccacacatctccctccctactatctcttcattgtttggctgaagtttgcctcttgtgagaaaacaatacaactccccttctccacacactttttttccagcccagattaataggtatcccctaccctaatcccaactctatgatctaataccttttttaggaggaaccacttctttttaatattgaaatctgctggttactttatgttttctcaagttcagttgactagagctgaccacagggtgtcatcaattcagattcctaaataaccctttctctccacacccagtcctccagctggtgagccctgggccagattgtttgatcttcaggtattttaaattttagttacatcaattaatgtaaattaatccaaatgctaatttttgtggtgcaagaagtttcttatgtaaattcagggtatggataagctaattaagatatccatctttggtggctctaagtgtattatttgtttttaaataaagtgtacaaatatagataacatgctataggtgtctcatgaattggaatatttgtcagatttgggatctagctgtggctttacagtaatcagttaaattaacatagtctgatttggggcttttgggggaggagttgtagaggggtgcagagaaataaaaggatattagacaaagta

SEQ ID NO: 20937 - DNA, 1026 bp, Homo sapiens
  ENST00000495595
gcaagagacagctccatctgcagctggaagattatttattaacaagtcttactagcatagtactgtactgttaagtcttatgcaggcaatgagtttaaataaatacttttatttacatattaaattatagaatactgattccagtatgactgaactctaaggattctcttcacacaggtatctacaggaggtgggttatacagatactattctagatgtgaaatctaaacgagtgcgagctttgttgggcttttcaagtgatgtcacggacagggaagatgacaaaaatcaggactcagttgtaaatggcacagaggctgaagttaaagagacagcaatgattgcaaaatctgagttaacagattctgcctccgtgctggataatttcaaattccttgaaagtgcagctgcagatttcagtgatgaagatgaagatgatgatgttgatggaagagagaaaagcgtcattgatacttcaacaattgttaggaaaaaagcattgcctgacagcggtgaagatcgagatacaaaagaagctctaaaggagtttgacttcttggttacatcagaggaaggagacaatgaatctagaagtgcaggcgatggaacagactgggaaaaggaagaccagtgtctcatgcctgaagcctggaatgtggaccagggagtaattaccaaactcaaggaacaatacaaaaaggagagaaaggggaaaaagggggtgaagagtcaaaactacaagatatgcttgctaatttgagagatgttgatgaacttccttcattgcagccatctgtgggttcaccttccagacccagcagctccaggcttcctgaacatgaaattaatagggcagatgaagtggaagcattgacatttcctccttcttctggaaagtcattcatcatgggagcagatgaagcccttgaaagtgaactgggacttggagaactagcaggccttacggtggccaatgaagcagactcactaacttatgatatagcaaacaataaagatgcattgagg

SEQ ID NO: 20938 - DNA, 2254 bp, Homo sapiens
  ENST00000379213
cggccgccatggacgagcaggcgggtcccggcgtcttcttcagcaacaaccacccgggcgccggcggtgccaaggggctcgggcctctggcgggggcggcccgagcccagtacagtctcccggggatcctgcacttcctgcagcacgagtgggcccgcttcgaggtggagagagcccagtgggaggtggagcgggcggagctgcaggcccagattgccttcctgcagggagaaaggaagggccaagaaaatttgaagaaggatcttgtgaggaggatcaaaatgttggagtatgctcttaaacaggaaagagccaaataccacaagttgaaatacgggacagaattgaatcagggagatatgaagcctccaagctatgattctgatgaaggtaatgaaacagaagtgcagccacaacaaaacagccagttaatgtggaaacaaggtcgacaactactcagacagtatctacaggaggtgggttatacagatactattctagatgtgaaatctaaacgagtgcgagctttgttgggcttttcaagtgatgtcacggacagggaagatgacaaaaatcaggactcagttgtaaatggcacagaggctgaagttaaagagacagcaatgattgcaaaatctgagttaacagattctgcctccgtgctggataatttcaaattccttgaaagtgcagctgcagatttcagtgatgaagatgaagatgatgatgttgatggaagagagaaaagcgtcattgatacttcaacaattgttaggaaaaaagcattgcctgacagcggtgaagatcgagatacaaaagaagctctaaaggagtttgacttcttggttacatcagaggaaggagacaatgaatctagaagtgcaggcgatggaacagactgggggcccaataggtcaaaactacaagatatgcttgctaatttgagagatgttgatgaacttccttcattgcagccatctgtgggttcaccttccagacccagcagctccaggcttcctgaacatgaaattaatagggcagatgaagtggaagcattgacatttcctccttcttctggaaagtcattcatcatgggagcagatgaagcccttgaaagtgaactgggacttggagaactagcaggccttacggtggccaatgaagcagactcactaacttatgatatagcaaacaataaagatgcattgaggaagacatggaaccctaagtttacattgagaagtcactttgatggcatccgagcccttgctttccatcccattgagcctgttttgataacagcatcagaggatcacacattaaaaatgtggaatttacagaaaacagccccagccaaaaagagcacttctcttgatgtagaacctatctatacattcagagcccataaaggtccagtgctttgtgtggtaatgagcagcaatggtgagcagtgttacagtggtggtactgatggactgatccagggctggaataccactaatcccaacatcgacccctatgattcttatgatccttctgttttacgaggccctctgctaggccacacggatgcagtctggggtttggcttatagtgcagcacatcagcgtttgttgtcctgttcagcagatggcactctgcgtttatggaatacaactgaggttgctccagcactaagtgtatttaatgatactaaagaactgggaatccctgcctctgtggatctagtgagcagtgacccgagccatatggtagcatcattcagcaagggatatacaagcatttttaacatggaaacacaacaacgcattctcactttagaatccaatgtagatacaacagccaactcttcctgccaaataaatagagtcatcagtcatcctactcttccgatcagcatcactgctcatgaagacaggcacatcaaattctatgataacaatacaggcaaactgatccactcgatggtagcccacctagaagctgttacaagtttagcagttgatcccaatggcctttacttgatgtctggcagtcatgactgttcaatacgtttatggaatctagaaagtaagacgtgtatccaagaattcacagctcatcgaaaaaagtttgaagaatcgattcatgatgtagctttccacccatccaaatgctatatagccagtgctggagctgacgcactggctaaagtctttgtatgacgcaatgcatcatcttcaccttctagctgtttataagtaatcaactgcac

SEQ ID NO: 20939 - DNA, 2713 bp, Homo sapiens
  ENST00000259400
ctcgtgatgccccgccccgtcgctcctgcgcctgcgccgtgcccaccgaccggcctcgagcgccccggcgggaggtttttctatatgagtggagaagacagctgttaccagggaggtcatacaacatttttttaggatgtctgaagatgaagaaaaagtgaaattacgccgtcttgaaccagctatccagaaattcattaagatagtaatcccaacagacctggaaaggttaagaaagcaccagataaatattgagaagtatcaaaggtgcagaatctgggacaagttgcatgaagagcatatcaatgcaggacgtacagttcagcaactccgatccaatatccgagaaattgagaaactttgtttgaaagtccgaaaggatgacctagtacttctgaagagaatgatagatcctgttaaagaagaagcatcagcagcaacagcagaatttctccaactccatttggaatctgtagaagaacttaagaagcaatttaatgatgaagaaactttgctacagcctcctttgaccagatccatgactgttggtggagcatttcatactactgaagctgaagctagttctcagagtttgactcagatatatgccttacctgaaattcctcaagatcaaaatgctgcagaatcgtgggaaaccttagaagcggacttaattgaacttagccaactggtcactgacttctctctcctagtgaattctcagcaggagaagattgacagcattgcagaccatgtcaacagtgctgctgtgaatgttgaagagggaaccaaaaacttagggaaggctgcaaaatacaagctggcagctctgcctgtggcaggtgcactcatcgggggaatggtagggggtcctattggcctccttgcaggcttcaaagtggcaggaattgcagctgcacttggtggtggggtgttgggcttcacaggtggaaaattgatacaaagaaagaaacagaaaatgatggagaagctcacttccagctgtccagatcttcccagccaaactgacaagaaatgcagttaaaaaccaaatttcagtattattggtgccaacatgtctatcctgaggacctttgctgctgttggacactccgtcaccttttggaacacaagtatatcaagatagtggctactgatgttcaagtgggattgaagtgtgataaatggatatattttgttgtttgctggggtgttcatggagatgttaagagattgaggccctgggctgagggtatataatgtatgtcaggtaaagtttgaagactgccaaggagcagattttctccctggaaatgtgaaaactgaacctataactctgataaggacttgagatgtgtagaaacgttgggttatggaagactagtttcttccataaccctgaattggagaccttaatgctaagtgtagattattgaggtttgttagtgaggaaaagaataagagttcagaagcctttgttatcagatagcgaaatcagggcctagtgaggagcacaggtcgactacataatggagtccattggcgaaccctattgcaatttggtccaactatatcttctggtgaaggaaattaatgatgtaagaaaatgcaagaggctcaacttctcttccaaaaatcttctggcttctgaactcttcctctgcctctctttaaataaataacacagaatttcaagtggtaggagacttattaagccagtcaccaagcttggtctgtcagcctgtcttctaacacctcaaagatcttgtgccctgtgctgtccctcccttgtaattatgaaaagttctttggtttctggggtgaattctacccatgtataatgaggaattctctcataaccttttttgtcttgtctgtcatctctgttcatcccttcctataacctctaggtaaaaagaaaagaaaaaaagaaatttcgagatattttcaacattgttagagtttgggctaaaatgagcaaggagaaaaaaaccaccaagaacatttcctggggcatgttccagttttgaggggtgatatatctgccagatagggggtatctgacccagtcttcttttcagctggtctctggggggagctgagaactcgcttgctacctcacatccttttccccagactttttatctcctatgcatccctttgctttctatagctggtgtttcttccccaaaatggcgttcccatgcttacctttctcacattctagacaatgatggacaaagacgcatgcaagactcagacccggggaatggtgtggtgctaatctcaacacctgacattcacagcaagcatggcccagcccaactgcatgtctatctcaaaccgcagaaaggctttaatactggaaaaaaagaattcaagactacaggcagctcccctctgtaccccaactcatttaaaataggaggaatcactttttgccttacttaacgcttttttctgagcacagggatgggcacctgcaccccagaaggtgtgagctgtctctctgccaggagctaaggttcattaggggattggatggtttatcacttctttctttctgagtttacttttagtaacttttattgatggctacctttcatgtccctgtctaaagagactttctctttcatacgtcttaaatctcatcaatgaaatccagtgaaacagcaccatttcttagtatcattaaataactagaaagtatcaa

SEQ ID NO: 20940 - DNA, 858 bp, Homo sapiens
  ENST00000529340
gtgcccaccgaccggcctcgagcgccccggcgggaggtttttctatatgagtggagaagacagctgttaccagggaggtcatacaacatttttttaggatgtctgaagatgaagaaaaagtgaaattacgccgtcttgaaccagctatccagaaattcattaagatagtaatcccaacagacctggaaaggttaagaaagcaccagataaatattgagaaggtatacatacattaaagaagtaaatcattgtgagatatgagggaatttccttacttcacagcttccctttgaggaaagctcacaattgagaagtactgcctaattcagttgaggaaatagtatcaaaggtgcagaatctgggacaagttgcatgaagagcatatcaatgcaggacgtacagttcagcaactccgatccaatatccgagaaattgagaaactttgtttgaaagtccgaaaggatgacctagtacttctgaagagaatgatagatcctgttaaagaagaagcatcagcagcaacagcagaatttctccaactccatttggaatctgtagaagaacttaagaagcaatttaatgatgaagaaactttgctacagcctcctttgaccagatccatgactgttggtggacttaattgaacttagccaactggtcactgacttctctctcctagtgaattctcagcaggagaagattgacagcattgcagaccatgtcaacagtgctgctgtgaatgttgaagagggaaccaaaaacttagggaaggctgcaaaatacaagctggcagctctgcctgtggcaggtgcactcatcgggggaatggtagggggtcctattggcctccttgcaggc

SEQ ID NO: 20941 - DNA, 611 bp, Homo sapiens
  ENST00000533696
gcccaccgaccggcctcgagcgccccggcgggaggtttttctatatgagtggagaagacagctgttaccagggaggtcatacaacatttttttaggatgtctgaagatgaagaaaaagtgaaattacgccgtcttgaaccagctatccagaaattcattaagatagtaatcccaacagacctggaaaggttaagaaagcaccagataaatattgagaagtatcaaaggtgcagaatctgggacaagttgcatgaagagcatatcaatgcaggacgtacagttcaggtaaggctattatattttttctgctaaatcagtatgaaaaagacagtcttaagacaattttgctaaaatattacctttgcagctgaacccttttatacacatttgttactatttacttgaggatacatttttagcagaaattgctgaatcacatgccatacatattttcaaagttttgttttgttaccaaattttcctccagaaatgatacacagacttatactctcacaagcaatacattttgtaaaatcctttaacattggtattacccatttcttaaatttttgctaattgataggttaaaattgtgccacttcgttgttcta

SEQ ID NO: 20942 - DNA, 568 bp, Homo sapiens
  ENST00000531035
accgaccggcctcgagcgccccggcgggagagatgggattttggcatgttgcccaggctggccatgaactcctgggctcaagtggtcctcccgccttggcctcccaaagtgctggtattacagacatgagccaccgtacccggccccttcattcacaatttttcataaagattcagtggctccacaaagtctgtttttctatatgagtggagaagacagctgttaccagggaggtcatacaacatttttttaggatgtctgaagatgaagaaaaagtgaaattacgccgtcttgaaccagctatccagaaattcattaagatagtaatcccaacagacctggaaaggttaagaaagcaccagataaatattgagaagtatcaaaggtgcagaatctgggacaagttgcatgaagagcatatcaatgcaggacgtacagttcagcaactccgatccaatatccgagaaattgagaaactttgtttgaaagtccgaaaggatgacctagtacttctgaagagaatgatagatcctgttaaagaagaagcatcagcagcaacagcagaatt

SEQ ID NO: 20943 - DNA, 675 bp, Homo sapiens
  ENST00000525342
ccgaccggcctcgagcgccccggcgggaggtttttctatatgagtggagaagacagctgttaccagggaggtcatacaacatttttttaggatgtctgaagatgaagaaaaagtgaaattacgccgtcttgaaccagctatccagaaattcattaagatagtaatcccaacagacctggaaaggttaagaaagcaccagataaatattgagaagtatcaaaggtgcagaatctgggacaagttgcatgaagagcatatcaatgcaggacgtacagttcagtttaggaactacatttgagccttctccaaggatttcatcaactgtggaacaaaaattttttttttttaaatggacagttgcggccgggcgcggtggcttacgcctgtaatcccagcactttgggaggctgagcaactccgatccaatatccgagaaattgagaaactttgtttgaaagtccgaaaggatgacctagtacttctgaagagaatgatagatcctgttaaagaagaagcatcagcagcaacagcagaatttctccaactccatttggaatctgtagaagaacttaagaagcaatttaatgatgaagaaactttgctacagcctcctttgaccagatccatgactgttggtggagcatttcatactactgaagctgaagctagttctca

SEQ ID NO: 20944 - DNA, 941 bp, Homo sapiens
  ENST00000524405
cccggcgggaggtttttctatatgagtggagaagacagctgttaccagggaggtcatacaacatttttttaggatgtctgaagatgaagaaaaagtgaaattacgccgtcttgaaccagctatccagaaattcattaagatagtaatcccaacagacctggaaaggttaagaaagcaccagataaatattgagaagtatcaaaggtgcagaatctgggacaagttgcatgaagagcatatcaatgcaggacgtacagttcagcaactccgatccaatatccgagaaattgagaaactttgtttgaaagtccgaaaggatgacctagtacttctgaagagaatgatagatcctgttaaagaagaagcatcagcagcaacagcagaatttctccaactccatttggaatctgtagaagaacttaagaagcaatttaatgatgaagaaactttgctacagcctcctttgaccagatccatgactgttggtggacttaattgaacttagccaactggtcactgacttctctctcctagtgaattctcagcaggagaagattgacagcattgcagaccatgtcaacagtgctgctgtgaatgttgaagagggaaccaaaaacttagggaaggctgcaaaatacaagctggcagctctgcctgtggcaggtgcactcatcgggggaatggtagggggtcctattggcctccttgcaggcttcaaagtggcaggaattgcagctgcacttggtggtggggtgttgggcttcacaggtggaaaattgatacaaagaaagaaacagaaaatgatggagaagctcacttccagctgtccagatcttcccagccaaactgacaagaaatgcagttaaaaaccaaatttcagtattattggtgccaacatgtctatcctgaggacctttgctgctgttggacactccgtcacc

SEQ ID NO: 20945 - DNA, 2523 bp, Homo sapiens
  ENST00000525640
aaggggctctctggaggccgcctttgggggcgtcgggccctcacaggcttggtgggcctggcgcccgtgtggcgcgcgcaagaggcgctgggcggcaagtagggcattggatccgaagtgcgagcgccatggtggctcctcctgtttttcagaagtggcggagcctcgcttggtttcgtttttggaagctttattggaagctggtatagggaggccgcagacgatgcgagcaggacggcctcccggggtcgcggggtggaaaagtttccggcgcgcgtcctgtctctggcgcgctgtaggccccgggtcgccagggtcgctggcgtctgggtcccgggacagacccgcgcatccgttcgctggtgggggcgtttggtgtgtgtggcccaggtgtgctgtgggtgacactgcgaggaatgacgcgacgctcgatggtagtgaggctcggaggactgggagcgagaggccggaagcccctgctcgccaaacccagaggtggttggcagaaggtcccacaccttggctccctccttttagctaaccgaggttcagagaggagactttactttgacttttctctccaaattcggtatctcttccataagtcagaaacattaagcggcgggccggaagaaatcgggcgccactagtatcctgaaaagtgggagctctgggccgatggaaggtttttctatatgagtggagaagacagctgttaccagggaggtcatacaacatttttttaggatgtctgaagatgaagaaaaagtgaaattacgccgtcttgaaccagctatccagaaattcattaagatagtaatcccaacagacctggaaaggttaagaaagcaccagataaatattgagaagtatcaaaggtgcagaatctgggacaagttgcatgaagagcatatcaatgcaggacgtacagttcagcaactccgatccaatatccgagaaattgagaaactttgtttgaaagtccgaaaggatgacctagtacttctgaagagaatgatagatcctgttaaagaagaagcatcagcagcaacagcagaatttctccaactccatttggaatctgtagaagaacttaagaagcaatttaatgatgaagaaactttgctacagcctcctttgaccagatccatgactgttggtggagcatttcatactactgaagctgaagctagttctcagagtttgactcagatatatgccttacctgaaattcctcaagatcaaaatgctgcagaatcgtgggaaaccttagaagcggacttaattgaacttagccaactggtcactgacttctctctcctagtgaattctcagcaggagaagattgacagcattgcagaccatgtcaacagtgctgctgtgaatgttgaagagggaaccaaaaacttagggaaggctgcaaaatacaagctggcagctctgcctgtggcaggtgcactcatcgggggaatggtagggggtcctattggcctccttgcaggcttcaaagtggcaggaattgcagctgcacttggtggtggggtgttgggcttcacaggtggaaaattgatacaaagaaagaaacagaaaatgatggagaagctcacttccagctgtccagatcttcccagccaaactgacaagaaatgcagttaaaaaccaaatttcagtattattggtgccaacatgtctatcctgaggacctttgctgctgttggacactccgtcaccttttggaacacaagtatatcaagatagtggctactgatgttcaagtgggattgaagtgtgataaatggatatattttgttgtttgctggggtgttcatggagatgttaagagattgaggccctgggctgagggtatataatgtatgtcaggtaaagtttgaagactgccaaggagcagattttctccctggaaatgtgaaaactgaacctataactctgataaggacttgagatgtgtagaaacgttgggttatggaagactagtttcttccataaccctgaattggagaccttaatgctaagtgtagattattgaggtttgttagtgaggaaaagaataagagttcagaagcctttgttatcagatagcgaaatcagggcctagtgaggagcacaggtcgactacataatggagtccattggcgaaccctattgcaatttggtccaactatatcttctggtgaaggaaattaatgatgtaagaaaatgcaagaggctcaacttctcttccaaaaatcttctggcttctgaactcttcctctgcctctctttaaataaataacacagaatttcaagtggtaggagacttattaagccagtcaccaagcttggtctgtcagcctgtcttctaacacctcaaagatcttgtgccctgtgctgtccctcccttgtaattatgaaaagttctttggtttctggggtgaattctacccatgtataatgaggaattctctcataaccttttttgtcttgtctgtcatctctgttcatcccttcctataacctctaggt

SEQ ID NO: 20946 - DNA, 2424 bp, Homo sapiens
  ENST00000534052
gggctctctggaggccgcctttgggggcgtcgggccctcacaggcttggtgggcctggcgcccgtgtggcgcgcgcaagaggcgctgggcggcaagtagggcattggatccgaagtgcgagcgccatggtggctcctcctgtttttcagaagtggcggagcctcgcttggtttcgtttttggaagctttattggaagctggtatagggaggccgcagacgatgcgagcaggacggcctcccggggtcgcggggtggaaaagtttccggcgcgcgtcctgtctctggcgcgctgtaggccccgggtcgccagggtcgctggcgtctgggtcccgggacagacccgcgcatccgttcgctggtgggggcgtttggtgtgtgtggcccaggtgtgctgtgggtgacactgcgaggaatgacgcgacgctcgatggtagtgaggctcggaggactgggagcgagaggccggaagcccctgctcgccaaacccagaggtggttggcagaaggtcccacaccttggctccctccttttagctaaccgaggttcagagaggagactttactttgacttttctctccaaattcggtttttctatatgagtggagaagacagctgttaccagggaggtcatacaacatttttttaggatgtctgaagatgaagaaaaagtgaaattacgccgtcttgaaccagctatccagaaattcattaagatagtaatcccaacagacctggaaaggttaagaaagcaccagataaatattgagaagtatcaaaggtgcagaatctgggacaagttgcatgaagagcatatcaatgcaggacgtacagttcagcaactccgatccaatatccgagaaattgagaaactttgtttgaaagtccgaaaggatgacctagtacttctgaagagaatgatagatcctgttaaagaagaagcatcagcagcaacagcagaatttctccaactccatttggaatctgtagaagaacttaagaagcaatttaatgatgaagaaactttgctacagcctcctttgaccagatccatgactgttggtggagcatttcatactactgaagctgaagctagttctcagagtttgactcagatatatgccttacctgaaattcctcaagatcaaaatgctgcagaatcgtgggaaaccttagaagcggacttaattgaacttagccaactggtcactgacttctctctcctagtgaattctcagcaggagaagattgacagcattgcagaccatgtcaacagtgctgctgtgaatgttgaagagggaaccaaaaacttagggaaggctgcaaaatacaagctggcagctctgcctgtggcaggtgcactcatcgggggaatggtagggggtcctattggcctccttgcaggcttcaaagtggcaggaattgcagctgcacttggtggtggggtgttgggcttcacaggtggaaaattgatacaaagaaagaaacagaaaatgatggagaagctcacttccagctgtccagatcttcccagccaaactgacaagaaatgcagttaaaaaccaaatttcagtattattggtgccaacatgtctatcctgaggacctttgctgctgttggacactccgtcaccttttggaacacaagtatatcaagatagtggctactgatgttcaagtgggattgaagtgtgataaatggatatattttgttgtttgctggggtgttcatggagatgttaagagattgaggccctgggctgagggtatataatgtatgtcaggtaaagtttgaagactgccaaggagcagattttctccctggaaatgtgaaaactgaacctataactctgataaggacttgagatgtgtagaaacgttgggttatggaagactagtttcttccataaccctgaattggagaccttaatgctaagtgtagattattgaggtttgttagtgaggaaaagaataagagttcagaagcctttgttatcagatagcgaaatcagggcctagtgaggagcacaggtcgactacataatggagtccattggcgaaccctattgcaatttggtccaactatatcttctggtgaaggaaattaatgatgtaagaaaatgcaagaggctcaacttctcttccaaaaatcttctggcttctgaactcttcctctgcctctctttaaataaataacacagaatttcaagtggtaggagacttattaagccagtcaccaagcttggtctgtcagcctgtcttctaacacctcaaagatcttgtgccctgtgctgtccctcccttgtaattatgaaaagttctttggtttctggggtgaattctacccatgtataatgaggaattctctcataaccttttttgtcttgtctgtcatctctgttcatcccttcctataacctctaggt

SEQ ID NO: 20947 - DNA, 542 bp, Homo sapiens
  ENST00000526607
cgggccctcacaggcttggtgggcctggcgcccgtgtggcgcgcgcaagaggcgctgggcggcaagtagggcattggatccgaagtgcgagcgccatggtggctcctcctgtttttcagaagtggcggagcctcgcttggtttcgtttttggaagctttattggaagctggtatagggaggccgcagacgatgcgagcaggacggcctcccggggtcgcggggtggaaaagtttccggcgcgcgtcctgtctctggcgcgctgtaggccccgggtcgccagggtcgctggcgtctgggtcccgggacagacccgcgcatccgttcgctggtgggggcgtttggtgtgtgtggcccaggtttttctatatgagtggagaagacagctgttaccagggaggtcatacaacatttttttaggatgtctgaagatgaagaaaaagtgaaattacgccgtcttgaaccagctatccagaaattcattaagatagtaatcccaacagacctggaaaggttaagaaagcaccagataaatattgagaag

SEQ ID NO: 20948 - DNA, 342 bp, Homo sapiens
  ENST00000525579
tatcaaaggtgcagaatctgggacaagttgcatgaagagcatatcaatgcaggacgtacagttcagcaactccgatccaatatccgagaaattgagaaactttgtttgaaagtccgaaaggatgacctagtacttctgaagagaatgatagatcctgttaaagaagaagcatcagcagcaacagcagaatttctccaactccatttggaatctgtagaagaacttaagaagcaatttaatgatgaagaaactttgctacagcctcctttgaccagatccatgactgttggtggaagctgattggtatataaaaaaaaacttcggcagattttgaagaagtat

SEQ ID NO: 20949 - DNA, 828 bp, Homo sapiens
  ENST00000525847
agggtcttactcttatgattcattaggcttaactatagcgctgctcagtctgtggctaattatttctcatcatgggggcaaaacctttttgagtgcactactcaatgccctgtgaattaagagttttcccattttggctggtggcaacaggcagtgtctccagtgttgacaactccgatccaatatccgagaaattgagaaactttgtttgaaagtccgaaaggatgacctagtacttctgaagagaatgatagatcctgttaaagaagaagcatcagcagcaacagcagaatttctccaactccatttggaatctgtagaagaacttaagaagcaatttaatgatgaagaaactttgctacagcctcctttgaccagatccatgactgttggtggagcatttcatactactgaagctgaagctagttctcagagtttgactcagatatatgccttacctgaaattcctcaagatcaaaatgctgcagaatcgtgggaaaccttagaagcggacttaattgaacttagccaactggtcactgacttctctctcctagtgaattctcagcaggagaagattgacagcattgcagaccatgtcaacagtgctgctgtgaatgttgaagagggaaccaaaaacttagggaaggctgcaaaatacaagctggcagctctgcctgtggcaggtgcactcatcgggggaatggtagggggtcctattggcctccttgcaggcttcaaagtggcaggaattgcagctgcacttggtggtggggtgttgggcttcacaggtggaaaattgatacaaagaaagaaacagaaaatgat

SEQ ID NO: 20950 - DNA, 858 bp, Homo sapiens
  ENST00000529385
gtattttggggtttgattttgttgggttttttttttccatcaaacccaacatgacatgtaaatgcttatttggattttttttttctggaaagtagattcatttggagaataatatgtttgtatgtttgagtgaattttagcgtgagatgctttttgctgtaaagttgccacccttttattacctaataattaagaccccccccttttttttatgaaagttaatttgtcctttcgacatggcttatcagatgctattaatgaaccactattaagatggcaaggctgcagtacccagggccctgattacaggaattaaaatagtgtgtgttggctccctgctgctccccagcaggaccgctcactcataattcctttgcatctagtctcagcaggagaagattgacagcattgcagaccatgtcaacagtgctgctgtgaatgttgaagagggaaccaaaaacttagggaaggctgcaaaatacaagctggcagctctgcctgtggcaggtgcactcatcgggggaatggtagggggtcctattggcctccttgcaggcttcaaagtggcaggaattgcagctgcacttggtggtggggtgttgggcttcacaggtggaaaattgatacaaagaaagaaacagaaaatgatggagaagctcacttccagctgtccagatcttcccagccaaactgacaagaaatgcagttaaaaaccaaatttcagtattattggtgccaacatgtctatcctgaggacctttgctgctgttggacactccgtcaccttttggaacacaagtatatcaagatagtggctactgatgttcaagtgggattgaagtgtgataaatggatata

SEQ ID NO: 20951 - DNA, 549 bp, Homo sapiens
  ENST00000593535
gaagtgtgtgtctgaactcccatctgtgagcgtgtcgtcgaggtgtgcacctccagcgacttcgtgctcggcagcgcggacgcacctgcccgtcctccccgccagggactcaacttcctgggcctgggcgagaaccgacggcggggaggggccagaaattctgagcggagttattcggagtgtcaagaaggatggggagtggaaggtgcttatcatggatcacccaagcatgcgcatcttgtcttcctgctgcaaaatgtcagatatcctggctgagggcatcaccattgttgaagacatcaacaaacggcgggaacccattcccagtctggaggccatttatttgctgagccccacggagaagtcggttcaggccctgatcaaagacttccaggggaccccgactttcacctacaaagcggcccatatcttcttcaccgacacctgccccgagcccctgttcagtgagctaggccgctctcgtctggcaaaggtggtgaagacgttgaaggagattcaccttgccttcctcccctacgaggcccaggt

SEQ ID NO: 20952 - DNA, 821 bp, Homo sapiens
  ENST00000597467
accttgggacacacccggaagcggcggcggcgcccctcggggaagatggcgccctcggggctgaaggcggtggtgggggaaaaaattctgagcggagttattcggagtgtcaagaaggatggggagtggaaggtaggggtgaggcagatggctgggtacccagaggcagctcatcatcaggcctatggggaagaccctgaatgtgggacccccaagaactgcctgtccacatgggtggagttgggtgaatgggttctgggtcctcccacccagccagcccttgaaactgcccctcccactgccttggccccttctggggccagctgtggcctcttccgcctgctcctccatccatctgtccatccatctggacaggtgcttatcatggatcacccaagcatgcgcatcttgtcttcctgctgcaaaatgtcagatatcctggctgagggcatcaccagtgagtgaacgcgtccccagtgagatgggacctgagcgtgggaacccctgactgtgcccctctcccagggttcagcccttgagtgtaggatcccctcaaatcgtccagaactcccaagtacgcagctccctgcacggacagcccggatcatgtgaccaaatccattcttaaaccttgcaagctgactgcgggagcccatggattgcaggcctcccctgcagcactccctggctgcagccccttcctgaccgtgcagctccctcgtggagccctgtgtgggactcccagggtggactctggatgtggggtcccaagaatgcagagccttctatgggtgaccccaggtggtgtcccagtcactttg

SEQ ID NO: 20953 - DNA, 552 bp, Homo sapiens
  ENST00000595950
accttgggacacacccggaagcggcggcggcgcccctcggggaagatggcgccctcggggctgaaggcggtggtgggggaaaaaattctgagcggagttattcggagtgtcaagaaggatggggagtggaaggtgcttatcatggatcacccaagcatgcgcatcttgtcttcctgctgcaaaatgtcagatatcctggctgagggcatcaccacctgccccgagcccctgttcagtgagctaggccgctctcgtctggcaaaggtggtgaagacgttgaaggagattcaccttgccttcctcccctacgaggcccaggtgttctccctcgatgctccccacagcacctacaacctctactgccccttccgggcagaggagcgcacgcggcagctcgaggtgctggcccagcagattgccacgctgtgcgccaccctgcaggagtacccggccatccgctaccgcaagggcccagaggacacagcccagttggcccacgccgtcctggccaagctgaacgccttcaaggcagacactcccagtctgggcgag

SEQ ID NO: 20954 - DNA, 632 bp, Homo sapiens
  ENST00000595181
acacacccggaagcggcggcggcgcccctcggggaagatggcgccctcggggctgaaggcggtggtgggggaaaaaattctgagcggagttattcggagtgtcaagaaggatggggagtggaaggtgcttatcatggatcacccaagcatgcgcatcttgtcttcctgctgcaaaatgtcagatatcctggctgagggcatcaccattgttgaagacatcaacaaacggcgggaacccattcccagtctggaggccatttatttgctgagccccacggagaaggtgcctacatgagtgagcgtgtgtgtatgcgcgtgcatgcgtgtacatgtgcatgtgtgtgtatgtctgcatgcatgtgattgcatgtgtgcatgtgtatacgtgtgcatgtgtccatgtgtatgtgtgtgcatgtgtgtgcatgtgtgtgtgcatctgtgtatgcatgtgtgtgcgtgtttgcatgtgtgtctatgtatgtgtctgtgtgcatgtgcatgtgtgtgcgtctgtgtgtgcatttgtgtgtatgtgtgtatgcgtgtgtgtctgtgggtctgtgtgtgcatttgtgtctgtgcatgtgtgtatgcgtgtgtatgtatgtgtgtgtgcatctgtgtgcatc

SEQ ID NO: 20955 - DNA, 1914 bp, Homo sapiens
  ENST00000441779
acacacccggaagcggcggcggcgcccctcggggaagatggcgccctcggggctgaaggcggtggtgggggaaaaaattctgagcggagttattcggagtgtcaagaaggatggggagtggaaggtgcttatcatggatcacccaagcatgcgcatcttgtcttcctgctgcaaaatgtcagatatcctggctgagggcatcaccattgttgaagacatcaacaaacggcgggaacccattcccagtctggaggccatttatttgctgagccccacggagaaggctcaggcccagagagtgatccaccttccccagtcggttcaggccctgatcaaagacttccaggggaccccgactttcacctacaaagcggcccatatcttcttcaccgacacctgccccgagcccctgttcagtgagctaggccgctctcgtctggcaaaggtggtgaagacgttgaaggagattcaccttgccttcctcccctacgaggcccaggtgttctccctcgatgctccccacagcacctacaacctctactgccccttccgggcagaggagcgcacgcggcagctcgaggtgctggcccagcagattgccacgctgtgcgccaccctgcaggagtacccggccatccgctaccgcaagggcccagaggacacagcccagttggcccacgccgtcctggccaagctgaacgccttcaaggcagacactcccagtctgggcgagggcccagagaaaacccgctcccagctgctgataatggaccgggcagctgaccccgtgtccccactactgcatgagctcacgttccaggccatggcgtatgatctgctggacatagagcaggacacatacaggtatgagaccaccgggctgagcgaggcgcgggagaaggccgtcttgctggacgaggacgatgacttgtgggtggagcttcgccacatgcatatcgcagatgtgtccaagaaggtcacggagctcctgaggaccttctgtgagagcaagaggctgaccacggacaaggcgaacatcaaagacctatcccagatcctgaaaaagatgccgcagtaccagaaggagctgaataagtattctacgcacctgcatctagcagatgattgtatgaagcacttcaagggctcggtggagaagctgtgtagtgtggagcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgtgagtgaggagaacctggccaagctgatccagcatgccaatgtacaggcgcacagcagcctcatccgtaacctggagcagctgggaggcactgtcaccaaccccgggggctcggggacctccagccggctggagccgagagaacgcatggagcccacctatcagctgtcccgctggaccccggtcatcaaggatgtaatggaggacgccgtggaggaccggctggacaggaacctgtggcccttcgtatccgaccccgcccccacggccagctcccaggccgctgtcagtgcccgcttcggtcactggcacaagaacaaggctggcatagaagcccgggcgggcccccggctcatcgtgtatgtcatgggcggtgtggccatgtcagagatgagggccgcctacgaggtgaccagggccaccgagggcaagtgggaggtgctcattggctcctcacacatcctcaccccgacccgcttcctggatgacctgaaggcactggacaagaagctggaggacattgccctgccctgacccctggccccgccccctacccctccctttccagagaaataaactcttcccgtcgctctgcc

SEQ ID NO: 20956 - DNA, 589 bp, Homo sapiens
  ENST00000599905
acacccggaagcggcggcggcgcccctcggggaagatggcgccctcggggctgaaggcggtggtgggggaaaaaattctgagcggagttattcggagtgtcaagaaggatggggagtggaaggtgcttatcatggatcacccaagcatgcgcatcttgtcttcctgctgcaaaatgtcagatatcctggctgagggcatcaccagtgagtgaacgcgtccccagtgagatgggacctgagcgtgggaacccctgactgtgcccctctcccagggttcagcccttgagtgtaggatcccctcaaatcgtccagaactcccaagtacgcagctccctgcacggacagcccggatcatgtgaccaaatccattcttaaaccttgcaagctgactgcgggagcccatggattgcaggcctcccctgcagcactccctggctgcagccccttcctgaccgtgcagctccctcgtggagccctgtgtgggactcccagggtggactctggatgtggggtcccaagaatgcagagccttctatgggtgaccccaggtggtgtcccagtcactttgccattgagggataggtgctga

SEQ ID NO: 20957 - DNA, 1876 bp, Homo sapiens
  ENST00000221283
ccggaagcggcggcggcgcccctcggggaagatggcgccctcggggctgaaggcggtggtgggggaaaaaattctgagcggagttattcggagtgtcaagaaggatggggagtggaaggtgcttatcatggatcacccaagcatgcgcatcttgtcttcctgctgcaaaatgtcagatatcctggctgagggcatcaccattgttgaagacatcaacaaacggcgggaacccattcccagtctggaggccatttatttgctgagccccacggagaagtcggttcaggccctgatcaaagacttccaggggaccccgactttcacctacaaagcggcccatatcttcttcaccgacacctgccccgagcccctgttcagtgagctaggccgctctcgtctggcaaaggtggtgaagacgttgaaggagattcaccttgccttcctcccctacgaggcccaggtgttctccctcgatgctccccacagcacctacaacctctactgccccttccgggcagaggagcgcacgcggcagctcgaggtgctggcccagcagattgccacgctgtgcgccaccctgcaggagtacccggccatccgctaccgcaagggcccagaggacacagcccagttggcccacgccgtcctggccaagctgaacgccttcaaggcagacactcccagtctgggcgagggcccagagaaaacccgctcccagctgctgataatggaccgggcagctgaccccgtgtccccactactgcatgagctcacgttccaggccatggcgtatgatctgctggacatagagcaggacacatacaggtatgagaccaccgggctgagcgaggcgcgggagaaggccgtcttgctggacgaggacgatgacttgtgggtggagcttcgccacatgcatatcgcagatgtgtccaagaaggtcacggagctcctgaggaccttctgtgagagcaagaggctgaccacggacaaggcgaacatcaaagacctatcccagatcctgaaaaagatgccgcagtaccagaaggagctgaataagtattctacgcacctgcatctagcagatgattgtatgaagcacttcaagggctcggtggagaagctgtgtagtgtggagcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgtgagtgaggagaacctggccaagctgatccagcatgccaatgtacaggcgcacagcagcctcatccgtaacctggagcagctgggaggcactgtcaccaaccccgggggctcggggacctccagccggctggagccgagagaacgcatggagcccacctatcagctgtcccgctggaccccggtcatcaaggatgtaatggaggacgccgtggaggaccggctggacaggaacctgtggcccttcgtatccgaccccgcccccacggccagctcccaggccgctgtcagtgcccgcttcggtcactggcacaagaacaaggctggcatagaagcccgggcgggcccccggctcatcgtgtatgtcatgggcggtgtggccatgtcagagatgagggccgcctacgaggtgaccagggccaccgagggcaagtgggaggtgctcattggctcctcacacatcctcaccccgacccgcttcctggatgacctgaaggcactggacaagaagctggaggacattgccctgccctgacccctggccccgccccctacccctccctttccagagaaataaactcttcccgtcgctctgcca

SEQ ID NO: 20958 - DNA, 1785 bp, Homo sapiens
  ENST00000597068
gaagcggcggcggcgcccctcggggaagatggcgccctcggggctgaaggcggtggtgggggaaaaaattctgagcggagttattcggagtgtcaagaaggatggggagtggaaggtgcttatcatggatcacccaagcatgcgcatcttgtcttcctgctgcaaaatgtcagatatcctggctgagggcatcaccattgttgaagacatcaacaaacggcgggaacccattcccagtctggaggccatttatttgctgagccccacggagaagtcggttcaggccctgatcaaagacttccaggggaccccgactttcacctacaaagcggcccatatcttcttcaccgacacctgccccgagcccctgttcagtgagctaggccgctctcgtctggcaaaggtggtgaagacgttgaaggagattcaccttgccttcctcccctacgaggcccaggtgttctccctcgatgctccccacagcacctacaacctctactgccccttccgggcagaggagcgcacgcggcagctcgaggtgctggcccagcagattgccacgctgtgcgccaccctgcaggagtacccggccatccgctaccgcaagggcccagaggacacagcccagttggcccacgccgtcctggccaagctgaacgccttcaaggcagacactcccagtctgggcgagggcccagagaaaacccgctcccagctgctgataatggaccgggcagctgaccccgtgtccccactactgcatgagctcacgttccaggccatggcgtatgatctgctggacatagagcaggacacatacaggtatgagaccaccgggctgagcgaggcgcgggagaaggccgtcttgctggacgaggacgatgacttgtgggtggagcttcgccacatgcatatcgcagatgtgtccaagaaggtcacggagctcctgaggaccttctgtgagagcaagaggctgaccacggacaaggcgaacatcaaagacctatcccagatcctgaaaaagatgccgcagtaccagaaggagctgaataaggacctggccatgggctccgacgcagagggggagaagatcaaggactccatgaagctgatcgttccggtgctgctggacgcggcggtgcccgcctacgacaagatccgggtcctgctgctctacatcctccttcggaatgctacccctctggacccgggaaccctcctccattggcttggggattcctccactgaggtgtgagtgaggagaacctggccaagctgatccagcatgccaatgtacaggcgcacagcagcctcatccgtaacctggagcagctgggaggcactgtcaccaaccccgggggctcggggacctccagccggctggagccgagagaacgcatggagcccacctatcagctgtcccgctggaccccggtcatcaaggatgtaatggaggacgccgtggaggaccggctggacaggaacctgtggcccttcgtatccgaccccgcccccacggccagctcccaggccgctgtcagtgcccgcttcggtcactggcacaagaacaaggctggcatagaagcccgggcgggcccccggctcatcgtgtatgtcatgggcggtgtggccatgtcagagatgagggccgcctacgaggtgaccagggccaccgagggcaagtgggaggtgctcattggctcctcacacatcctcaccccgacccgcttcctggatgacctgaaggcactggacaagaagctggaggacattgccctgccctga

SEQ ID NO: 20959 - DNA, 1859 bp, Homo sapiens
  ENST00000414284
ggcggcggcgcccctcggggaagatggcgccctcggggctgaaggcggtggtgggggaaaaaattctgagcggagttattcggagtgtcaagaaggatggggagtggaaggtgcttatcatggatcacccaagcatgcgcatcttgtcttcctgctgcaaaatgtcagatatcctggctgagggcatcaccattgttgaagacatcaacaaacggcgggaacccattcccagtctggaggccatttatttgctgagccccacggagaaggccctgatcaaagacttccaggggaccccgactttcacctacaaagcggcccatatcttcttcaccgacacctgccccgagcccctgttcagtgagctaggccgctctcgtctggcaaaggtggtgaagacgttgaaggagattcaccttgccttcctcccctacgaggcccaggtgttctccctcgatgctccccacagcacctacaacctctactgccccttccgggcagaggagcgcacgcggcagctcgaggtgctggcccagcagattgccacgctgtgcgccaccctgcaggagtacccggccatccgctaccgcaagggcccagaggacacagcccagttggcccacgccgtcctggccaagctgaacgccttcaaggcagacactcccagtctgggcgagggcccagagaaaacccgctcccagctgctgataatggaccgggcagctgaccccgtgtccccactactgcatgagctcacgttccaggccatggcgtatgatctgctggacatagagcaggacacatacaggtatgagaccaccgggctgagcgaggcgcgggagaaggccgtcttgctggacgaggacgatgacttgtgggtggagcttcgccacatgcatatcgcagatgtgtccaagaaggtcacggagctcctgaggaccttctgtgagagcaagaggctgaccacggacaaggcgaacatcaaagacctatcccagatcctgaaaaagatgccgcagtaccagaaggagctgaataagtattctacgcacctgcatctagcagatgattgtatgaagcacttcaagggctcggtggagaagctgtgtagtgtggagcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgtgagtgaggagaacctggccaagctgatccagcatgccaatgtacaggcgcacagcagcctcatccgtaacctggagcagctgggaggcactgtcaccaaccccgggggctcggggacctccagccggctggagccgagagaacgcatggagcccacctatcagctgtcccgctggaccccggtcatcaaggatgtaatggaggacgccgtggaggaccggctggacaggaacctgtggcccttcgtatccgaccccgcccccacggccagctcccaggccgctgtcagtgcccgcttcggtcactggcacaagaacaaggctggcatagaagcccgggcgggcccccggctcatcgtgtatgtcatgggcggtgtggccatgtcagagatgagggccgcctacgaggtgaccagggccaccgagggcaagtgggaggtgctcattggctcctcacacatcctcaccccgacccgcttcctggatgacctgaaggcactggacaagaagctggaggacattgccctgccctgacccctggccccgccccctacccctccctttccagagaaataaactcttcccgtcgctctgcca

SEQ ID NO: 20960 - DNA, 1523 bp, Homo sapiens
  ENST00000599737
ggagttattcggagtgtcaagaaggatggggagtggaaggtgcttatcatggatcacccaagcatgcgcatcttgtcttcctgctgcaaaatgtcagatatcctggctgagggcatcaccattgttgaagacatcaacaaacggcgggaacccattcccagtctggaggccatttatttgctgagccccacggagaagtcggttcaggccctgatcaaagacttccaggggaccccgactttcacctacaaagcggcccatatcttcttcaccgacacctgccccgagcccctgttcagtgagctaggccgctctcgtctggcaaaggtggtgaagacgttgaaggagattcaccttgccttcctcccctacgaggcccaggggcccagaggacacagcccagttggcccacgccgtcctggccaagctgaacgccttcaaggcagacactcccagtctgggcgagggcccagagaaaacccgctcccagctgctgataatggaccgggcagctgaccccgtgtccccactactgcatgagctcacgttccaggccatggcgtatgatctgctggacatagagcaggacacatacaggtatgagaccaccgggctgagcgaggcgcgggagaaggccgtcttgctggacgaggacgatgacttgtgggtggagcttcgccacatgcatatcgcagatgtgtccaagaaggtcacggagctcctgaggaccttctgtgagagcaagaggctgaccacggacaaggcgaacatcaaagacctatcccagatcctgaaaaagatgccgcagtaccagaaggagctgaataagtattctacgcacctgcatctagcagatgattgtatgaagcacttcaagggctcggtggagaagctgtgtagtgtggagcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgtgagtgaggagaacctggccaagctgatccagcatgccaatgtacaggcgcacagcagcctcatccgtaacctggagcagctgggaggcactgtcaccaaccccggggacgccgtggaggaccggctggacaggaacctgtggcccttcgtatccgaccccgcccccacggccagctcccaggccgctgtcagtgcccgcttcggtcactggcacaagaacaaggctggcatagaagcccgggcgggcccccggctcatcgtgtatgtcatgggcggtgtggccatgtcagagatgagggccgcctacgaggtgaccagggccaccgagggcaagtgggaggtgctcattggctcctcacacatcctcaccccgacccgcttcctggatgacctgaaggcactggacaagaagctggaggacattgccctgccctgacccctggccccgccccctacccctccctttccag

SEQ ID NO: 20961 - DNA, 472 bp, Homo sapiens
  ENST00000599648
ccctgatcaaagacttccaggggaccccgactttcacctacaaagcggcccatatcttcttcaccgacagtgagtgaggagagcctagggtgttggtgggtggggcaaggaggtgtgggggctgctctggcctgatgccccactcctgcctcaccccagcctgccccgagcccctgttcagtgagctaggccgctctcgtctggcaaaggtggtgaagacgttgaaggagattcaccttgccttcctcccctacgaggcccaggtgttctccctcgatgctccccacagcacctacaacctctactgccccttccgggcagaggagcgcacgcggcagctcgaggtgctggcccagcagattgccacgctgtgcgccaccctgcaggagtacccggccatccgctaccgcaagtggggaccccacccagccccaccccgatgccgacccccccttaaccgcgtgcaacacct

SEQ ID NO: 20962 - DNA, 747 bp, Homo sapiens
  ENST00000594221
gtacccggccatccgctaccgcaagggcccagaggacacagcccagttggcccacgccgtcctggccaagctgaacgccttcaaggcagacactcccagtctgggcgagggcccagagaaaacccgctcccagctgctgataatggaccgggcagctgaccccgtgtccccactactgcatgagctcacgttccaggccatggcgtatgatctgctggacatagagcaggacacatacaggtatgagaccaccgggctgagcgaggcgcgggagaaggccgtcttgctggacgaggacgatgacttgtgggtggagcttcgccacatgcatatcgcagatgtgtccaagtgcgtgcacacggggaccggatcccccccccaccgcccactgtgggcctggtagcggccttgggatccctggctgctgccaagtctttggccctcatgagcacccctcgtgtgactccagactggcctccaatttcaccccacctctccctgtcccccctgagtgggctcacccatggcctgtggctcctctcccctcactctcacccccgcccaccctcatggccaggaaggtcacggagctcctgaggaccttctgtgagagcaagaggctgaccacggacaaggcgaacatcaaagacctatcccagatcctgaaaaagatgccgcagtaccagaaggagctgaataagtattctacgcacctgcatctagcagatgattgtatgaagcacttca

SEQ ID NO: 20963 - DNA, 430 bp, Homo sapiens
  ENST00000595861
cagctgaccccgtgtccccactactgcatgagctcacgttccaggccatggcgtatgatctgctggacatagagcaggacacatacaggtatgagaccaccgggctgagcgaggcgcgggagaaggccgtcttgctggacgaggacgatgacttgtgggtggagcttcgccacatgcatatcgcagatgtgtccaagaaggtcacggagctcctgaggaccttctgtgagagcaagaggctgaccacggacaaggcgaacatcaaagacctatcccagatcctgaaaaagatgccgcagtaccagaaggagctgaataagtattctacgcacctgcatctagcagatgattgtatgaagcacttcaagggctcggtggagaagctgtgtagtgtggagcaggtggggcagggcttgcggggggcaggggt

SEQ ID NO: 20964 - DNA, 770 bp, Homo sapiens
  ENST00000600702
cctgaggaccttctgtgagagcaagaggctgaccacggacaaggcgaacatcaaagacctatcccagatcctgaaaaagatgccgcagtaccagaaggagctgaataagtattctacgcacctgcatctagcagatgattgtatgaagcacttcaagggctcggtggagaagctgtgtagtgtggagcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgtgagtgaggagaacctggccaagctgatccagcatgccaatgtacaggcgcacagcagcctcatccgtaacctggagcagctgggaggcactgtcaccaaccccgggggctcggggacctccagccggctggagccgagagaacgcatggagcccacctatcagctgtcccgctggaccccggtcatcaaggatgtaatggaggacgccgtggaggaccggctggacaggaacctgtggcccttcgtatccgaccccgcccccacggccagctcccaggccgctgtcaggctcctcacacatcctcaccccgacccgcttcctggatgacctgaaggcactggacaagaagctggaggacattgccctgccctgacccctggccccgccccctacccctccctttccagagaaataaactcttcccgtcgctctgcca

SEQ ID NO: 20965 - DNA, 811 bp, Homo sapiens
  ENST00000599400
ctcggtggagaagctgtgtagtgtggagcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgtgagtgaggagaacctggccaagctgatccagcatgccaatgtacaggcgcacagcagcctcatccgtaacctggagcagctgggaggcactgtcaccaaccccgggccacaccaggcgcagcccctctgtgaccagcctccttcccctcaatccccctgctgccctccctgccctgcctgtagggctcggggacctccagccggctggagccgagagaacgcatggagcccacctatcagctgtcccgctggaccccggtcatcaaggatgtaatggaggacgccgtggaggaccggctggacaggaacctgtggcccttcgtatccgaccccgcccccacggccagctcccaggccgctgtcagtgcccgcttcggtcactggcacaagaacaaggctggcatagaagcccgggcgggcccccggctcatcgtgtatgtcatgggcggtgtggccatgtcagagatgagggccgcctacgaggtgaccagggccaccgagggcaagtgggaggtgctcattggctcctcacacatcctcaccccgacccgcttcctggatgacctgaaggcactggacaagaagctggaggacattgccctgccctgacccctggccccgccccctacccctccct

SEQ ID NO: 20966 - DNA, 704 bp, Homo sapiens
  ENST00000593854
ggagccttggagaggtagtctcaggatagtggtgtgacctgtgtgtaggtgggtggggcactggaaaggtgggacctgggtgaggagcagggcctgtggagagactgtccctggacaggggtgggaccttgagagacctggtgctgagatgaggtaggacccaaatgtcctcttgccgaggatcctggggatgtccttggcccgcctctcccatccccttccctgacacatagcggccggtggacggctgaccccatgcccgcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgtgagtgaggagaacctggccaagctgatccagcatgccaatgtacaggcgcacagcagcctcatccgtaacctggagcagctgggaggcactgtcaccaaccccgggggctcggggacctccagccggctggagccgagagaacgcatggagcccacctatcagctgtcccgctggaccccggtcatcaaggatgtaatggaggtactgggtggcaggtcagggtgggggccagccctccgcatcggctggcggctcagcctccctcctgctgaggtgctaagcctcagggcttagg

SEQ ID NO: 20967 - DNA, 1974 bp, Homo sapiens
  ENST00000595800
atgtcctcttgccgaggatcctggggatgtccttggcccgcctctcccatccccttccctgacacatagcggccggtggacggctgaccccatgcccgcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgtgagtgaggagaacctggccaagctgatccagcatgccaatgtacaggcgcacagcagcctcatccgtaacctggagcagctgggaggcactgtcaccaaccccgggggctcggggacctccagccggctggagccgagagaacgcatggagcccacctatcagctgtcccgctggaccccggtcatcaaggatgtaatggaggtactgggtggcaggtcagggtgggggccagccctccgcatcggctggcggctcagcctccctcctgctgaggtgctaagcctcagggcttaggggaaaatgctcattgctggcattcccttggcaccgatctgctctgctgaggggggcacgccaagcccgcagctgaggaattggggtgacagcggggcctgtgctggggagcctcacttcctccccacctgccggctgcctccgctatatctctctagtctgttcccctgtcccgcaggagtgcccctgagccccagccctggccttcccaggatcccagggcagcaccatccaatggcaatgggcctggggcggcttcctggcttcctccttgtccctctaagagccccggcccctctttctgcgtgggggccagagacctgggcctcctcatccccatggaccttgaatacctggacttctggggctctgaggggctgagagcccagacactgggttccccaaagggctgggggtattgactgatggtccccaagggcctggaggcccagactactgggttgccgaggaactgtgggtttagacttctgggtacccaaggagttatggaattagattcgtgggtccccagtgagttatggatctagatttctaggtccccaatggactagaggcctagactcctgggtcccccagaggcaggaggtggagatgctggttcctgtctgccaggatcttggcccctgaataccccgtggggggcactcctgaccccggaccccatgcctggggttcctcccctaacctgcctctcggccgccaggacgccgtggaggaccggctggacaggaacctgtggcccttcgtatccgaccccgcccccacggccagctcccaggccgctgtcaggtgaggccccggggccgcccccgcccacgcctgggtctgtgttaggtgggcggcctggcggcggtgagggcctcctgcctggactttctgcccctgccctgcacagtgcccgcttcggtcactggcacaagaacaaggctggcatagaagcccgggcgggcccccggctcatcgtgtatgtcatgggcggtgtggccatgtcagagatgagggccgcctacgaggtgaccagggccaccgagggcaagtgggaggtgctcattggtaagtcaccaggactgggaccctggggtctggggcttgggttcccggggcctgggcttgtaccttctaggtgtctggactccagagtccttggagtcagggacctggtttgctgagggacagggacagccccacaccagccgggaccgggagcctgtcaaagacgaaggcagcgccccccaacatcttccccaaacctctgcccctgcacaggctcctcacacatcctcaccccgacccgcttcctggatgacctgaaggcactggacaagaagctggaggacattgccctgccctgacccctggccccgccccctacccctccctttccagagaaataaactcttcccgtcgctctgcc

SEQ ID NO: 20968 - DNA, 385 bp, Homo sapiens
  ENST00000599558
cttccctgacacatagcggccggtggacggctgaccccatgcccgcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgtgagtgaggagaacctggccaagctgatccagcatgccaatgtacaggcgcacagcagcctcatccgtaacctggagcagctgggaggcactgtcaccaaccccggggtacgccaggagcgggcatggggggaccctgggagagggtgcggatcacagccggggctctgcaaggcagagggccattggtgcacag

SEQ ID NO: 20969 - DNA, 706 bp, Homo sapiens
  ENST00000601061
ggtgtgagtgaggagaacctggccaagctgatccagcatgccaatgtacaggcgcacagcagcctcatccgtaacctggagcagctgggaggcactgtcaccaaccccgggggctcggggacctccagccggctggagccgagagaacgcatggagcccacctatcagctgtcccgctggaccccggtcatcaaggatgtaatggaggacgccgtggaggaccggctggacaggaacctgtggcccttcgtatccgaccccgcccccacggccagctcccaggccgctgtcaggtgaggccccggggccgcccccgcccacgcctgggtctgtgttaggtgggcggcctggcggcggtgagggcctcctgcctggactttctgcccctgccctgcacagtgcccgcttcggtcactggcacaagaacaaggctggcatagaagcccgggcgggcccccggctcatcgtgtatgtcatgggcggtgtggccatgtcagagatgagggccgcctacgaggtgaccagggccaccgagggcaagtgggaggtgctcattggctcctcacacatcctcaccccgacccgcttcctggatgacctgaaggcactggacaagaagctggaggacattgccctgccctgacccctggccccgccccctacccctccctttccagagaaataaactcttcccgtcgctctgcca

SEQ ID NO: 20970 - DNA, 716 bp, Homo sapiens
  ENST00000602355
ttgccttcatactttgtctcactgcttcttatctctttgcctatctctgcctctgtctttgtctttctctggctcgctctctctccctttggctttctctctccgtctctctctggctcactgtttctctctctcgctttcttgctgtctctcgctctctctcgctctctgttccacttccccatctttgcctgccatcccccaccctaccagccacaccaggcgcagcccctctgtgaccagcctccttcccctcaatccccctgctgccctccctgccctgcctgtagggctcggggacctccagccggctggagccgagagaacgcatggagcccacctatcagctgtcccgctggaccccggtcatcaaggatgtaatggaggacgccgtggaggaccggctggacaggaacctgtggcccttcgtatccgaccccgcccccacggccagctcccaggccgctgtcagtgcccgcttcggtcactggcacaagaacaaggctggcatagaagcccgggcgggcccccggctcatcgtgtatgtcatgggcggtgtggccatgtcagagatgagggccgcctacgaggtgaccagggccaccgagggcaagtgggaggtgctcattggctcctcacacatcctcaccccgacccgcttcctggatgacctgaaggcactggacaagaagctggaggacattgccctgccctga

SEQ ID NO: 20971 - DNA, 295 bp, Homo sapiens
  ENST00000599278
ggttcctgtctgccaggatcttggcccctgaataccccgtggggggcactcctgaccccggaccccatgcctggggttcctcccctaacctgcctctcggccgccaggacgccgtggaggaccggctggacaggaacctgtggcccttcgtatccgaccccgcccccacggccagctcccaggccgctgtcagtgcccgcttcggtcactggcacaagaacaaggctggcatagaagcccgggcgggcccccggctcatcgtgtatgtcatgggcggtgtggccatgtcagagat

SEQ ID NO: 20972 - DNA, 1188 bp, Homo sapiens
  ENST00000612033
tgcatgcgtgtacatgtgcatgtgtgcatgtgtgtgcatgtgtgtgtgcatctgtgtatgcatgtgtgtgcgtgcatgtgtgtctatgtatgtgtctgtgtgcatgtgcatgtgtgtgcgtctgtgtgtgcatttgtgtgtatgtgtgtatgcgtgtgtgtctgtgggtctgtgtgtgcatttgtgtctgtgcatgtgtgtatgcgtgtgtattgtgtgtgcatctgtgtgcatctgtatgtgtgtgtgtgcgtctgtctgtgtgcatgtgtgtatgcgtgtgtatgtatgtgtctgcgtctgtgtgtgcgtctgtgtgtatctgtgtgtgcatgtgtgtatgcgtgtatatgtatgtgcatctgtgtgcatgtgtctatgtatgtgtgtgcatctgtgtgtgcgtgtgtatgcgtgtgtgtatgcgtctgtcatgtgtgtatgcgtgtgtgtgcgcatcagtgtctgcatgtgtgtatatgtgtgtatgtatgttgcgcgcgcatctgtgtgtgtgcatgtgtgtatgtatgtgtgtgcatctctgtgtgtgcatgtgtgtatgtgtgtgtgcatctgtgtgtgtgtgcatgtgtgcatgcgtgtgtatgtgtgtgtgcgtgcgtgcatctgtgtgtgtgcgcgtgtgcccatgtgggtgcgacactagtgtgcatttgcacatatacatgtccccgtccgtccatgtttgcacatggtggcagatggggggtggctgggaggcctaggcagccaatgagcctaggtgtgcaggctcaggcccagagagtgatccaccttccccagtcggttcaggccctgatcaaagacttccaggggaccccgactttcacctacaaagcggcccatatcttcttcaccgacacctgccccgagcccctgttcagtgagctaggccgctctcgtctggcaaaggtggtgaagacgttgaaggagattcaccttgccttcctcccctacgaggcccaggtacggcccgggctcatcctgggcagggggtgggggtttgtgaccaaatgtcccctgttccctcagaaacagacactgaggctgggcgcagtggctcatacctgtaatcccagcgctgtgggaggccagggcaggaggatcacttggggccaggagtttgagaccagcctgggtacagagcaagaccccgtctcttaa

SEQ ID NO: 20973 - DNA, 561 bp, Homo sapiens
  ENST00000483586
gcttctgcggccaaagtaggttgggagtggaaggtggtggctgctgctccgcagtgtcgggaagatggcgccgccggtggcagagagggggctaaagagcgtcgtgtggcagaagataaaagcaacagtgtttgatgactgcaagaaagaaggcgaatggaagataatgcttttagatgaatttaccactaagcttttggcatcgtgttgcaaaatgacagatcttctagaagaaggtattactgttgtagagaatatttataagaaccgtgaacctgtcagacaaatgaaagctctttatttcatcactccgacatcaaaggtgagtattttgagaccttaaaaagcaggttcatcaatatttcaccattgttatggtttactaacagaaaattcaaagtaataaagtacactttagtagaaaaatattgccataaactagtttgcttaggaaagtttttttctgtgttagaagattatttgcattcttccgaatgagaatgtataagtaaaaggattccttttttccccatatatgaaagcagaattaaattgtataaa

SEQ ID NO: 20974 - DNA, 294 bp, Homo sapiens
  ENST00000469338
ggccaaagtaggttgggagtggaaggtggtggctgctgctccgcagtgtcgggaagatggcgccgccggtggcagagagggggctaaagagcgtcgtgtggcagaagataaaagcaacagtgtttgatgactgcaagaaagaaggcgaatggaagataatgcttttagatgaatttaccactaagcttttggcatcgtgttgcaaaatgacagatcttctagaagaaggtattactggtaagtgttattcttggcatgaacactttttaattgtaattgggggagatctgaggt

SEQ ID NO: 20975 - DNA, 2478 bp, Homo sapiens
  ENST00000370008
agtaggttgggagtggaaggtggtggctgctgctccgcagtgtcgggaagatggcgccgccggtggcagagagggggctaaagagcgtcgtgtggcagaagataaaagcaacagtgtttgatgactgcaagaaagaaggcgaatggaagataatgcttttagatgaatttaccactaagcttttggcatcgtgttgcaaaatgacagatcttctagaagaaggtattactgttgtagagaatatttataagaaccgtgaacctgtcagacaaatgaaagctctttatttcatcactccgacatcaaagtctgtagattgtttcttacatgattttgcaagtaaatcggagaacaagtataaagcagcatatatttacttcactgacttttgccctgataatctctttaacaaaattaaggcttcttgctccaagtcaataagaagatgtaaagaaataaatatttccttcattccacatgaatctcaggtgtatactcttgatgtaccagatgcattctattactgttatagtccagaccctggtaatgcaaagggaaaagatgccattatggaaacaatggctgaccagatagttacagtgtgtgccaccttggatgaaaatcccggagtaagatataaaagtaaacctctagataatgccagtaagcttgcacagcttgttgaaaaaaagcttgaagactactacaagattgatgaaaagagcctaataaagggtaaaactcattcacagctcttaataattgatcgtggctttgatcctgtgtccactgtcctgcatgaactgacctttcaggcaatggcatatgatctactaccaattgagaatgatacatacaaatataaaacagatggaaaagaaaaggaggccatccttgaagaagaagatgacctctgggttagaattcgacatcgacatattgcggttgtgttagaggaaattcccaagcttatgaaagaaatttcatcaacaaagaaagcaacagaaggaaagacatcacttagtgctcttacccagctgatgaaaaagatgccccatttccgaaaacagattactaagcaagttgtccatcttaacttagcagaagattgcatgaataagttcaagcttaatatagaaaagctctgcaaaactgaacaggacctggcacttggaactgatgcagaaggacagaaggtgaaagattccatgcgagtactccttccagttctactcaacaaaaatcatgataattgtgataaaataagagcaattctactttatatcttcagtattaatggaactacggaagaaaatttggacaggttgatccagaatgtaaagatagaaaatgagagtgacatgattcgtaactggagttaccttggtgttcccattgttccccaatctcaacaaggcaaaccgttaagaaaggatcggtctgcagaagaaacttttcagctctctcggtggacaccttttatcaaagatattatggaggatgctattgataatagattagattcaaaagaatggccatattgttcccagtgtccagcagtatggaatggttcaggagctgtaagtgctcgccagaaacccagagctaattatttagaagaccgaaaaaatgggtcaaagctgattgtttttgtaattggagggatcacatactctgaagtgcgttgtgcttatgaagtttctcaggcacataaatcctgtgaagttattattggttctacacatgttttaacacccaaaaagctgttggatgatataaagatgctgaataaacccaaggataaagtctccttaattaaagatgaatagcatttctttttggagggtttagagattcttactaatatgttgaactaaaatagaaagaaaatgttgctgtcatgtaatttaaacaatgtaaatattttatggaataatggcttttcaaatacatttcttaaggaactgtttatgattattactggatttgtcatttttgataatttaaatattgctgctgctttgtagatgatgagaagaaatgttaaagtgctttctaaaaggaaattttttcacctttggaggagaatatattagagttgtgggtaatttttcacagccacctatgtacatactaattacccattggatacttatatctaaaagtctcatgctgaagtatagtttttgggaaagaatgattttaaataaagagattgtaaaagtaaaaaactgtaaatgtatatgtatgatagaattgtttcctctaagtgtagtttttctttcaactaaaattcagtttatgtgtaaaataattcagtcattaatagaaatggagtgatttcacagtgtgtactgttttgccacatacttctaaagaacacaattttatataattttgaaatcatgtatgtttaaattagaaaaccaaaaatcatgaacattctaagagaaaataaatatagaatttaaaaaatta

SEQ ID NO: 20976 - DNA, 514 bp, Homo sapiens
  ENST00000486601
actctgccatatgatcacatagaaaactggtaactaaagaatcacagagaagtccaaagacacatacaattctgtcttatgttacatgttatataatatacttcaaaataaaaatatcatatctaagttaagtcttggtctctgctgttagagattcctcactttaatttgccctgataatctctttaacaaaattaaggcttcttgctccaagtcaataagaagatgtaaagaaataaatatttccttcattccacatgaatctcaggtgtatactcttgatgtaccagatgcattctattactgttatagtccagaccctggtaatgcaaagggaaaagatgccattatggaaacaatggctgaccagatagttacagtgtgtgccaccttggatgaaaatcccggagtaagatataaaagtaaacctctagataatgccagtaagcttgcacagcttgttgaaaaaaagcttgaagactactacaagattgatgaaaagagcctaataaag

SEQ ID NO: 20977 - DNA, 2536 bp, Homo sapiens
  ENST00000485167
ataaatatttccttcattccacatgaatctcaggtgtatactcttgatgtaccagatgcattctattactgttatagtccagaccctggtaatgcaaagggaaaagatgccattatggaaacaatggctgaccagatagttacagtgtgtgccaccttggatgaaaatcccggagtaagatataaaagtaaacctctagataatgccagtaagcttgcacagcttgttgaaaaaaagcttgaagactactacaagattgatgaaaagagcctaataaagggtaaaactcattcacagctcttaataattgatcgtggctttgatcctgtgtccactgtcctgcatgaactgacctttcaggcaatggcatatgatctactaccaattgagaatgatacatacaagcaagtataacttgaagggcatataaagggcatatacaaacaggatagaatatgagcatttaatgatttatataggcaccagaaatctgaaagcccctataaccttttctattcagagactttatccttctcttattcctacagttatagtctttgacagataatgttgaccttgtaaattaaagtgtaatttgattgctttggagcatttttggtgtgtttgcttccttaactgtgtgtacagtagagctacatttaaacacagggaatttggcccttttgcttttaaaagtaaataccaggctcactatcattgaaggagaaaccatattcaaaattgttaggctataattgttctgaatcatacattcaaaagtgtatgtgtcttatcaacataaagtattttaaaagattggaacactagaaaactaaataggatggctattgaggacaacaggcatagttttaccattttggtaccttctactgagttaatcttggtataaacatatttactttaaaagtaatgtcaaataaaaacctaaatgaaaaatgaaatagttttctatcaaggaatcatcttactgtatctctgtatcatttatggtgtatgtgttacatacattacaaatgttatttgatgtcatgatttctgaatccaaactggtatttgtcagctaagatttactgcttgagtacagtaataaaaatgaaaatagttttctgaaattttatgtttaaactaatttgttagttttaagatacagacacttgtgatagttatgatactgttttttttcttaaatattgttaaaatttgtattttctattgtatttttatttgcattctggtcaaatcttggtttctgagtttttctctgtattatctgtattaatgttagataacatagctatttttctaatataaaagttattttaagcagtttattcagaggggatattatttacctctgttaccctgtaggtctctaaacttttaagtagacttattttttaaaaagctactatactcccttctttctgaatcaaaaacattcagagataagaattagatggaagtaaagctccctgtggtttgtgctccatcacaattttttttttttttttttttttttttagtagaggcagggtttccccatgttggccaggctagtcttgaactcctgacctcaggtgatccccctgcctcggcctcccaaagtgctgggattgcaggggtgagccaccacgcccagccttcatcacagttttttatggaaacagaatacaaagcagcaggaagctctaagtgtccagattcaagttttcatgttggtgccttctttaaatttacttttttttttttttctttttttgagacagagtcttactctgtcacccaggctggagtgcagtggcgcgatctctgctcattgcagccttcgtcccctgagttcaaatgattcccagcctcagcctcccaagtaactgggactacaagtgtgcaccactgcgcctggctcatttttgtgtttttagtagaaatggggttttgctgtgttggccaggctggtctcgaactcctggcctcacatgatccacccacctcggcctcccaactaaatttacttttaaaatgggatattcatcacctgagtattgtcaggcttgttactcttatctctgtttacagatcacttataagtcaaaggtattgtgtaagaacaaagtggtattttaaatgacaaaagggctttcatccttagtgcagccttatataattgagcacagtgattctgtctttggtcatctgtaatccacacaggtggatggttttatagattgatgtgtaatttgtgggggttatagaaacgattatattcatatagcaaagtctatatgtattatttgtagttcagagctaggaaaactcaatgcagtccttcctgatcttgactcaggaaatcagtagttccaaggatgattcagtcttgtctagttccacaaatggaaggagggtgtctgcataaaaagataaggggaatcagtcaggaagcccattttgaatagcttcatgaatcccttaaattgttgctcacttcagcagaactcattaaagctatcacaatttt

SEQ ID NO: 20978 - DNA, 765 bp, Homo sapiens
  ENST00000495245
accacaccctgctaagtttttgtatttttttttagagacagggtttcaccttgttagccaggctggttttgaactcctgacctcaagtgatccgcccaccttggcctccgaaagtgctaaaattacaggcgtgagccactgcacctggccgatattcctgttcttaatggaaatttgataattgtactgtgggttattagcacatcaaaacaatgttgtagggaattagaacacaaagcgttagtatattgagtcttgttcttaaagttaactgtaggacgttgaattttttttataaagtacaattttgctgaactaaaactctaataatggcacctaaactgaatatttgaaaatgtcttggtaggcttaggacttatttttaatgtaaggatagcagcgtgccttagttttgagtaggtattcattacccccctaaaatagtggattttacttttcagtttcttgagttgtgtcttgaaattattgtttgtaaaaatgtttcttttgattttggagggaaaaaaatcaaaaagttttagtgcttctgtctacttgtagatataaaacagatggaaaagaaaaggaggccatccttgaagaagaagatgacctctgggttagaattcgacatcgacatattgcggttgtgttagaggaaattcccaagcttatgaaagaaatttcatcaacaaagaaagcaacagaaggaaagacatcacttagtgctcttacccagctgatgaaaaagatgccccatttccg

SEQ ID NO: 20979 - DNA, 752 bp, Homo sapiens
  ENST00000472099
acctggcacttggaactgatgcagaaggacagaaggtgaaagattccatgcgagtactccttccagttctactcaacaaaaatcatgataattgtgataaaataagagcaattctactttatatcttcagtattaatggtaatggagataatcactttttaataagtattttactattgatcataaaagaatctttgaaaactgaaagatagttgctgaacttggttaagataaaagggaaaatatgaaatcgagagaagactgaaggagatataatttgactgttttttattttaaaagcttcattcatgggtactacctaaagccttgaaattattttggtagcaattgtgtgattgtgcactcatatttttacctatttaaggaactacggaagaaaatttggacaggttgatccagaatgtaaagatagaaaatgagagtgacatgattcgtaactggagttaccttggtgttcccattgttccccaatctcaacaaggcaaaccgttaagaaaggatcggtctgcagaagaaacttttcagctctctcggtggacaccttttatcaaagatattatggaggatgctattgataatagattagattcaaaagaatggccatattgttcccagtgtccagcagtatggaatggttcaggagctgtaagtgctcgccagaaacccagagctaattatttagaagaccgaaaaaatgggtcaaagctgattgtttttgtaattggagggat

SEQ ID NO: 20980 - DNA, 412 bp, Homo sapiens
  ENST00000479472
aaaagaaatgaagttgatgtatgtcccaagttttgatgaaactgtatttgtaaaaaaaattttgtagtttaagtattgtcatacagtgttcaaaaccccagccaatgaccagcagttggtatgaagaacctttgacattttgtaaaaggccatttcttgggagttttttggtgtgtctgtttttttaaagtattcaagatactaccagtcaacatctttttggaagaaaatgccttgggtttagaagattttcttaaaaggggagtagatggttgtagattgactaaaaagtctaccatacttcaagggactacagctgcacccacctctggatcaaagaacttctaggacatcaagccaattatcttctgtaataccctacccctaatatagatacccccaactcacctca

SEQ ID NO: 20981 - DNA, 4915 bp, Homo sapiens
  ENST00000359930
cacttgagccgaagttaatttctcggggagttctcgggcgcgcacaggcagctcggtttgccctgcgattgagctgcgggtcgcggccggcgccggcctctccaatggcaaatgtgtgtggctggaggcgagcgcgaggctttcggcaaaggcagtcgagtgtttgcagaccggggcgagtcctgtgaaagcagataaaagaaaacatttattaacgtgtcattacgaggggagcgcccggccggggctgtcgcactccccgcggaacatttggctccctccagctccgagagaggagaagaagaaagcggaaaagaggcagattcacgtcgtttccagccaagtggacctgatcgatggccctcctgaatttatcacgatatttgatttattagcgatgccccctggtttgtgtgttacgcacacacacgtgcacacaaggctctggctcgcttccctccctcgtttccagctcctgggcgaatcccacatctgtttcaactctccgccgagggcgagcaggagcgagagtgtgtcgagtgagtgtgcgtctgtgtgtcccggcgagggtgcgcgctcggcgccgggagcgcggccagccgagtccggaggcatcgggaggtcgagagccgccgggaccccagctctgcgttcactgccccgtccggagctggacttcggggccggggccggggccgtgcgccggggacaggcagggccgggtcgcgggccgcgcgtcccccaggccggagatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacgatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgaatccccacatcgtcctcaacattgacctggcccccaccatcctggacattgcaggcctggacatacctgcggatatggacgggaaatccatcctcaagctgctggacacggagcggccggtgaatcggtttcacttgaaaaagaagatgagggtctggcgggactccttcttggtggagagaggcaagctgctacacaagagagacaatgacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctgggacttaaagatggaggaagctatgagcaatacaggcagtttcagcgtcgaaagtggccagaaatgaagagaccttcttccaaatcactgggacaactgtgggaaggctgggaaggttaagaaacaacagaggtggacctccaaaaacatagaggcatcacctgactgcacaggcaatgaaaaaccatgtgggtgatttccagcagacctgtggtattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaatccctcgcagttgtggacatttctgttcctgtccagataccatttctcctagtatttctttgttatgtcccagaactgatgttttttttttaaggtactgaaaagaaatgaagttgatgtatgtcccaagttttgatgaaactgtatttgtaaaaaaaattttgtagtttaagtattgtcatacagtgttcaaaaccccagccaatgaccagcagttggtatgaagaacctttgacattttgtaaaaggccatttcttgggagttttttggtgtgtctgtttttttaaagtattcaagatactaccagtcaacatctttttggaagaaaatgccttgggtttagaagattttcttaaaaggggagtagatggttgtagattgactaaaaagtctaccatacttcaagggactacaggtaagtctcatagtataccagctttggtacttcattttttaaaaaagtattaatcaattgcaaagaaattcgccttggccaacccttctttgtgtatcaggtagtctaacctgatacaagtagttgacagatttcaactatcaatcaccagtccaacccatttctcatttaacagatgacggagataatccctaaaagcacccacatttgtttcaatgccccaaacaggccaaggctccctagcaactccctagtggcgttttttaacttctcagaaactgttaccattatttgaaataggcttccttaacctcctttacccttaacccaacagggattt

SEQ ID NO: 20982 - DNA, 1319 bp, Homo sapiens
  ENST00000479970
gacttaaagatggaggaagctatgagcaatacaggtatttcgttttattattaaagcctaaacaaagttctcctatcttggcccatccttcagtctcatctctgtgagtctgcacctgttatcttgagaaactgcccttccctctggtctgcccgagaccaggatcacccaccaaagataggtgtcacctaggagaccttctttgtatagttctttggggactttttctttcttggtgatggttaacattcattctcctttgacacttgaaaacttaggcagtttcagcgtcgaaagtggccagaaatgaagagaccttcttccaaatcactgggacaactgtgggaaggctgggaaggttaagaaacaacagaggtggacctccaaaaacatagaggcatcacctgactgcacaggcaatgaaaaaccatgtgggtgatttccagcagacctgtggtattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaatccctcgcagttgtggacatttctgttcctgtccagataccatttctcctagtatttctttgttatgtcccagaactgatgttttttttttaaggtactgaaaagaaatgaagttgatgtatgtcccaagttttgatgaaactgtatttgtaaaaaaaattttgtagtttaagtattgtcatacagtgttcaaaaccccagccaatgaccagcagttggtatgaagaacctttgacattttgtaaaaggccatttcttggga

SEQ ID NO: 20983 - DNA, 4238 bp, Homo sapiens
  ENST00000484875
gggccatttctggacaacagctgctattttcacttgagccgaagttaatttctcggggagttctcgggcgcgcacaggcagctcggtttgccctgcgattgagctgcgggtcgcggccggcgccggcctctccaatggcaaatgtgtgtggctggaggcgagcgcgaggctttcggcaaaggcagtcgagtgtttgcagaccggggcgagtcctgtgaaagcagataaaagaaaacatttattaacgtgtcattacgaggggagcgcccggccggggctgtcgcactccccgcggaacatttggctccctccagctccgagagaggagaagaagaaagcggaaaagaggcagattcacgtcgtttccagccaagtggacctgatcgatggccctcctgaatttatcacgatatttgatttattagcgatgccccctggtttgtgtgttacgcacacacacgtgcacacaaggctctggctcgcttccctccctcgtttccagctcctgggcgaatcccacatctgtttcaactctccgccgagggcgagcaggagcgagagtgtgtcgaatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacgatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgaatccccacatcgtcctcaacattgacctggcccccaccatcctggacattgcaggcctggacatacctgcggatatggacgggaaatccatcctcaagctgctggacacggagcggccggtgaatcggtttcacttgaaaaagaagatgagggtctggcgggactccttcttggtggagagaggcaagctgctacacaagagagacaatgacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctgggacttaaagatggaggaagctatgagcaatacaggcagtttcagcgtcgaaagtggccagaaatgaagagaccttcttccaaatcactgggacaactgtgggaaggctgggaaggttaagaaacaacagaggtggacctccaaaaacatagaggcatcacctgactgcacaggcaatgaaaaaccatgtgggtgatttccagcagacctgtggtattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaatccctcgcagttgtggacatttctgttcctgtccagataccatttctcctagtatttctttgttatgtcccagaactgatgttttttttttaaggtactgaaaagaaatgaagttgatgtatgtcccaagttttgatgaaactgtatttgtaaaaaaaattttgtagtttaagtattgtcatacagtgttcaaaaccccagccaatgaccagcagttggtatgaagaacctttgacattttgtaaaaggccatttcttggga

SEQ ID NO: 20984 - DNA, 1550 bp, Homo sapiens
  ENST00000495544
gggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctgggacttaaagatggaggaagctatgagcaatacaggggacaactgtgggaaggctgggaaggttaagaaacaacagaggtggacctccaaaaacatagaggcatcacctgactgcacaggcaatgaaaaaccatgtgggtgatttccagcagacctgtggtattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaatccctcgcagttgtggacatttctgttcctgtccagataccatttctcctagtatttctttgttatgtcccagaactgatgttttttttttaaggtactgaaaagaaatgaagttgatgtatgtcccaagttttgatgaaactgtatttgtaaaaaaaattttgtagtttaagtattgtcatacagtgttcaaaaccccagccaatgaccagcagttggtatgaagaaccttt

SEQ ID NO: 20985 - DNA, 3905 bp, Homo sapiens
  ENST00000467815
ctcgggcgcgcacaggcagctcggtttgccctgcgattgagctgcgggtcgcggccggcgccggcctctccaatggcaaatgtgtgtggctggaggcgagcgcgaggctttcggcaaaggcagtcgagtgtttgcagaccggggcgagtcctgtgaaagcagataaaagaaaacatttattaacgtgtcattacgaggggagcgcccggccggggctgtcgcactccccgcggaacatttggctccctccagctccgagagaggagaagaagaaagcggaaaagaggcagattcacgtcgtttccagccaagtggacctgatcgatggccctcctgaatttatcacgatatttgatttattagcgatgccccctggtttgtgtgttacgcacacacacgtgcacacaaggctctggctcgcttccctccctcgtttccagctcctgggcgaatcccacatctgtttcaactctccgccgagggcgagcaggagcgagagtgtgtcgaatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacgatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgaatccccacatcgtcctcaacattgacctggcccccaccatcctggacattgcaggcctggacatacctgcggatatggacgggaaatccatcctcaagctgctggacacggagcggccggtgaatcggtttcacttgaaaaagaagatgagggtctggcgggactccttcttggtggagagaggcaagctgctacacaagagagacaatgacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctggatggaggaagctatgagcaatacaggcagtttcagcgtcgaaagtggccagaaatgaagagaccttcttccaaatcactgggacaactgtgggaaggctgggaaggttaagaaacaacagaggtggacctccaaaaacatagaggcatcacctgactgcacaggcaatgaaaaaccatgtgggtgatttccagcagacctgtggtattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaa

SEQ ID NO: 20986 - DNA, 552 bp, Homo sapiens
  ENST00000433632
agctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctgggcagatgacctttaacaagctgtgattcctgagagaggaacacctgcaccaactgcccaggaaacacacggaattccgtctcatttcattgtcctcccttttgtccactcatgcattcaacaaacacttcctgagaacttacacctgaaaccatgttgactaaagatgaccccatcctcgctg

SEQ ID NO: 20987 - DNA, 398 bp, Homo sapiens
  ENST00000465769
cacacatgcctccggggctcctccagagctgagaggccggccccgcggctcctgctctctgccccatagcaagctgctacacaagagagacaatgacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagagta

SEQ ID NO: 20988 - DNA, 363 bp, Homo sapiens
  ENST00000474450
gtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctggctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaagcacgccgagctacaactacgcgcccaacccggacaaacactggatcatgcgctacacggggcccatga

SEQ ID NO: 20989 - DNA, 1635 bp, Homo sapiens
  ENST00000463221
gtgtcgagtgagtgtgcgtctgtgtgtcccggcgagggtgcgcgctcggcgccgggagcgcggccagccgagtccggaggcatcgggaggtcgagagccgccgggaccccagctctgcgttcactgccccgtccggagctggacttcggggccggggccggggccgtgcgccggggacaggcagggccgggtcgcgggccgcgcgtcccccaggccggagatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatgtaagcctcagcactctgcctgccagaggcactgcttagcatgaagggggagggtcaggctttagcaacagtactgtcaccaccatgacttcactgtgcctcctctctaatcctcctggtttaaagaccccaagaacatactgcttgtccatggtgaaactgggatgcaactccagacagcctgggcaacagaccaaggcaggagaatttttaacttgggatacacggcctcccaccaagaggtgtgtggatggaactgcatagaataggtttccttttaatgccatgtgtattttatttaagacatctaaaaacattcttttgaggagggggtctatagttttaccagactaattatttgccaccatttattgagctgtgggctatgtagcaggtgctgtgctaagcccttggcattattgtccagtccctgaatattcacagtgacccttggtgtaccagttatctattgccatgtaacaaatcatcccagaatctagcaacttaaaacaacaaacacaaattatctcacggtgtctgtgagtcaggaatctgggagtggctgttctgagcttctg

SEQ ID NO: 20990 - DNA, 814 bp, Homo sapiens
  ENST00000437955
ggggatgcagcagcggcagcggcggcggcggcggcggcagcggcagcggcggcgcggagtcccctgcgcccagcggcccggccgggctgcggcagaggcggcggcggcgccccgctccgggtgaggttgccggggccgtgcgcgctgatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaag

SEQ ID NO: 20991 - DNA, 632 bp, Homo sapiens
  ENST00000478766
ggttccatgcaggtgatgaacaagacccggcgcatcatggagcagggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacaggtcctgagccgattaagaaatcagacccaagagtcagctgatgaaagtcaacactgcactctgatgaatctggtgaaggctgggtttgagggcatggcttccttctgagagcatttgggcttcctgactaaactccagagtgtgacagacttcccactgatgcaggtccacacctctcctccccgcgcagacaggacaagcctcctgaaaactagccctccccgggggcagctcagtccccagaggaaaagcaagggaagggattgggctatgcatgcccacttcggcccttcaaatccactaggcacatgctaggggtcagcaaaccacagccaatggacctaaccaggccctccatttgttttagtaaataaagttttattggaacata

SEQ ID NO: 20992 - DNA, 842 bp, Homo sapiens
  ENST00000371964
gcgagcggcttccgccgggctgctccgcgggcgcgtcggccatgagcgagttgccgggcgacgtgcgggcgtttctgcgggagcacccgagcctgcggctccagacggacgcccgcaaggtgaggtgcatcctgacaggtcacgagctgccctgccgcctgccggagctccaggtctacacccgcggcaaaaagtaccagcggctggtccgcgcctccccggccttcgactatgcagagttcgagccgcacatcgtgcccagcaccaagaacccgcaccagttgttctgcaaactcaccctgcggcacatcaacaagtgcccagaacacgtgctgaggcacacccagggccggcggtaccagcgagctctgtgtaaatatgaagaatgtcagaagcaaggggtggagtacgtgcctgcctgcctggtgcaccggaggaggaggagggaggaccagatggacggtgacgggcctcgcccgcgggaagccttctgggagcccacatccagtgatgaggggggagctgcaagtgatgacagcatgacagacctgtacccacctgagctattcaccagaaaggaccttggaagcacggaggatggggatggcactgatgactttttgacagacaaagaggatgagaaggcaaagcccccaagagagaaggccactgatgagggcaggagagagacgaccgtgtaccgagggctggtccagaagcgcgggaagaagcagttgggctcgttgaaaaagaagttcaagagtcatcaccgcaaacccaagagcttcagctcctgtaaacagccaggttaataaaagcacatgccgtgaagtttcgagaaa

SEQ ID NO: 20993 - DNA, 676 bp, Homo sapiens
  ENST00000495524
gcgggcgcgtcggccatgagcgagttgccgggcgacgtgcgggcgtttctgcgggagcacccgagcctgcggctccagacggacgcccgcaaggtgaggtgcatcctgacaggtcacgagctgccctgccgcctgccggagctccaggtctacacccgcggcaaaaagtaccagcggctggtccgcgcctccccggccttcgactatgcagagttcgagccgcacatcgtgcccagcaccaagaacccgtaggtggtccgcggcggcgcggggaggcccagggcaattaggacagcccctccgctggactccgccagtgctgcagcccctactctttcagagttgggagccctgggacccaggtgggcgcccgggtgctggaatcacctgcggtcccagcggcgaggcctcttggcaccagttgttctgcaaactcaccctgcggcacatcaacaagtgcccagaacacgtgctgaggcacacccagggccggcggtaccagcgagctctgtgtaaatatgaagaatgtcagaagcaaggggtggagtacgtgcctgcctgcctggtgcaccggaggaggaggagggaggaccagatggacggtgacgggcctcgcccgcgggaagccttctgggagcccacatccagtgatgaggggggagctgcaagtgatgac

SEQ ID NO: 20994 - DNA, 314 bp, Homo sapiens
  ENST00000486887
cgtgcccagcaccaagaacccgtaggtggtccgcggcggcgcggggaggcccagggcaattaggacagcccctccgctggactccgccagtgctgcagcccctactctttcagagttgggagccctgggacccaggcaccagttgttctgcaaactcaccctgcggcacatcaacaagtgcccagaacacgtgctgaggcacacccagggccggcggtaccagcgagctctgtgtaaatatgaagaatgtcagaagcaaggggtggagtacgtgcctgcctgcctggtgcaccggaggaggaggagggaggacc

SEQ ID NO: 20995 - DNA, 842 bp, Homo sapiens; identical to SEQ ID NO: 20992
  ENST00000630633

SEQ ID NO: 20996 - DNA, 676 bp, Homo sapiens; identical to SEQ ID NO: 20993
  ENST00000627396

SEQ ID NO: 20997 - DNA, 314 bp, Homo sapiens; identical to SEQ ID NO: 20994
  ENST00000626704

SEQ ID NO: 20998 - DNA, 5008 bp, Homo sapiens
  ENST00000309558
gccaagggtcccccagacgggcgggggctccttgcggccggctagctactctccccgcctccctgcgccctcgccctccgccccgctgtacccgcagagcgcgcggcccagcgcagccccttttggcaccgaggtttccaggtgcccagcgcgaaggcggagccgggttacagccgcctcctcggcgccacagagaagacccccgggagttcggcggcccaggcgctccggctctgcgtcccgagcctcccccggctctccgcgctcctccctctcggcgcgcccggcgcgaagcctgcgattcgtgagccgagcgcagagcgcagagccgagtggcgcacgctgggcagtggcctgggcaaccccaaacgcagccagagccctcacccgagtccgctggcccgcgcactcccggaccatgactgccgagggacccagcccgcctgcccgttggcacagacgcctccccgggctctgggcggcggcgctgctcctgctcggtctgccgcgcctttcggtgcgggcggatggaaagttctttgtgctggagtctcagaatggctctcagggcctacaactggaggctgctcggctttcctgcaagagcaggggcgctcacctggcatctgcagacgagctgcggagagtggtacaggattgctcctttgcggtgtgcaccactggctggctagcagatggtactcttggaacaactgtgtgtagcaaaggaagtggagaacagcaaatcatgagagctgtcgatgtgagaattgagagcaacccagttcctggtggcacatacagtgccctttgtattaaggatgaagagaagccgtgtggagacccgccttcgttcccacacaccatcctgcagggccgcaccggcttggaaatgggggatgaactgctgtacgtgtgtgccccaggccacatcatgggccaccgggagaccgccttcaccttgctatgtaacagctgtggggagtggtacggcctggtgcaggcctgtgggaaagatgaggctgaggcacacattgactatgaagataacttccctgatgacagatctgtgtcattcagagagctcatggaggattcccggacagaggcagatgaggacaggggtcagggagactcctctgaggaggctccaaaacaggaccgtctggtctccatttctgtggggagagaaaacatagcccgggataaagtctttgtgccaaccacaggcttgcctggtgctgggagcagtgtccccgcagattcaccaggatcacggctgctccagaagcacttgttctggtttcctgctgaggctttccacaagcctgggttggaaaaggaggtggatgatgacaccaaaaagcagttttctgctggagacaaccacagtggtgtaaaattggtcccaggtgaacctgaaaccaaggtgatctacggcaacactgatggtccctcggggccatttgtgggcaagaatgacagcaaggcaggagatccagtggtgagcagcagtgatgagtcctggttagatggctaccctgtgacagagggggcttggaggaagacagaggcagaagaggaagaagatggggacagaggggatgggtcagtagggctggatgaaaacgtcctagttactcctgatcagcccattcttgtggaagttaagaagcccaagagtagcaccctcacaccaagcgagggcatgacccatagttcagttcttccatctcaaatgctagatgtggaagctttggcgctcagacccgtgaatgcttccgagactgagggcattggggatggtgacttgacgaagtaccagtcaactctaccctggagattcatcacagaggaatctcccatggccaccctgtcctatgagctcaccagctccaccctggagatattaacagtgaacactgtcaagcagacacctaaccacatcccctcaacgatcatggcaaccacccagcctccagtagaaaccactgttcctgagatccaggatagcttcccatacctgctgtctgaagacttctttggacaggaaggccccgggccaggtgcaagtgaggagcttcatcccaccttggagtcgtgtgtgggggacggatgtcctggcctcagcagaggccctgtgatcgccaccattgtcaccgtcctgtgcctactgctgctcctggcaggtgtggggatggtgtggggctaccgcaagtgccagcacaagagctctgtgtacaagctgaatgttggccagcggcaggctcggcactaccaccagcagatcgagatggagaaggtctaggcacctttggagtgggttctcccaaagccacttgggaggaaaataactgtgacacatcacacgataattcactagagcatgacgcaggtggactgaggctcatcattttttcctcagccctttgttttataggctgagaagtgtctctggagcacctgggagggcagggaggctttggtgacatcatcactcatgtcaatgtctcctccaccatctgccctggaattgactacactaatcccagacctgtgcttgggccctgtttccagtgtgaggtcaaaaatcgcctcttccttcatcacagtattatctttttttttttgagacagagtctcatgctgttgcccaggctggagtgcagtgtcccgatctgagctcactgcaacctctgcctcccaagttcaagcaattctcctgcctcagcctcccaagtaggtgggattacaggcatgcaccaccatgcccagctaatttttttatatttttagtagagatggagtttcaccatgttggccaggctggtcaagaactcctgacctcaagtgatctgccctccttagcctcccaaagtgctaggattccaggtgtgagccacatcacagtattacctttttgaagaaagaaaatcaccagcttcatgccctgaaattttataaatagtcatgataaaccaagtgtatgagagcagtattatctaggacatggatattgaattattgggagaggaatatggaagaataatgggttgtttccttttaatgttgtgatgttgctgagggcagatgaaccaagagccaggacacagtctagaagctttgaggtttcttttttcattgtttcttgaaattagaatttaagactgacattttgttgggggagttgaggagtgaagaaacacacatccccctctgttccctccattctgtgggacagtctgtcatttattttattttattttcaatatttcatggttaaggatttgccattattttttaaaaacaaagttagctttgtaccagtaagtaccatttcctctcagaagcagtggcctagttgtccttgaccagtctgtgcctaggaatgtcttggaatttttgccaggactaacaaaactcagtccttggtttcctctctcaggattaaccatttctctgaactccagtaagagagaatgacacgggagaaaaaaaaaagaaatgttttcagagggccgaacaccaggttatcaagtatgggcacatacttgatggagaagcagaagaatctgtgaaagaatatgaaatgatctgtgctgatctgttctctagtgtggaaactgggagctctgtggaaacagaatccatcctgtctgttgggtaacccatttcgtagcatctaaatcatcttagggtggctcagcgaggatggtttatggcagtggttctcaaagtgtggtcctcagaccagtagcatcagcgtcacctgggaatttgttggagatgcaaattctctagtcccaccctggactcaggaaacaggaaccctgggagtagggcccagttctgtttttaacaagccctccaggtgattttgatatgcactcaagtttgagagcctgttggtttataataatctcaaatgtgaacttcgaggccagctgaagccctaaaggcacagatgagtatgtggtgtgtgttgtgtggaagtcaggcatggctgtgtgcagctgaggtggcatttgaagctgcctaaatgccacctgcaatagtctcctgtatgttggcacagaaatgaaacatgttatatttttctaatatgaatcaccttcttagaaatagttatcagtggtaaaaagtgatgaatgcaacacatttattttgagacaccatagcagtctaagtgtttttgtgtggtagagggaaatcctgatcttttttatgattgaaaaattgttggtggtgttttacctaaggaaaaaaaacattcgcaacatgttttctaccctgccacctcttttcagcaagctttggaaaagtaataggcgaagtagctgtaaagagaggcagcataatcaaagatcttattccccatagttgggtaaaataaagcctgaaggtaccaactagaatacctgtgcatcagacgaagtcaagaacaataggaataaaatgctttctgcatgtagccaaagcaaaacataatagaataaaagccagagactgtatatatttataaattagatcctaatctactgcaagataacttttctatttttaactatataaaataacctctgtctcagcattgggactgtgttagcaactattattgtggaataacccagaacattggatttataccaacaaataggcaatattaatacagtgtattaataaatttattacaaattattaatacagtgtattaataaatttattacaaattattaatacaggtaaatgttttatttgtagacatggactgtgaaataaacccaacacatcagtttttaagttcttattggtgtggtatcctctaaattaatgttatagaatctaaaaattcatgttgaaagggaatgattaaaacaatgtaaatctaaattgtatgtcatgcatgttttgagaatggtgaatgtttaatgctcatgaaaattgggggagggggttctattaacacaaagcttctgagatatttaaaataaataattattgccccaac

SEQ ID NO: 20999 - DNA, 729 bp, Homo sapiens
  ENST00000412539
ctgccgagggacccagcccgcctgcccgttggcacagacgcctccccgggctctgggcggcggcgctgctcctgctcggtctgccgcgcctttcggtgcgggcggatggaaagttctttgtgctggagtctcagaatggctctcagggcctacaactggaggctgctcggctttcctgcaagagcaggggcgctcacctggcatctgcagacgagctgcggagagtggtacaggattgctcctttgcggtgtgcaccactggctggctagcagatggtactcttggaacaactgtgtgtagcaaaggaagtggagaacagcaaatcatgagagctgtcgatgtgagaattgagagcaacccagttcctggtggcacatacagtgccctttgtattaaggatgaagatgaggctgaggcacacattgactatgaagataacttccctgatgacagatctgtgtcattcagagagctcatggaggattcccggacagaggcagatgaggacaggggtcagggagactcctctgaggaggctccaaaacaggaccgtctggtctccatttctgtggggagagaaaacatagcccgggataaagtctttgtgccaaccacaggcttgcctggtgctgggagcagtgtccccgcagattcaccaggatcacggctgctccagaagcacttgttctggtttcctgctgaggctttccacaagcctgggttggaaa

SEQ ID NO: 21000 - DNA, 5388 bp, Homo sapiens
  ENST00000342745
agtgacgcgggcgctgcagccgtcgctaccgccgcgttctattctccgaagccggcgaccgccccacctcctccctccctcccgcccgcttcctctgcccacagcgccggccagagcgagctagacaagggcacgcggggcctcgcctagacccgagaagactgcgggcgcgcgcaagcggcggcgtggaagctgtgagcgcccccatcccggaggtctccgccggctcccgggtgaatcagctcccggccgactttaggattcttctggattttaaattttttctttttaaaaaaacttggacggataaaagatgtgccatggcaggatagcaccaaagagcacctcagtgtttgccgtggcctccgtgggacatggagtgttccttccgctagtgatcctttgcaccctgcttggagacggacttgcttccgtgtgccccctaccaccggagccagagaatggtggctacatctgccacccccggccctgcagagaccccctgacagcaggcagtgtcatcgaatacctgtgtgctgaaggctacatgttgaagggcgattacaaatacctgacgtgtaagaatggcgagtggaaaccagccatggagattagctgccgtctcaacgaggataaagacacccacacatcacttggggtccccacgctgtctatagtggcttctactgccagctccgtggcgctcattctcctcctcgtggtgctgtttgtgctgctgcagccaaagctgaagtctttccatcatagcaggcgtgaccagggggtatctggggaccaggtctccatcatggtggatggagtccaggttgcactaccatcatacgaggaggctgtatatggcagttctggtcactgtgtgccacctgctgaccccagagtacagattgtgctgtcagaagggtctgggcccagtgggaggagcgtgccaagggagcaacagctgccggaccaaggggcctgctcctctgcaggtggagaagatgaggccccaggccagtctggactatgtgaagcctggggctctcgggcctcagagactgtgatggtgcatcaggcaaccacctcttcctgggtggccggctcagggaaccgccaactggcacacaaagaaactgcagattcagagaacagtgacatacaaagccttttatccctcacgtcagaggagtacacagatgatattccactgttgaaagaagcatgagggcagcggccagcctttcctctctgcgaggttctctcagcccttcctccctctccctgtgggattgagcaccctgtactctccagccaccttacctggatacctgagctgccacctgtgtatctgtgtatctctgagggccctataggcccaccttgctggaaactcaaggaagattctcgccatctgcctgttggacagctggaggagctggctctttgcctggccccgccttcccatctgtcagagacatatttgaatgtgctggatcaaaccctcccttttcctaagcctctgggtcccctccagccagctctttggcggcagcccccaccagctcctgtgggcctgagtgctgctgtgtttacttgtgcctttcccccaccctgtccagtttccctgtcatgcagacttgttgctgtccacaagccttagtggctgcactgctgccccctgccacacagggggccgggcctgggtctgtcctgtttcctttgagggttgcccctactgccctttgcaggaacagatccaggtgtgagagctcttgagtcaagagtggcagaagtggctctaattggggtgagagtgtagtccctgggcttgccctgggttgaccctggtggcatatttccttggctgaggatggaagatttggagaatcatgtccatgctggcccaggacccagccatctggcccaaaggcacaagctcctggccctgttgagttgagagtttccaagaagcatccagaagatcccaagggagagaaggaaaatggctgataatgattgtcttcctaatatgcaagttctcacttcctacttccagcatcggccttcctggccttgtcttttttttgtttccctggagtataatgggaagttgcatgctgcctcctgggttttatcccagatagctctggctttcttgctgcccacaggggcctggggcaggaaggagacttgctgagatgccatggagtgcccatctggtcactggcagtctgggcaggttgcccctttctgggtttgtggtgacggaggggaggccgagaggcacagaccaagtccccgggtggctgcaggcagctccagcccggtcctgaggatcctcctcaccatggtcacgtgccttagtaactgtgcccaggaagtggcctgctgcttgctgtgctgctgcttttcctacttctgcccttccctgccacccctcgcatgtcacagctgacaagcaattccttgtcttccctggccccctgggggaagggctgagaaacagtccgtgtgcaccccaaccttaatggcctgaggtgggcagaggggtgtggagcagcctggagtacagggccctgggggaggagcccactgatgaggggcgctctcccatagccatgtgttgaatgctaactaggctggggtggacgaactctgccaactgctgtcatcttagaagatagatgcagcagtaaggaatgtttgttttgcttttttctgaaattttctgaagcactgtggctgggaaacttcgaagcggaccctgtgctgcatgtctgctcctcccctgagcctgtctgcttgggggtggtaaaaataaaaatcccagtttattttcagtaccttacctaacagggttggctccaggcgtgggtggcctagaagatgaggggagtggtcttctcccagccttttaccctcttgcctcctgcctccgcgcttacacacgcactttaccacccggtcattccctggcctcttgctgccacttgtagtcttccttccttcctctcagggtaagggcagtgcctgctgtgcctgttggccactcccacacttcccctcccccaggagccctcatctgctgtgctgagtccaggaaagcatagttaggtagggagctggttggagaaggtgctagaactagaaggcagatgagactagcatgggcccacctggagggctgtccctaatggccccagtcgccttacctcacccacagcagtgcccttgtcttcctccaaaacagaaagcagtgacaaaagggggaggggtggtaatctgaagtctcactgctgagccttcagcttttatttttcactgtttcaaaacccgcattctattctagaatggtttttaaaatggaagatcttacctttttctatcttgttactctggggttttgtccccctaagagattgcactttttgtttggggtttattcagctgcatagatgaccagcttgatccctggtgaaatgaaaagccttccttctcctgaagcctctttccgccctgccctccactaacaacactgaggagcacaagcccaggcttgcccacctggtaggaaaggaagaaattagaacaatgggagccttggctcccctctcgtctcctcccctccttcttgtcactggctttgatgaggcccacttcccagaggctcctgggcctgtgagtgcaggagctcattctcccctcactgctgaagtctgtgacagcttcttcctccagttatgtctttcttccaaagcaatttcttaaccatcagccatgtgctgctatttctagggcttctgggctttgtcccttactgagagattagggactccacagctgccttgaggtagggcctggctgagagacaagggtagcagcaggtggcaggctgttaaaagacaggctgcctgaggagcctggagcaggtggaaacaggtggaagaaaccggccacagccctgctttaccgggctcacctctagggcattccagcaagaggctgatgcaggagaatggccagcaccaaaggacatttaaaagagtttttgggtttttttgtttgtttgttgttggtgtttgtttttttttttttttttttggcacacttgagctgactcagtgcaggtttaatatcctggtgacttgcagtcacattctaatgactttcaagggccagaatatggtgaaaatcacttaaaatatccgtcccttccatgccttagtttagcaggtaggctctatcttttgccatttctgtattttatgtgctgtgttcccgtttcactgggtatgaactgtgaaatcgactgaatcctggccactttatgagtttgtttggttttataaggcatttcaatgtacattctataaatacaagcactccatttgcaaacagatcttaagctaatattttctttcccattcatcttgccctccccctcctcccgccagctttaaagttcagtggagaagccagatggcaattcagacaaaggtatactcttcctgcttcatgggtggtggcacgggaatagatagcccttagccctttccctcccagtcccagctgagccctcagaccacttgcttcccacataacaatgtcgcctccatttccgaggaacatccttgcgtagagaatgaaatatgctgcaatcatttctgcatccttactcctcacccccaaagaaaaaaaaaaggcctagcagggaagcagcatgcaggcttcacagcttaatgccaaggacagcgagtgaggctgggagcttctcttgggcctgctgggtctgtcagctctcggaatagggacagtccttactggtgccccaaggtgggacttggagaatattttgcttggcatatgtttggtctgaatggtgtagttgctggttccctagagaggaaaaggtggcaggcccagctttgctgggaaatggctcttaatttccagttgaaaccctagtagaattgtgaatgaaaacctcaaggttgagcccctctgccaagcagcagagctagtagaaggggatgcaggggcaaagcactcagttgccaagcaaggaggagagatgtacgtgggctgtgtggcagtccccacaccctgccctggcttcttcaggttatcgcaccactatggaatcctttgcagaatggtactcatataatggtttaaaacaacacattcataattgactctgtgcaggatgtcactcaatcagtttgggtttgctttattttattttatatatatattttttggtatcctgtacattgcagtgggtgtgaagatagtattttaatatttgtacaaagtttaatttaattttaattgttctatgtatataactgcatttctaaataattaaaaaaaagttcttatgaaggc

SEQ ID NO: 21001 - DNA, 424 bp, Homo sapiens
  ENST00000553497
tctccgaagccggcgaccgccccacctcctccctccctcccgcccgcttcctctgcccacagcgccggccagagcgagctagacaagggcacgcggggcctcgcctagacccgagaagactgcgggcgcgcgcaagcggcggcgtggaagctgtgagcgcccccatcccggaggtctccgccggctcccggttttttttggcctggaaaccagcagggtgcctccatttgctctctcatcctctggttcttacttgagtgtggaagtcgctccactggtggaccttgcagtggcactgagctgggtcacttcagccgtgaaaggccaactgtactactgtcaaggcttgggacagttaagcgtccgtgaaggtactggatacagcgacagcaggaagtgcagcagtgagaactgaaactaattt

SEQ ID NO: 21002 - DNA, 608 bp, Homo sapiens
  ENST00000556993
caggtgaatcagctcccggccgactttaggattcttctggattttaaattttttctttttaaaaaaacttggacggataaaagatgtgccatggcaggatagcaccaaagagcacctcagtgtttgccgtggcctccgtgggacatggagtgttccttccgctagtgatcctttgcaccctgcttggagacggacttgcttccgtgtgccccctaccaccggagccagagaatggtggctacatctgccacccccggccctgcagagaccccctgacagcaggcagtgtcatcgaatacctgtgtgctgaaggctacatgttgaagggcgattacaaatacctgacgtgtaagaatggcgagtggaaaccagccatggagattagctgccgtctcaacgagggtcagtctggcagatgaaaaagggatgctgctggggttctgctttctgttaactcacaggatgcaaagcatgcttcctccagagcactctttgctgtggtgcagcccagccccagttgatgctctgcagcctcccttccttgggtcttcatgtctttgtggaagatacttgaggttgctggtgcatgtcctattgcatttcattga

SEQ ID NO: 21003 - DNA, 2099 bp, Homo sapiens
  ENST00000545111
atatttattggtctgcaaatccggagaccttgcggcctcactggtcctccttccctctgagctatctccacacccagccttcgatcagaaggagatttagaagcagagctgcccgcagcgaatacttttaatgcccgggccgggaagaaagcgggttaggatctgatcccgctgagtagaggacccaggagcctcccgccccgcgtgctctgtagcgcgggggcgcgctgcgcgctgcgcctgggcggctggcgggggcggcgtgggcgcggtgatgcaggtgtgacacccgccggcgcctgcctccgcccggatcgcccagctccgcgttagccggagctgcacgcggggctgccggggcggacgctgctctgcctgcatccggaggcggccgccagcggatttgccacccagggatgatagtctacttgggaatgatggcgggcgccttcatcctgggaggcctggctgataagctgggaaggaagcgagtcctcagcatgtctctggccgtcaatgcctccttcgcctccctctcttccttcgtgcagggatatggagccttcctcttctgccgactcatctcaggcatcggtattgggggtgctctaccgattgtttttgcctatttttctgaattcttgtctcgggagaagcgaggagaacacctcagttggctgggcatcttctggatgactgggggcctgtacgcatctgccatggcctggagcatcatcccacactatggctggggcttcagcatggggaccaattaccacttccatagctggagagtgtttgtcatcgtctgtgctctgccctgcaccgtgtccatggtggccctgaagttcatgccagagagcccaaggtttctgctagagatgggcaaacatgatgaagcctggatgattctcaagcaagtccatgacaccaacatgagagctaaggggaccccagagaaagtgttcacggtttccaacatcaaaactcccaagcaaatggatgaattcattgagatccaaagttcaacaggaacctggtaccagcgctggctggtcagattcaagaccattttcaagcaggtctgggataatgccctgtactgtgtgatggggccctacagaatgaatacactgattctggccgtggtttggtttgccatggcattcagttactatggactgacagtttggtttcctgatatgatccgctattttcaagatgaagaatacaagtctaaaatgaaggtgttttttggtgagcatgtgtacggcgccacaatcaacttcacgatggaaaatcagatccaccaacatgggaaacttgtgaatgataagttcacaagaatgtactttaaacatgtactctttgaggacacattctttgacgagtgctattttgaagacgtaacatcaacagatacctacttcaaaaattgtaccattgaatcaaccatcttttacaacacagacctctacgagcacaagttcatcaactgtcggtttatcaactccaccttcctggagcagaaggagggctgccacatggacttggagcaagataatgacttcctgatttacctcgtcagcttcctgggcagcctgtctgtcttacccgggaacatcatttctgccctgctcatggatagaattggaaggctcaagatgattggtggctccatgctaatctctgcagtctgctgcttcttcctgttttttggcaacagtgagtctgcaatgatcggctggcagtgcctgttctgtgggacaagcattgcagcctggaatgctctggatgtgatcacagtggagctgtatcccaccaaccagagagcaacagccttcggcattctcaatggattatgcaaatttggcgccatcctgggaaacaccatctttgcttcttttgttgggataaccaaagtggtccccatccttctggctgctgcttctctggttgggggtggcctgattgcccttcgactgccagagactcgagaacaggtcctgatgtgaacaacctatgggaaaaggaaaggtcgagagaatcttgtccaggacactgaaatgcatccacacttcctgcctatcacggtccgg

SEQ ID NO: 21004 - DNA, 11279 bp, Homo sapiens
  ENST00000394232
ggagctgcacgcggggctgccggggcggacgctgctctgcctgcatccggaggcggccgccagcggatttgccacccagagcataaccttcggtggcaggacaaatcaggccagcacgcagtctgccaagtcctgctcgctccctgtcaagaaaaacagctggatccatttctaatcaacacttcccaacgcaacacttctgagtctctgaaggagaccagagcttgaaactttccagacttccaacagacatcgagtgcaaaaggatatttaggttgtctttgcacaaatctggttgatttgagagataaagggggggggaaccagtgtgactttcacctaagaagtcacatgaacatatttcacatttgaactacataatgaatgatggttattgaaatagcccaaacctctaccacagagcgagggatatagctcaaggggcaaccaggcagtcgcagaaccaaggaatggatgactacaagtatcaggacaattatgggggctatgctcccagtgatggctattaccgcggcaatgagtccaacccagaagaagatgcacagagtgatgtcaccgaaggccatgatgaggaagacgagatctatgagggcgagtaccagggtatccctcacccagatgatgtcaaggccaagcaggccaagatggcgccctccagaatggacagccttcggggccagacagacctgatggctgagaggctggaagatgaggagcagttggcccaccagtacgagaccatcatggatgagtgtggccatggccgcttccagtggatcctctttttcgtcttgggtttggccctgatggccgatggggtggaagtgttcgtggtgagttttgccctgcccagtgcagagaaggacatgtgtctgtccagttccaaaaaaggaatgctagggatgatagtctacttgggaatgatggcgggcgccttcatcctgggaggcctggctgataagctgggaaggaagcgagtcctcagcatgtctctggccgtcaatgcctccttcgcctccctctcttccttcgtgcagggatatggagccttcctcttctgccgactcatctcaggcatcggtattgggggtgctctaccgattgtttttgcctatttttctgaattcttgtctcgggagaagcgaggagaacacctcagttggctgggcatcttctggatgactgggggcctgtacgcatctgccatggcctggagcatcatcccacactatggctggggcttcagcatggggaccaattaccacttccatagctggagagtgtttgtcatcgtctgtgctctgccctgcaccgtgtccatggtggccctgaagttcatgccagagagcccaaggtttctgctagagatgggcaaacatgatgaagcctggatgattctcaagcaagtccatgacaccaacatgagagctaaggggaccccagagaaagtgttcacggtttccaacatcaaaactcccaagcaaatggatgaattcattgagatccaaagttcaacaggaacctggtaccagcgctggctggtcagattcaagaccattttcaagcaggtctgggataatgccctgtactgtgtgatggggccctacagaatgaatacactgattctggccgtggtttggtttgccatggcattcagttactatggactgacagtttggtttcctgatatgatccgctattttcaagatgaagaatacaagtctaaaatgaaggtgttttttggtgagcatgtgtacggcgccacaatcaacttcacgatggaaaatcagatccaccaacatgggaaacttgtgaatgataagttcacaagaatgtactttaaacatgtactctttgaggacacattctttgacgagtgctattttgaagacgtaacatcaacagatacctacttcaaaaattgtaccattgaatcaaccatcttttacaacacagacctctacgagcacaagttcatcaactgtcggtttatcaactccaccttcctggagcagaaggagggctgccacatggacttggagcaagataatgacttcctgatttacctcgtcagcttcctgggcagcctgtctgtcttacccgggaacatcatttctgccctgctcatggatagaattggaaggctcaagatgattggtggctccatgctaatctctgcagtctgctgcttcttcctgttttttggcaacagtgagtctgcaatgatcggctggcagtgcctgttctgtgggacaagcattgcagcctggaatgctctggatgtgatcacagtggagctgtatcccaccaaccagagagcaacagccttcggcattctcaatggattatgcaaatttggcgccatcctgggaaacaccatctttgcttcttttgttgggataaccaaagtggtccccatccttctggctgctgcttctctggttgggggtggcctgattgcccttcgactgccagagactcgagaacaggtcctgatgtgaacaacctatgggaaaaggaaaggtcgagagaatcttgtccaggacactgaaatgcatccacacttcctgcctatcacggtccggaggacaccttggatagcacgggaggagaagttgactttgtgacccctagtttaggacccacttcagctgtcaatatgtttgtaactcaggtgactgatttgggggtgccctgagccacccttagaatcacagagctgcgtgtttaacttcaagtcttcccagtccaaggcagggagaggattctccagtgagtgcacacactatgcgaggagcaagcatttctctaagtcaagtgcaaggacttaacttgcgtttgaaaaggaattagagggtcagaaacacccaggttcctccagaaagctccttggagcccaacaacttaacaaatcaacttggctggaagttagagtcattatatgaagattgggcttgaagtatatatttttgcatttaaaagtatcacctatcatattttccactcgaaaattgacatagtagcattgaggatactctgatctagaaagccaagtatttgagcaacatctatagagatctacttttctcctatgtctcctaggctttccatgataattaggtaatacatttaagaaggatatttatttctgttttgctctattcaaagaaacggaatgggatagttattctgtaaactaagtttgtatataactttatttgggtttaatttccacaactggtatctgcaaatattgccagcattttagccatattttgggagaacttggtgtttgaggtcccaggaaatgaggtctgatcaaatgaaatgcaagcacaatttcttacagccatttaactttctgttgggaggatgaattaacaaactcacattgtgcagtctgcttaatccaggcacttttctttgtgcaggtgtagtgagtagttacttctctcccttacacagatgacttgtgaaactcaagctcaccatcttcagtgctggcattttactttgccactacccaaaaacaatgtgagatgtgttcagtggcctctggtactctttgcaggcaagaatcaaacaacatggggactgagggaaggatggggaagtgtagccacagttcttccaaatgtaaatactttttgtttgttctagtggtaaaatgcaaatgcaatccatatttgttaggatggtcaggtctcatgagaaatctatgctatgtgtccagagcttttgaaacagagtccattggagtgggagttagggagtgtagtggatgccaaatatgtttttcttcagtgcttaagagaactgtttcctgaagtccagctttgaacataaacaggggtgtgggttgggggaggagcttaggacaaacctctctgatgaaggtcagcaatagactgaagtcttgactgcatggaagaggaaaaacatcagaactgtctgacaatggaggggacagtgagctacgcacaactgccagcggaggtgaacttgcacctgcccaggccggatgaacatcagcctgcaagaactagttgtttgagttgatttgcagtgctctcaatgggcaagtgccacattttccctggcagagatctccaaaaatttaaaacagaataataatggctatatcgagtgttttctcagtattggagaaatgcttaggtcctatgatagcttcgggacatctttctgtaattttcctcaattaacgggttggtaggggtaaatcttatgacacctttccaccgtcgatttgagatcagttttaatggttaaaatgtttactctccttctgtcaaccctcacctttttatttacacccctccctttttttctgtacagggagagaagacatattgactctgactggacaccctgattcctccaaatatatataccactgtgtattaatctttctctcagtgttttataggagtactaacatttattgctctgtcaataatgaaaggctcgatgtaatatagctgtaatttactttccatatgaatacagtggctaggttcataaaagagaattgtgtgagtctgggattaccacatctaaaacattattctttaatgggataatacaattcattgagcagctaccacttaaaaaacttgcaggacagttagagcctgcatttctagttaagatggatcttgtaaatttaaaattggattaacattggagtgctggggtggctgcaataatttgggggctaactccatttggtttccaagatctcacttctgcattatctttatggctctttaaaccagccacctagccaatcaagggcaattcccatctcatccatcactcaggtctttgtaaagggtgcagccaagctctgcagacttttgcaggattgtctagcctgagtaccgggctacttcttaaatgccgtcactcctgctgagataaatgcgtctttaaaaatagtctctgtggcaggtcactgggggacaatgtacagcattctggccatccacttctttttcacttcatgttctaccccaagagactcccgatgtcggctgtggagggttaaagggatgaggctttcctttgtttagcaaatctgttcacagttcttgatgatgtattttatgatgcccagcttggaaatagttgctttccatagtctcaactgtattgtgtcatctcctgatgctgatttttgatcttttgttttattaaaaataattagtgaaagaggtgtgcctatctgtgaagtttgtagtacatcatcctgaggtcatgtaacaagtaaaccccaacccagcgttccctcctacgttgtgttagttcattaaaactaaataataaaaataactgtaagaaaaccttaaggactggggttagagattattttcaggcactaaggtctcttctgtattccaaaattgattgaatcagctgggagaaacattgagaatcgcttccttcaacttttattttgcaacatggggaccttgagaggttaaacgatgtggcccagattacatgtaatgtgaggagtgggcgagaaggcctaaggtgatgctctcatgacagttctggggaagcctgcagtttggggaatgggacaatgtgacaaatactcgccattccctgagaccattcattgactattcccttgatggctttactataatgagaggaagcatcagtttaaacataaaaagattagtatttatccatccatttattcattcagcaaatccttattgagccctgaccatgggccagtctctctgccaagccctggggacacagtgatgaaaaaactggccacagtttctgcttcctgcctcattccacttgcagtgagcggatattaaattggccataaacaccgagtacgatgaccttacaatccgcaaactgcacctttcatgtgtaaaaggattgctactactttacttgtcagctgtggatttccaaatgtggtggctccctcttatttttttttctttgaggagtgtaccaattttttatctttataaaccaggtaagggaaatgatgcccttgcccattttctacagacctaatcgatttttacctaatcagttttacagaaagggttacatggaagaagagataggggccaggaatgcaagagggacattggtgagtggggtaagaatccccgtagccctgggaaaggtgtctccacttccacatctggcttttctagggggcatctgtgctaactgacctgggattatgttggatggcatatgactgcaaattcaaagaaaccaatttataataagtttatagtaagttaaaggtttgttttactctcatgtgaagggaatctggaggaaggaaagccagggctggagtggctgcctttgatcatgggagcacactccttctgcccgatcattgggagcacactccttctgcctgatcgttgggagcacactcctgcctgatcatgggcgcacgttccttctgcctgatcgttgggagcacactccttctgcctgatcatgggagcacactccttctgcctgatcattgggagcacgctccttctgcctgatcgttgggagcacactctttctgcctgatcgttgggagcacaccccttctgcctgatcattgggagcacactccttctgcctgatcatgggcacacgctccttctgcccgatcatgggcacacgctccttctgcccgatcgttgggagcacactccttctgcccaatcattgggctcacgctccttctgcccgatcgctgggctcacgctccttctgcccgatcttgggcgcacgctccttctgcccgatcgttgggcgcacgctccttctgcccgatcgttgggcgcatgctccttctgcccgatcgttgggagcacgctcattctgcccgattgttgggagcacgctccttctgcccgatcgttgggcgcacgctccttctgcccgatcgttgggcgcacgcttcttctgcctgatcgttgggcgcacgctccttctgcctgatcgttgggcgcacgctccttctgcctgatcgttgggagcacgctccttctgcctgattgttggaagcacgctccttctgccttcagactccttgatttttagtgcagtttccatcactgaggctgcctcatgggctgagatggctgttgaagcactgaacctcacatccacaattcaggcaggaagcagaaggaagggcaatgggcaaaggggctgtgccttgcagccgatccagcctccctttgctgcagaggaggcagggaaatgcggtatttactgggaacattgctgcccctcctccaaattgagggtcttggctcgaaggacaaaagccagaaaggataggtggattagtgcttcttaaacttttgcgtgcatcagaatcacccagaaagatgttaaaactcactcttcaaggccccatccccagagattcggattctggggatttggaatctggggtggggtctgaagaatctgcattttttaacaaactcccaggtgacatagatggcatcaattctcaagccatattttgagtagcactgacactcttccaataggtggtactttgacttgtcagggaagttctattgctctgataacttaaaaccaacccaaccagaagctcacaaaaactagcagcctgtgaaaaatgatcaccattttcctagagctccgagacaactagtggtagtgcaacagtaacccaaaaatgtcaatgaaaatatttccttccccagaaactgcttggtttcactcaggtcctgtccttatgggcctgtgtctggttgcagggcttgaagtatttcggaagctcagcagaggttgaaccctttcccctgggggttggtgatctttgttttggccatttccacctggtgaagattttcatagacaaatatgcttgtggcatcctgtaattcattgtgccttatgatggacctctgattctataagcttccccctagctagggatgcacgggggtgatcaagacatgactagatgtgaacctgacctgcagacagtccacctgaacgtgcctggaaatgtctcccgaaaaggatgaaaagcctcctcctttagacaaggaagacagagtggagcaaatttctctacatagatctcattcgaaaacaaatttacagaatgcagaatggctactgtgtgtcttgtgctatgctaggtctctctctctctaagtggactctgaccctgtccaaaacattgtgcttttgcatgtagctgtgtcgcatttaggcccagctctaagaaccgtttggaaataaatcacatagagcctttgattgtgaggcaggcttaaagtacattttgtttgatttgcagaggcatggtgaggaatttatatgcatggctgttgtggcagcagcgagatttccaaaaagatgaatgatgaaatgaaacagactgaagctatctcacaaatgttaaatggagaaataaaagttgttatagtcattgctaattacagaatgagcaagagatttatttagcaggaccatactatgccccctggaaggttcagtttatgagctggagcacaaggatttactgtcatttcacctgaaaacacacatttagctgtccatttacctttaatcctacaggcttaaaatactttaaaatttcagagaccattaatatgtattcctttagaaagcaaaggtctttcagaagctgtcctctaccaaagttaatgtggtcaccacatttgatgattttgctaggtagggaggtttatttaatcacagctactgtcactcaggaggatgagccatttaaaaatggtggccctgtcctccacttcttacctaccatatataatctcagtaattcagatttctctaaatcagcattagtgatcatttcaatagggtatgaacaaaaggcctataaaaatagctttccaattcgccaccaaaaatgcaaaaatgacaagtaagtgaggtaacgcatgagctaaatagcttgatttagtcactctaaaatgtgggtgtgtatatatacatacatatatatacacacacacattatgttatacaccataaatatatagaagttttacttgtcaattaaaactataaataaagtggctttccagaaaaattagatattggactctatcacaaaggaattgcataaaaatacttacaaacataactataagcaattgatgagcaaattacaaatgactgttttttattaaaacattcctccaaaagaacggcaaagcaaatcccatagacacccaaaatactaaaagtgacaaaacaatacttctttaaaaatgtattttatgatctatttattgatattctaatggttttaagaaggataattttccaaaacctaaatgctacacattttacagtggcaatatcaaccttatcatgagctaaagatttgcaatcagaacattggtagagtgcattgctgagttataacaagtgtctcaggacgaggatatttggtaggtatccttaaatatatagatgcttaccagtaggtttaatagaagatttctgaaaggtagcgcaagtttttatttcattatttttatttttatttttttgagacagagtctcactctgtcatctaggctggagtgcagtggtgcaatcttggcttgctgcaatctccacctcccaggttcaagcgattctcccacctcagcctcccgagtagctgggattacaggcatgcgccaccatgcctggctaatttttgtatttttagtagagacggggtttcgccatgttggccaggctcgtctcgaactcctggcctcaagtgatctgcccgcctcagcctcccaaagtgctgggattacaaatgtgagctactatgcctggtcccaacttcttaaaattaaattttggggaagttcatggagatatttttgacatgtaaaagtagaaaacaaaccatccatagtgtgtgcatatatacacacaaggtttggtttaatatacttgctgtgcactagtcagttttgattcaggttacataagggataaaatatagaaagacattttaaagtttgaaatatgtgctaagtagttagagatttggcagttttgccacatttcaaatgggccaaacattaaaataacttatccatgaatttcaggtttcaaggaaggaggaatatctgactatttttttttgtgtgtgagatttggtctcagctttttggtccatctgaatcctggaagtccccaactctaccagaccaaaagggtgtctctattttttgttgttacttctctgttcttgatgtaatgagttaagtagatgaaagagattaaggtgcagggaagggctcttaaaagtttaatgtttcagctttccatagtcattcatacttgtgaatcttcttcctcttctacttcaaagtagccaaaacttggaaagttcaaattaatctttgggctccaaagagcaattctgaaggattaacaggtttcattctctccagtgggaggtggcctagacaggtgccggttttggggagaggtgagagtacccagatgtgggtgactatttcctgttcttccctgaaagtcaggccagtggtctcgaatcattcccacagcaactgctacaaaagtgactatcttaatcctttggctagatgggatacctcttctaccttttcagaggtgagctgttgagtagtaatgtccgctacaacaccacgctcccggaatggtggttcctaagagcaaagtcagttaatacaatttctccaggtatccagctatctccaggtgtgcggtcctgtgaagcactctaagaactgtaaaaaatatttcataggtatagaaggcatttgtaatactgttggttcaaatgtgctgacatgtagccagtggaggaagatgtttctttggaagcctgccatctttctgtaacgcaccttcaacctgagataattaagagtcattacgtttcccagtcccatgtcacattgaccagtcctgtggtcctatggctaagcggaggacacggccacaagctgtgagtcatgaaaaggagggtgcaggtgataggcaaagggacccattagccagtttacaatgactggcaactgaccagatagagcttaccgtatgtccatgtagagttgctcatattagtctgtaaataattctatgcatagtgaatgcagcttctgaattattaaactgatgctataaatgtgaactgacaaaaccca

SEQ ID NO: 21005 - DNA, 4077 bp, Homo sapiens
  ENST00000557410
gctgctctgcctgcatccggaggcggccgccagcggatttgccacccaggtcctaagactctcagtccagagagggccctgccccacacccagaaggaaggaatgctgcccagagatgaccagaggaatctagacagagcataaccttcggtggcaggacaaatcaggccagcacgcagtctgccaagtcctgctcgctccctgtcaagaaaaacagctggatccatttctaatcaacacttcccaacgcaacacttctgagtctctgaaggagaccagagcttgaaactttccagacttccaacagacatcgagtgcaaaaggatatttaggttgtctttgcacaaatctggttgatttgagagataaagggggggggaaccagtgtgactttcacctaagaagtcacatgaacatatttcacatttgaactacataatgaatgatggttattgaaatagcccaaacctctaccacagagcgagggatatagctcaaggggcaaccaggcagtcgcagaaccaaggaatggatgactacaagtatcaggacaattatgggggctatgctcccagtgatggctattaccgcggcaatgagtccaacccagaagaagatgcacagagtgatgtcaccgaaggccatgatgaggaagacgagatctatgagggcgagtaccagggtatccctcacccagatgatgtcaaggccaagcaggccaagatggcgccctccagaatggacagccttcggggccagacagacctgatggctgagaggctggaagatgaggagcagttggcccaccagtacgagaccatcatggatgagtgtggccatggccgcttccagtggatcctctttttcgtcttgggtttggccctgatggccgatggggtggaagtgttcgtggtgagttttgccctgcccagtgcagagaaggacatgtgtctgtccagttccaaaaaaggaatgctagggatgatagtctacttgggaatgatggcgggcgccttcatcctgggaggcctggctgataagctgggaaggaagcgagtcctcagcatgtctctggccgtcaatgcctccttcgcctccctctcttccttcgtgcagggatatggagccttcctcttctgccgactcatctcaggcatcggtattgggggtgctctaccgattgtttttgcctatttttctgaattcttgtctcgggagaagcgaggagaacacctcagttggctgggcatcttctggatgactgggggcctgtacgcatctgccatggcctggagcatcatcccacactatggctggggcttcagcatggggaccaattaccacttccatagctggagagtgtttgtcatcgtctgtgctctgccctgcaccgtgtccatggtggccctgaagttcatgccagagagcccaaggtttctgctagagatgggcaaacatgatgaagcctggatgattctcaagcaagtccatgacaccaacatgagagctaaggggaccccagagaaagtgttcacggtttccaacatcaaaactcccaagcaaatggatgaattcattgagatccaaagttcaacaggaacctggtaccagcgctggctggtcagattcaagaccattttcaagcaggtctgggataatgccctgtactgtgtgatggggccctacagaatgaatacactgattctggccgtggtttggtttgccatggcattcagttactatggactgacagtttggtttcctgatatgatccgctattttcaagatgaagaatacaagtctaaaatgaaggtgttttttggtgagcatgtgtacggcgccacaatcaacttcacgatggaaaatcagatccaccaacatgggaaacttgtgaatgataagttcacaagaatgtactttaaacatgtactctttgaggacacattctttgacgagtgctattttgaagacgtaacatcaacagatacctacttcaaaaattgtaccattgaatcaaccatcttttacaacacagacctctacgagcacaagttcatcaactgtcggtttatcaactccaccttcctggagcagaaggagggctgccacatggacttggagcaagataatgacttcctgatttacctcgtcagcttcctgggcagcctgtctgtcttacccgggaacatcatttctgccctgctcatggatagaattggaaggctcaagatgattggtggctccatgctaatctctgcagtctgctgcttcttcctgttttttggcaacagtgagtctgcaatgatcggctggcagtgcctgttctgtgggacaagcattgcagcctggaatgctctggatgtgatcacagtggagctgtatcccaccaaccagagagcaacagccttcggcattctcaatggattatgcaaatttggcgccatcctgggaaacaccatctttgcttcttttgttgggataaccaaagtggtccccatccttctggctgctgcttctctggttgggggtggcctgattgcccttcgactgccagagactcgagaacaggtcctgatgtgaacaacctatgggaaaaggaaaggtcgagagaatcttgtccaggacactgaaatgcatccacacttcctgcctatcacggtccggaggacaccttggatagcacgggaggagaagttgactttgtgacccctagtttaggacccacttcagctgtcaatatgtttgtaactcaggtgactgatttgggggtgccctgagccacccttagaatcacagagctgcgtgtttaacttcaagtcttcccagtccaaggcagggagaggattctccagtgagtgcacacactatgcgaggagcaagcatttctctaagtcaagtgcaaggacttaacttgcgtttgaaaaggaattagagggtcagaaacacccaggttcctccagaaagctccttggagcccaacaacttaacaaatcaacttggctggaagttagagtcattatatgaagattgggcttgaagtatatatttttgcatttaaaagtatcacctatcatattttccactcgaaaattgacatagtagcattgaggatactctgatctagaaagccaagtatttgagcaacatctatagagatctacttttctcctatgtctcctaggctttccatgataattagggagagaagacatattgactctgactggacaccctgattcctccaaatatatataccactgtgtattaatctttctctcagtgttttataggagtactaacatttattgctctgtcaataatgaaaggctcgatgtaatatagctgtaatttactttccatatgaatacagtggctaggttcataaaagagaattgtgtgagtctgggattaccacatctaaaacattattctttaatgggataatacaattcattgagcagctaccacttaaaaaacttgcaggacagttagagcctgcatttctagttaagatggatcttgtaaatttaaaattggattaacattggagtgctggggtggctgcaataatttgggggctaactccatttggtttccaagatctcacttctgcattatctttatggctctttaaaccagccacctagccaatcaagggcaattcccatctcatccatcactcaggtctttgtaaagggtgcagccaagctctgcagacttttgcaggattgtctagcctgagtaccgggctacttcttaaatgccgtcactcctgctgagataaatgcgtctttaaaaatagtctctgtggcaggtcactgggggacaatgtacagcattctggccatccacttctttttcacttcatgttctaccccaagagactcccgatgtcggctgtggagggttaaagggatgaggctttcctttgtttagcaaatctgttcacagttcttgatgatgtattttatgatgcccagcttggaaatagttgctttccatagtctcaactgtattgtgtcatctcctgatgctgatttttgatcttttgttttattaaaaataattagtgaaaga

SEQ ID NO: 21006 - DNA, 601 bp, Homo sapiens
  ENST00000557291
gacacccagagaggagcacacacaatacaagtcagactttaattttttccttttttaatgaatgcttttcctgaattccaggactatgaaggttttgaagcaacacttcacaaaggcagggactctggaaaattctgagggagtttcagagcagatgaacttctgtctgcttctccctgggtccccgacctatctgttcttgtcccagcccagttcaaaaggaaaactctcccttgattttccctaaatgggtggaataagggaaaactaaagctgttactaccagtcttttctgggagatgaaaatccaatctcaaggatgtttcttcctggaccaaagctgtgatgggtgacgaaaaatgatagaatgaaaagctcttgtgttatgtatttgccagagatgtgtgttacatgcgcctacatcatcattaaggtatttgaaaagcagcgtgcactacaagaagcatgagcgtggatgctcaaacagacctagggatgatagtctacttgggaatgatggcgggcgccttcatcctgggaggcctggctgataagctgggaaggaagcgagtcctcagcatgtctctggccgtcaatgcct

SEQ ID NO: 21007 - DNA, 535 bp, Homo sapiens
  ENST00000553727
atcgtctgtgctctgccctgcaccgtgtccatggtggccctgaagttcatgccagagagcccaaggtttctgctagagatgggcaaacatgatgaagcctggatgattctcaagcaagtccatgacaccaacatgagagctaaggggaccccagagaaagtgttcacggtttccaacatcaaaactcccaagcaaatggatgaattcattgagatccaaagttcaacaggaacctggtaccagcgctggctggtcagattcaagaccattttcaagcaggtatgattgggaacttactttggatgaggatgcgtctctatgggagtctcttaccttagtggatgaaaaatgcagctcctgaacatccccaccaacctgggccagcgtgatggagaggaagcaaccctggaggggggcgtttgggctccagcccacgtctgcctctagcttgctgtgtgccctggagctgaaaactctctaaatcttagtttcttttctttgttcttccttcccaaggcagggattttgaatgtag

SEQ ID NO: 21008 - DNA, 11202 bp, Homo sapiens
  ENST00000330276
cagagcataaccttcggtggcaggacaaatcaggccagcacgcagtctgccaagtcctgctcgctccctgtcaagaaaaacagctggatccatttctaatcaacacttcccaacgcaacacttctgagtctctgaaggagaccagagcttgaaactttccagacttccaacagacatcgagtgcaaaaggatatttaggttgtctttgcacaaatctggttgatttgagagataaagggggggggaaccagtgtgactttcacctaagaagtcacatgaacatatttcacatttgaactacataatgaatgatggttattgaaatagcccaaacctctaccacagagcgagggatatagctcaaggggcaaccaggcagtcgcagaaccaaggaatggatgactacaagtatcaggacaattatgggggctatgctcccagtgatggctattaccgcggcaatgagtccaacccagaagaagatgcacagagtgatgtcaccgaaggccatgatgaggaagacgagatctatgagggcgagtaccagggtatccctcacccagatgatgtcaaggccaagcaggccaagatggcgccctccagaatggacagccttcggggccagacagacctgatggctgagaggctggaagatgaggagcagttggcccaccagtacgagaccatcatggatgagtgtggccatggccgcttccagtggatcctctttttcgtcttgggtttggccctgatggccgatggggtggaagtgttcgtggtgagttttgccctgcccagtgcagagaaggacatgtgtctgtccagttccaaaaaaggaatgctagggatgatagtctacttgggaatgatggcgggcgccttcatcctgggaggcctggctgataagctgggaaggaagcgagtcctcagcatgtctctggccgtcaatgcctccttcgcctccctctcttccttcgtgcagggatatggagccttcctcttctgccgactcatctcaggcatcggtattgggggtgctctaccgattgtttttgcctatttttctgaattcttgtctcgggagaagcgaggagaacacctcagttggctgggcatcttctggatgactgggggcctgtacgcatctgccatggcctggagcatcatcccacactatggctggggcttcagcatggggaccaattaccacttccatagctggagagtgtttgtcatcgtctgtgctctgccctgcaccgtgtccatggtggccctgaagttcatgccagagagcccaaggtttctgctagagatgggcaaacatgatgaagcctggatgattctcaagcaagtccatgacaccaacatgagagctaaggggaccccagagaaagtgttcacggtttccaacatcaaaactcccaagcaaatggatgaattcattgagatccaaagttcaacaggaacctggtaccagcgctggctggtcagattcaagaccattttcaagcaggtctgggataatgccctgtactgtgtgatggggccctacagaatgaatacactgattctggccgtggtttggtttgccatggcattcagttactatggactgacagtttggtttcctgatatgatccgctattttcaagatgaagaatacaagtctaaaatgaaggtgttttttggtgagcatgtgtacggcgccacaatcaacttcacgatggaaaatcagatccaccaacatgggaaacttgtgaatgataagttcacaagaatgtactttaaacatgtactctttgaggacacattctttgacgagtgctattttgaagacgtaacatcaacagatacctacttcaaaaattgtaccattgaatcaaccatcttttacaacacagacctctacgagcacaagttcatcaactgtcggtttatcaactccaccttcctggagcagaaggagggctgccacatggacttggagcaagataatgacttcctgatttacctcgtcagcttcctgggcagcctgtctgtcttacccgggaacatcatttctgccctgctcatggatagaattggaaggctcaagatgattggtggctccatgctaatctctgcagtctgctgcttcttcctgttttttggcaacagtgagtctgcaatgatcggctggcagtgcctgttctgtgggacaagcattgcagcctggaatgctctggatgtgatcacagtggagctgtatcccaccaaccagagagcaacagccttcggcattctcaatggattatgcaaatttggcgccatcctgggaaacaccatctttgcttcttttgttgggataaccaaagtggtccccatccttctggctgctgcttctctggttgggggtggcctgattgcccttcgactgccagagactcgagaacaggtcctgatgtgaacaacctatgggaaaaggaaaggtcgagagaatcttgtccaggacactgaaatgcatccacacttcctgcctatcacggtccggaggacaccttggatagcacgggaggagaagttgactttgtgacccctagtttaggacccacttcagctgtcaatatgtttgtaactcaggtgactgatttgggggtgccctgagccacccttagaatcacagagctgcgtgtttaacttcaagtcttcccagtccaaggcagggagaggattctccagtgagtgcacacactatgcgaggagcaagcatttctctaagtcaagtgcaaggacttaacttgcgtttgaaaaggaattagagggtcagaaacacccaggttcctccagaaagctccttggagcccaacaacttaacaaatcaacttggctggaagttagagtcattatatgaagattgggcttgaagtatatatttttgcatttaaaagtatcacctatcatattttccactcgaaaattgacatagtagcattgaggatactctgatctagaaagccaagtatttgagcaacatctatagagatctacttttctcctatgtctcctaggctttccatgataattaggtaatacatttaagaaggatatttatttctgttttgctctattcaaagaaacggaatgggatagttattctgtaaactaagtttgtatataactttatttgggtttaatttccacaactggtatctgcaaatattgccagcattttagccatattttgggagaacttggtgtttgaggtcccaggaaatgaggtctgatcaaatgaaatgcaagcacaatttcttacagccatttaactttctgttgggaggatgaattaacaaactcacattgtgcagtctgcttaatccaggcacttttctttgtgcaggtgtagtgagtagttacttctctcccttacacagatgacttgtgaaactcaagctcaccatcttcagtgctggcattttactttgccactacccaaaaacaatgtgagatgtgttcagtggcctctggtactctttgcaggcaagaatcaaacaacatggggactgagggaaggatggggaagtgtagccacagttcttccaaatgtaaatactttttgtttgttctagtggtaaaatgcaaatgcaatccatatttgttaggatggtcaggtctcatgagaaatctatgctatgtgtccagagcttttgaaacagagtccattggagtgggagttagggagtgtagtggatgccaaatatgtttttcttcagtgcttaagagaactgtttcctgaagtccagctttgaacataaacaggggtgtgggttgggggaggagcttaggacaaacctctctgatgaaggtcagcaatagactgaagtcttgactgcatggaagaggaaaaacatcagaactgtctgacaatggaggggacagtgagctacgcacaactgccagcggaggtgaacttgcacctgcccaggccggatgaacatcagcctgcaagaactagttgtttgagttgatttgcagtgctctcaatgggcaagtgccacattttccctggcagagatctccaaaaatttaaaacagaataataatggctatatcgagtgttttctcagtattggagaaatgcttaggtcctatgatagcttcgggacatctttctgtaattttcctcaattaacgggttggtaggggtaaatcttatgacacctttccaccgtcgatttgagatcagttttaatggttaaaatgtttactctccttctgtcaaccctcacctttttatttacacccctccctttttttctgtacagggagagaagacatattgactctgactggacaccctgattcctccaaatatatataccactgtgtattaatctttctctcagtgttttataggagtactaacatttattgctctgtcaataatgaaaggctcgatgtaatatagctgtaatttactttccatatgaatacagtggctaggttcataaaagagaattgtgtgagtctgggattaccacatctaaaacattattctttaatgggataatacaattcattgagcagctaccacttaaaaaacttgcaggacagttagagcctgcatttctagttaagatggatcttgtaaatttaaaattggattaacattggagtgctggggtggctgcaataatttgggggctaactccatttggtttccaagatctcacttctgcattatctttatggctctttaaaccagccacctagccaatcaagggcaattcccatctcatccatcactcaggtctttgtaaagggtgcagccaagctctgcagacttttgcaggattgtctagcctgagtaccgggctacttcttaaatgccgtcactcctgctgagataaatgcgtctttaaaaatagtctctgtggcaggtcactgggggacaatgtacagcattctggccatccacttctttttcacttcatgttctaccccaagagactcccgatgtcggctgtggagggttaaagggatgaggctttcctttgtttagcaaatctgttcacagttcttgatgatgtattttatgatgcccagcttggaaatagttgctttccatagtctcaactgtattgtgtcatctcctgatgctgatttttgatcttttgttttattaaaaataattagtgaaagaggtgtgcctatctgtgaagtttgtagtacatcatcctgaggtcatgtaacaagtaaaccccaacccagcgttccctcctacgttgtgttagttcattaaaactaaataataaaaataactgtaagaaaaccttaaggactggggttagagattattttcaggcactaaggtctcttctgtattccaaaattgattgaatcagctgggagaaacattgagaatcgcttccttcaacttttattttgcaacatggggaccttgagaggttaaacgatgtggcccagattacatgtaatgtgaggagtgggcgagaaggcctaaggtgatgctctcatgacagttctggggaagcctgcagtttggggaatgggacaatgtgacaaatactcgccattccctgagaccattcattgactattcccttgatggctttactataatgagaggaagcatcagtttaaacataaaaagattagtatttatccatccatttattcattcagcaaatccttattgagccctgaccatgggccagtctctctgccaagccctggggacacagtgatgaaaaaactggccacagtttctgcttcctgcctcattccacttgcagtgagcggatattaaattggccataaacaccgagtacgatgaccttacaatccgcaaactgcacctttcatgtgtaaaaggattgctactactttacttgtcagctgtggatttccaaatgtggtggctccctcttatttttttttctttgaggagtgtaccaattttttatctttataaaccaggtaagggaaatgatgcccttgcccattttctacagacctaatcgatttttacctaatcagttttacagaaagggttacatggaagaagagataggggccaggaatgcaagagggacattggtgagtggggtaagaatccccgtagccctgggaaaggtgtctccacttccacatctggcttttctagggggcatctgtgctaactgacctgggattatgttggatggcatatgactgcaaattcaaagaaaccaatttataataagtttatagtaagttaaaggtttgttttactctcatgtgaagggaatctggaggaaggaaagccagggctggagtggctgcctttgatcatgggagcacactccttctgcccgatcattgggagcacactccttctgcctgatcgttgggagcacactcctgcctgatcatgggcgcacgttccttctgcctgatcgttgggagcacactccttctgcctgatcatgggagcacactccttctgcctgatcattgggagcacgctccttctgcctgatcgttgggagcacactctttctgcctgatcgttgggagcacaccccttctgcctgatcattgggagcacactccttctgcctgatcatgggcacacgctccttctgcccgatcatgggcacacgctccttctgcccgatcgttgggagcacactccttctgcccaatcattgggctcacgctccttctgcccgatcgctgggctcacgctccttctgcccgatcttgggcgcacgctccttctgcccgatcgttgggcgcacgctccttctgcccgatcgttgggcgcatgctccttctgcccgatcgttgggagcacgctcattctgcccgattgttgggagcacgctccttctgcccgatcgttgggcgcacgctccttctgcccgatcgttgggcgcacgcttcttctgcctgatcgttgggcgcacgctccttctgcctgatcgttgggcgcacgctccttctgcctgatcgttgggagcacgctccttctgcctgattgttggaagcacgctccttctgccttcagactccttgatttttagtgcagtttccatcactgaggctgcctcatgggctgagatggctgttgaagcactgaacctcacatccacaattcaggcaggaagcagaaggaagggcaatgggcaaaggggctgtgccttgcagccgatccagcctccctttgctgcagaggaggcagggaaatgcggtatttactgggaacattgctgcccctcctccaaattgagggtcttggctcgaaggacaaaagccagaaaggataggtggattagtgcttcttaaacttttgcgtgcatcagaatcacccagaaagatgttaaaactcactcttcaaggccccatccccagagattcggattctggggatttggaatctggggtggggtctgaagaatctgcattttttaacaaactcccaggtgacatagatggcatcaattctcaagccatattttgagtagcactgacactcttccaataggtggtactttgacttgtcagggaagttctattgctctgataacttaaaaccaacccaaccagaagctcacaaaaactagcagcctgtgaaaaatgatcaccattttcctagagctccgagacaactagtggtagtgcaacagtaacccaaaaatgtcaatgaaaatatttccttccccagaaactgcttggtttcactcaggtcctgtccttatgggcctgtgtctggttgcagggcttgaagtatttcggaagctcagcagaggttgaaccctttcccctgggggttggtgatctttgttttggccatttccacctggtgaagattttcatagacaaatatgcttgtggcatcctgtaattcattgtgccttatgatggacctctgattctataagcttccccctagctagggatgcacgggggtgatcaagacatgactagatgtgaacctgacctgcagacagtccacctgaacgtgcctggaaatgtctcccgaaaaggatgaaaagcctcctcctttagacaaggaagacagagtggagcaaatttctctacatagatctcattcgaaaacaaatttacagaatgcagaatggctactgtgtgtcttgtgctatgctaggtctctctctctctaagtggactctgaccctgtccaaaacattgtgcttttgcatgtagctgtgtcgcatttaggcccagctctaagaaccgtttggaaataaatcacatagagcctttgattgtgaggcaggcttaaagtacattttgtttgatttgcagaggcatggtgaggaatttatatgcatggctgttgtggcagcagcgagatttccaaaaagatgaatgatgaaatgaaacagactgaagctatctcacaaatgttaaatggagaaataaaagttgttatagtcattgctaattacagaatgagcaagagatttatttagcaggaccatactatgccccctggaaggttcagtttatgagctggagcacaaggatttactgtcatttcacctgaaaacacacatttagctgtccatttacctttaatcctacaggcttaaaatactttaaaatttcagagaccattaatatgtattcctttagaaagcaaaggtctttcagaagctgtcctctaccaaagttaatgtggtcaccacatttgatgattttgctaggtagggaggtttatttaatcacagctactgtcactcaggaggatgagccatttaaaaatggtggccctgtcctccacttcttacctaccatatataatctcagtaattcagatttctctaaatcagcattagtgatcatttcaatagggtatgaacaaaaggcctataaaaatagctttccaattcgccaccaaaaatgcaaaaatgacaagtaagtgaggtaacgcatgagctaaatagcttgatttagtcactctaaaatgtgggtgtgtatatatacatacatatatatacacacacacattatgttatacaccataaatatatagaagttttacttgtcaattaaaactataaataaagtggctttccagaaaaattagatattggactctatcacaaaggaattgcataaaaatacttacaaacataactataagcaattgatgagcaaattacaaatgactgttttttattaaaacattcctccaaaagaacggcaaagcaaatcccatagacacccaaaatactaaaagtgacaaaacaatacttctttaaaaatgtattttatgatctatttattgatattctaatggttttaagaaggataattttccaaaacctaaatgctacacattttacagtggcaatatcaaccttatcatgagctaaagatttgcaatcagaacattggtagagtgcattgctgagttataacaagtgtctcaggacgaggatatttggtaggtatccttaaatatatagatgcttaccagtaggtttaatagaagatttctgaaaggtagcgcaagtttttatttcattatttttatttttatttttttgagacagagtctcactctgtcatctaggctggagtgcagtggtgcaatcttggcttgctgcaatctccacctcccaggttcaagcgattctcccacctcagcctcccgagtagctgggattacaggcatgcgccaccatgcctggctaatttttgtatttttagtagagacggggtttcgccatgttggccaggctcgtctcgaactcctggcctcaagtgatctgcccgcctcagcctcccaaagtgctgggattacaaatgtgagctactatgcctggtcccaacttcttaaaattaaattttggggaagttcatggagatatttttgacatgtaaaagtagaaaacaaaccatccatagtgtgtgcatatatacacacaaggtttggtttaatatacttgctgtgcactagtcagttttgattcaggttacataagggataaaatatagaaagacattttaaagtttgaaatatgtgctaagtagttagagatttggcagttttgccacatttcaaatgggccaaacattaaaataacttatccatgaatttcaggtttcaaggaaggaggaatatctgactatttttttttgtgtgtgagatttggtctcagctttttggtccatctgaatcctggaagtccccaactctaccagaccaaaagggtgtctctattttttgttgttacttctctgttcttgatgtaatgagttaagtagatgaaagagattaaggtgcagggaagggctcttaaaagtttaatgtttcagctttccatagtcattcatacttgtgaatcttcttcctcttctacttcaaagtagccaaaacttggaaagttcaaattaatctttgggctccaaagagcaattctgaaggattaacaggtttcattctctccagtgggaggtggcctagacaggtgccggttttggggagaggtgagagtacccagatgtgggtgactatttcctgttcttccctgaaagtcaggccagtggtctcgaatcattcccacagcaactgctacaaaagtgactatcttaatcctttggctagatgggatacctcttctaccttttcagaggtgagctgttgagtagtaatgtccgctacaacaccacgctcccggaatggtggttcctaagagcaaagtcagttaatacaatttctccaggtatccagctatctccaggtgtgcggtcctgtgaagcactctaagaactgtaaaaaatatttcataggtatagaaggcatttgtaatactgttggttcaaatgtgctgacatgtagccagtggaggaagatgtttctttggaagcctgccatctttctgtaacgcaccttcaacctgagataattaagagtcattacgtttcccagtcccatgtcacattgaccagtcctgtggtcctatggctaagcggaggacacggccacaagctgtgagtcatgaaaaggagggtgcaggtgataggcaaagggacccattagccagtttacaatgactggcaactgaccagatagagcttaccgtatgtccatgtagagttgctcatattagtctgtaaataattctatgcatagtgaatgcagcttctgaattattaaactgatgctataaatgtgaactgacaaaaccc

SEQ ID NO: 21009 - DNA, 11035 bp, Homo sapiens
  ENST00000502798
gacttgccggagcaccgcgagtggcgcgcgggtcccgcctcccccgcgcgccgtgactccctgcgcaccgctggtactctcgccacgccgccgcccggcactgcagcaccagggggaggaggcaggcggaggagaggaggaggaccgcagcgtgcaagccgggagccactttcccgcccctcctctcgccgctgacacgctcagaggagtcaccactccgcgcgctgcaggcgagagtggcagacggaggcagcccggggaagcgagccggagcggcgcccgcactgaggcggctgcagtgctgacaccactcagggcaagggtgtccgacggctggagcgttctgttttgaacccaaagtggatgatgctgtcagagctgaaccactgaaaggaggctgtgaaaatttcccatcttctcattggccatcagttgagataagatggaagactcttacaaggataggacttcactgatgaagggtgccaaggacattgccagagaggtgaagaaacaaacagtaaagaaggtgaatcaagctgtggaccgagcccaggatgaatacacccagaggtcctacagtcggttccaagatgaagaagatgatgatgactactacccggctggagaaacctataatggtgaggccaacgatgacgaaggctcaagtgaagccactgaggggcatgatgaagatgatgagatctatgagggggagtatcagggcatccccagtatgaaccaagcgaaggacagcatcgtgtcagtggggcagcccaagggcgatgagtacaaggaccggcgggagctggaatcagaaaggagagctgacgaggaagagttagcccagcagtatgagctgataatccaagaatgcggtcatggtcgttttcagtgggcccttttcttcgtcctgggcatggctcttatggcagacggtgtagaggtgtttgtcgttggcttcgtgttacccagtgctgagacagacctctgcatcccaaattcaggatctggatggctaggcagcatagtgtacctcgggatgatggtgggggcgttcttctggggaggactggcagacaaagtgggaaggaaacagtctcttctgatttgcatgtctgtcaacggattctttgccttcctttcttcatttgtccaaggttatggcttctttctcttctgtcgcttactttctggattcgggattggaggagccatacccactgtgttctcgtactttgctgaagtcctggcccgggaaaagcggggcgaacacttgagctggctctgcatgttctggatgatcggtggcatctacgcctctgccatggcctgggccatcatcccgcactacgggtggagcttcagcatgggatcggcctaccagtttcacagttggcgtgtgtttgtcatcgtctgtgcactcccctgtgtctcctccgtggtggccctcacattcatgcctgaaagcccacgattcttgttggaggttggaaaacatgatgaagcttggatgattctgaagttaattcatgacaccaacatgagagcccggggtcagcctgagaaggtcttcacggtaaacaaaataaaaactcctaaacaaatagatgagctgattgaaattgagagtgacacaggaacatggtataggaggtgttttgttcggatccgcaccgagctgtacggaatttggttgacttttatgagatgtttcaactacccagtcagggataatacaataaagcttacaattgtttggttcaccctgtcctttgggtactatggattatccgtttggttccctgatgtcattaaacctctgcagtccgatgaatatgcattgctaaccagaaatgtggagagagataaatatgcaaatttcactattaactttacaatggaaaatcagattcatactggaatggaatacgacaatggcagattcataggggtcaagttcaaatctgtaactttcaaagactctgtttttaagtcctgcacctttgaggatgtaacttcagtgaacacctacttcaagaactgcacatttattgacactgtttttgacaacacagattttgagccatataaattcattgacagtgaatttaaaaactgctcgttttttcacaacaagacgggatgtcagattacctttgatgatgactatagtgcctactggatttattttgtcaactttctggggacattggcagtattgccagggaacattgtgtctgctctgctgatggacagaattgggcgcttaacaatgctaggtggctctatggtgctttcggggatcagctgtttcttcctttggttcggcaccagtgaatccatgatgataggcatgctgtgtctgtacaatggattgaccatctcagcctggaactctcttgacgtggtcactgtggaactgtaccccacagaccggagggcaacaggctttggcttcttaaatgcgctatgcaaggcagcagccgtcctgggaaacttaatatttggctctctggtcagcatcaccaaatcaatccccatcctgctggcttctactgtgctcgtgtgtggaggactcgttgggctgtgcctgcctgacacacgaacccaggttctgatgtaatgggaaaaaaagccatccttcctgcgtttcttcctcctgccctgggtcaattctccttcctgactcaaggcttcagagttttcctatatagaaaggtgatcaagtatcagaacataaacacgtgctgtgacttaaaatttagaagcatatcatcttgcccctttgtgattttgcacaggttgtttgtttgttttgttttgtttgaatgcattgttatctttccaaactgtgatgctactgcctcccgcaaatcagtggaagcatttctaaaatgccctaggcagccaggcttccctggggttctgctcattgaaagtttagaagctaagaagactgggctggtgtaagaaatagatcctgctcctaatttaacattaacaggaaatataagtcggcacattattgcatttgtgctgagaagagggattctttttttttttttttctaacagagtgatatttcctgtttacttagaaaaggacacccagtaattctcactgttatagcagagcctttcaaagaaaaccatgtggcaccaaacagggctgggtggggctctttggggcaagacaattaaggtgaccgctgacaagaaaaataaaagctctgcaattagcagcaaaaatctgagtgtgctgcataagcaagatttctgtcagaaagcccaattaaacctctgaaaagtgtgaggaaaaagaactgtaacagtatctgtgactgtggcatgtggttcagaatgtttgaaaatcagagatccgagagagagcttctgcctccatttaccactcccactccttcagctgcccttggtcttgccagacagcagattcagggaaagaaagctgcttcttaaaaactgtctgcctacctgattctgccacttacccacactgtctctagtctagagattgccagtggatagctaaattgtaaattgcaaattaggaagaaattcacacccagagccatttggaaatacaaaatggtacctctttccagtacctctttgctgtgggactggcccgccaggacccccaccccacctggcccgcagttgacattcagcttcccagctggcatcagcaaagagggtttgtccctctagcttccccagggctggcccactgctcaatgcgctcctggctccctgtaaaatcacagcccgcctgcactcctgagggcccctctcacagacagaccatctccctgtggttgtttgactgctcattttacctctggaatctgcctgggcttggaagaaagaggtcagccaggacattcccacgggcccgctgtcagctacatgaccttctcgcctctcaggctccccttcccccaggctcgtcctttttacacctcttctttgaaatctgaaccttccttgtagacttgcagccaatgaccagaagccaggaataaatcccatatttaaacaatattccttttttaactgcctcgatagaggtttattcttgttacttattataggcattttcaggcaagccatagcttggggcctccaggaagggaaagcttttgtttccactgatcattattttcagagatgtcctaactcccctgaggcccccctgcctccccctccccttcctaatgatccctcgcagagctcagactaagtgaaaagcttctttcattaacataagccattaatcgacttccccttgaagtaattcaggtctgcagaggggggaagactggtgttgggggcagtgggaagagggtggttccctgggggtctgtgatcagggctagaacatcaggaaaacccgaaccaaaaactgcaaaggtggcaggaagaagaaaaatcactgaaggctagacaagatgcatttgaaagataccaaccgcacagggaaagaaacaactttctctcacttctgcctcctatcattttattggagaacaaagacagcagtcaaacaacccaagaaagtaccctgtatgtttttcttcttccacatgtacccattttcccacctatctctccctgatttgtcttctttaaaaagacatttggggacctgagcaggtcttttagttgaatgcagcatgtgcagaaataactgcaaaagccaggagtgcatctccatcaacccatcaaaagaaaaatagaaatgtacatgggcatcgctgtctctagtcctctgtgatagttcactttgctaactagactacctttacttttcaaaatatctctaatgtctgctctggggtctaaatgcataaaacatctcccaagctgcagagcacagttattcagaattttatttgaacactgggttgggtcagcataggataaaccagcaaaaccttacttcatgagacctgccatccgtgtcccctgcagaaggaccgttcttggcctacttgttacctaatccaagcatccttggtggcctaagagggatcttttctcatctcctggacagtctgtggtcacaaaccttcttggtcaccacctctcccaccttttgtgcactcttccctgcctccttgagactgttcatcaccttgattttctaagagagctcaaatcatttccaaagcatgtggtgtggcctgtatagcttgctccagatttagctggagattaagaaacagccaggatattaaacagaaactctcagttgtatcagtgtagcaggccactggcacctaaacacgcaactggcatctcatttcgcctacagtagaaggaaaatgaaaatttgtacaaaaatgaaaacctaggaaatagtccacttgctcctatatttttaccaccttttctaactaaaatttccctgttgctctttggaatcaatccagaatgctcccaagtcccattattatcacagaatcttctcagtagggaaaaacaaacaactgcttcaaactgtgaattctgtatgtaccacattctatcccaggtattgggttttaaggcacccaactcacattcagtcctgctgcctgaatcatctcacaccagagtacagaccttggagacgcgatagatgggtcctagcctgaccttcaccactaagcggtacagggacccagatcttgctgtggagactgtaagtcgttgaacatctctagttctcactttccccgtgcacaaaataaaggattgggactagtctgctctccactctccagcattgtagaagacagtaatgaaaatagcttcatcttatctgccttcttatgctaaactcattttttttttttttaggtggagtttcactctgttgcccaggctggagtgcagtggtgggaactctgctcactgcaacctccgcctcccaggttcaagtgattctcccacctcagcctcccaagtagctgggaccacacgcatgcgccaccacgcccagctaatttttgtatcttttagtagaggtggggtttcaccgtgttggtcaggctggtctcgaactcctgacctcaagtgatcggcccacctcagcctcccaaaatgctgggattacaggcgtgagccactggcggcctcaactcatttttacaagcactaaataggtttagtttataaactgaaaaattaggaaataggcacgcataaaaagagtgtaggaagttgtttgggaagcccgcatggaataggccagaaagcacagtccccatgctgtctgccctgccagcatctcagcatcctgactagtatctctgttcactgcaggtttgacagttaccatcacccagccagaaaagggccccgccttgccagataaacgcgcttaggttagaagactataattgcaatattaccctacagctctcctgactgtttattccattattttcttgaaacatggccttaagtattatacataggcttcagaaacagtttttcagtgattttacctatattggcaaatagacaaatctcaccaaatcagagttcaggttttcaccaaaaactgcttagttgtctttcaagataccttaagagatcaaaggggaggtgggaaaagaaatgtagtgacagaagggagagtccaagataccactgataaggttccagcaaagagattaggacacagcagagactttctaaatgctggggtcatttccaaagcagtccaggggaatactttctgattccctctgccaatcaaaatagatagaatatgatattctccaattttttttctgtttgatgtcaaaatggcctttacctatttcttcagtaatatacctgatctgttcatgcactaaaggctctggagccaggaatgtctgaatttggccttcacctggtatcacagaaagacaactgggatattggtgttaaggggcatatcggctgtatgttaggttttctttaatcctcacatcgtgccaaacttagtctggttactaagcctaaaaacaccagtattgcaacaacttctgaaactctgaagtggactatatgtttctcacagtttttgtttatgctcagcaaagtatgtattttaagtaaagcttctcttgttatctgtaatgtagacaaaaaaaaaaaaaaacctgttagtatattctggatgtattgtgtgtcccttcattgtttcaggtatggcgtaacagttctccgtgtgatgttcttttgctctaaatgttgaccattcctcttgtcgcccgtctctcaccaaccagtcacagagccattgccagggctcccttcagtctttcttaaacaatatctaaatgcagtttagtaatcccaggattttgagttacaagaatacagtttatgggtctgtttcagctcttacttaaggctagcatggttgggcaggggaagagctgagccgagccttcactgatctcttgtcatttcatatgattatccagtaaatacttattgagcacctcccatgtgatacgtattgagacactgctgtgtgcaataattaagcctatggaggacttaaatgagggcaaggaaaacagaatgagagaagacactctcacactgacccccattacatgtgaaccctccgcgcccccccccataaatacaaagtgttatttttccacatttaaaacaaataatagccttcagcaggcagtgcaggaactattcagtcattgagataacctttgatgagaggagaaagctccttgattacctggtttttgttggagagactattaactagtacttggaaaatgagaaaaatgaaaccacacataagttgttcccttaaataatctcagcaggatattgcactaagatattattcaaggaaaagaatcaggagcagagatagccccatctctctagagcattttttttttttttttgggcgggggggcgggggacggagtctcgctctattacttaggccggagtgcagtggtgcaatctcggctcaatgcaacttccgcctcccaggttcaagcaattctcctgcctcagcctcccaggtagctgggattacaggtgcatgccactatgtccggctaattttttgtatttttagtagagacgaggtttcaccattttggccaggctggtctccaactcctaacttcaagtgatctacccaccttggcctcccaaagtgctgggattacaggcatgagccactacacctggcctaaagtcccgctttcttctgaggtgttcttttcatggtgtgaaaccagagacaggagctagggggtctgttccccagcgaatagtgttggggttttctcttcagagctaagtcagcaaagcctgcagctgctgccactcccctggtctgtgcctcccagggtgtttcctttctgattttgaagatttgtgggtgagtcaattatctttgcagacatcctaaagcagcttccctcctcgctaccctcagcagataagccatccagaaaacaggttctgacagccagtagcaggggtattttgggtttcagtttaaaactggtgcgtgttgttgcaagtgtcttgaagttgcaaaggatgtttggggttctagggcctgcaggggggcagagcagaaagagggtagttgtcagtgaccctctaccctcctctgagagccccattgccatttttgcccaccagttctcttcttacctcctcagggcagtgcccactcatttcctttatttcccttttgttttttttcttttcctcctctggtcgacaacctcttaattctagcagtgtacaaaagcaaggccaagctttcctggggcacttgggatgaaaggcccatccatgcctgttgtggaggcacagaggaggagaaggtgaagaacaggaatgggtgcagggggagtgtgaacgcaaggctgctggctttggcacagctccctgtgcagggctggatttccaattgcttttcagtgcctgtgccctgataggatgggcacagctggtatggaatcagagcagcccatctccagagcagaagtctgagagctcagcgtttgactcctgaaagaccaggatgttcctacctgggttcttgagattcattggctagtggaggtagatggtactctccatgtctgcagaagattccccacttggtgctgaaggctaggtgccttccagtcaggtctgaatgctgaaattgctgagattgtccactctctgcctactttattgcattcatgctccccttagatccaagagtgcccaggactaggagcagaaagcagttttcaaccctttgttcagactcagacgggtttcaactcaagcgggtaatctaccccagcagcaggggtgcaaagtccaaaacagctttgtggtgcctggggagtgactaggcagcctgctcacaggggctggagtcatctaaagctagtgatgagctggaatagctttgaaccggttcatccgaactgattgttaaactttcagaacttttgagagtcagttgagaaacatagctattactaaaaaattaaataagattagataaattatagctaaaagcaaaggcaacatatagtcaaagctcatcactttctacttattttactacattttaccattatctgtgcccatgaggtaatgtatgcctattatgtctgtatggtagaaatactgtatacaggtatactactacacacaccttcccaagtgacagtatttttgtagtttgagatcagctatagtggtggtatttataccatggaaagcaacaaagccatggaaagcaacaaagccatgcaaatcagactcctcctaacccctaagacagttgttaaacatttgccagcataccaccatctaaagccctaaagaatgcttggcctcccactgcatagacacaggccacatcacattgagtatcatggatttatgggtcagcattgcccctaagtccaaggaaggggaaagacttagcaagctcaacctcatgtgattcacaaagggtttctttctgcatttgtattgactcagaataggacccagtacagagaatccactgttatctatgggtgtcattccttcagaaagaatgtacagtaaaattggctatttcatgctatgcaaacaaaatgaaactagtttgaagttgcaaagtgtctcccctcttgcgcccacgtagtcatccaagaaggaaactcctttcttgccttgatattcaccaggcctacctagatagaacttgacaaattggcctaacttcatctccgctgctattgttatatatttgctttactgaatctatgtcctatgtcagtcagaagaaaaaagaaatgtcttttttaatatacactttcttagcatccatgcagttatgtatcctcatcctgatccaggaacatattgaacagatcatatgtcttttgttactatctagatacactaaataacatgatagaagagttttctctttcaggtgaacttccattttgaacatatgctaaacgtactatccactgtctattttaatgagatcttggcaatggtcctgtcggttttggtgtttggattgtttggctttgttttccttttttattcttcctgtttttaatgctgtgtaagatctcctgctatgaatgttccagttacccctattgtactgtatatacgtgtgctgcatgtgtaaattctgtttcaggttttggagttttcatcttaagtacagctggtcctgttgtgaactcatctttcctgtatgctcctctgtgtctgatttccaattgccaaaatgtttgaccaaatgtgttttgacaaatatcccgagacagccatgcgtatccttgtgaaagggcatgctccatgtgggatggctcgtgtacagcataaatctatcaaacttggaattgtgtatacatttatatgccagataactaacattcatgtaacagctgcaaagatatttagtgtatatcagattaataaaagagcattttttttttgctccattatattcaaataca

SEQ ID NO: 21010 - DNA, 3010 bp, Homo sapiens
  ENST00000322285
gacggaggcagcccggggaagcgagccggagcggcgcccgcactgaggcggctgcagtgctgacaccactcagggcaagggtgtccgacggctggagcgttctgttttgaacccaaagtggatgatgctgtcagagctgaaccactgaaaggaggctgtgaaaatttcccatcttctcattggccatcagttgagataagatggaagactcttacaaggataggacttcactgatgaagggtgccaaggacattgccagagaggtgaagaaacaaacagtaaagaaggtgaatcaagctgtggaccgagcccaggatgaatacacccagaggtcctacagtcggttccaagatgaagaagatgatgatgactactacccggctggagaaacctataatggtgaggccaacgatgacgaaggctcaagtgaagccactgaggggcatgatgaagatgatgagatctatgagggggagtatcagggcatccccagtatgaaccaagcgaaggacagcatcgtgtcagtggggcagcccaagggcgatgagtacaaggaccggcgggagctggaatcagaaaggagagctgacgaggaagagttagcccagcagtatgagctgataatccaagaatgcggtcatggtcgttttcagtgggcccttttcttcgtcctgggcatggctcttatggcagacggtgtagaggtgtttgtcgttggcttcgtgttacccagtgctgagacagacctctgcatcccaaattcaggatctggatggctaggcagcatagtgtacctcgggatgatggtgggggcgttcttctggggaggactggcagacaaagtgggaaggaaacagtctcttctgatttgcatgtctgtcaacggattctttgccttcctttcttcatttgtccaaggttatggcttctttctcttctgtcgcttactttctggattcgggattggaggagccatacccactgtgttctcgtactttgctgaagtcctggcccgggaaaagcggggcgaacacttgagctggctctgcatgttctggatgatcggtggcatctacgcctctgccatggcctgggccatcatcccgcactacgggtggagcttcagcatgggatcggcctaccagtttcacagttggcgtgtgtttgtcatcgtctgtgcactcccctgtgtctcctccgtggtggccctcacattcatgcctgaaagcccacgattcttgttggaggttggaaaacatgatgaagcttggatgattctgaagttaattcatgacaccaacatgagagcccggggtcagcctgagaaggtcttcacggtaaacaaaataaaaactcctaaacaaatagatgagctgattgaaattgagagtgacacaggaacatggtataggaggtgttttgttcggatccgcaccgagctgtacggaatttggttgacttttatgagatgtttcaactacccagtcagggataatacaataaagcttacaattgtttggttcaccctgtcctttgggtactatggattatccgtttggttccctgatgtcattaaacctctgcagtccgatgaatatgcattgctaaccagaaatgtggagagagataaatatgcaaatttcactattaactttacaatggaaaatcagattcatactggaatggaatacgacaatggcagattcataggggtcaagttcaaatctgtaactttcaaagactctgtttttaagtcctgcacctttgaggatgtaacttcagtgaacacctacttcaagaactgcacatttattgacactgtttttgacaacacagattttgagccatataaattcattgacagtgaatttaaaaactgctcgttttttcacaacaagacgggatgtcagattacctttgatgatgactatagtgcctactggatttattttgtcaactttctggggacattggcagtattgccagggaacattgtgtctgctctgctgatggacagaattgggcgcttaacaatgctaggtggctctatggtgctttcggggatcagctgtttcttcctttggttcggcaccagtgaatccatgatgataggcatgctgtgtctgtacaatggattgaccatctcagcctggaactctcttgacgtggtcactgtggaactgtaccccacagaccggagacgcagagtcttgccatgttgccccggctgatcttgaactcctggcctcaagcaatcctcctgcctcagcctcccaaagttctgggattacagtctcgagccactgcacctggctttctttccatttttgaggattaaaattacttgaaattttccaaatatattatacaaggtcttgctaagaacttagtagatttctttattgttgtcttttttctctctcttttgccttgtagaaatatcccacaaagtgaagtaaccaagtcaacaagtgtgaacaattttatagctctccttaaatttactatacagctctcagaaacaacggagccagtttatagcaggagccattagtgggtgtggacctcttttctaagatctgcttctaaacttggctttatcacataaagagagaaaagcattacaaacaatttgaaggaattctttgtcttataaaaaaaattctgaaaacctccttgtattcccactaggaggtatagttaaccttgcaactccacaaacagaccactttacacacttgcccaggggcctttgtttttgcttgcccctcctctgaaatgctctctacaggtgattaagtggcttttccctttacttaggtgtctactcaggtaaaatcttaaccaagacgcctttacttaaaatgtccctctgccccaccctgaggcttttaacttgcatagccctcatcatcacctgacataatatgtacttctttgcttttatagatattatctgtgtccctccactaggatgtccatttcatgggaataaagactttgtctcttt

SEQ ID NO: 21011 - DNA, 437 bp, Homo sapiens
  ENST00000506257
cagatttggttgacttttatgagatgtttcaactacccagtcagggataatacaataaagcttacaattgtttggttcaccctgtcctttgggtactatggattatccgtttggttccctgatgtcattaaacctctgcagtccgatgaatatgcattgctaaccagaaatgtggagagagataaatatgcaaatttcactattaactttacaatggaaaatcagattcatactggaatggaatacgacaatggcaggtctagaaacttgaaataatttaatttgctacctattcacaaaaacttatttcttcttagctttccctgcactgaaacaggcatagttttttgtttgtttgttttagtttgtacatttagtcattttcatgatgaatttcaatacttcttaataggctttaaataaaaggtacaaatgta

SEQ ID NO: 21012 - DNA, 12194 bp, Homo sapiens
  ENST00000374469
ccctccggagttcccgagctgctgaggagtctggattgtgtctgtccccagtgtcagatgaaagggcgctgaggctcttggccgctgccccgcgcccagctccgcgcacgcccctctgcgagtccggccgcccagcgcctcttcccgcccgagccgccgcctgcgctccggggcagccgctctgtctccagcgcgatgtggcctcgcctggccttttgttgctggggtctggcgctcgtttcgggctgggcgacctttcagcagatgtccccgtcgcgcaatttcagcttccgcctcttccccgagaccgcgcccggggcccccgggagtatccccgcgccgcccgctcctggcgacgaagcggcggggagcagagtggagcggctgggccaggcgttccggcgacgcgtgcggctgctgcgggagctcagcgagcgcctggagcttgtcttcctggtggatgattcgtccagcgtgggcgaagtcaacttccgcagcgagctcatgttcgtccgcaagctgctgtccgacttccccgtggtgcccacggccacgcgcgtggccatcgtgaccttctcgtccaagaactacgtggtgccgcgcgtcgattacatctccacccgccgcgcgcgccagcacaagtgcgcgctgctcctccaagagatccctgccatctcctaccgaggtggcggcacctacaccaagggcgccttccagcaagccgcgcaaattcttcttcatgctagagaaaactcaacaaaagttgtatttctcatcactgatggatattccaatgggggagaccctagaccaattgcagcgtcactgcgagattcaggagtggagatcttcacttttggcatatggcaagggaacattcgagagctgaatgacatggcttccaccccaaaggaggagcactgttacctgctacacagttttgaagaatttgaggctttagctcgccgggcattgcatgaagatctaccttctgggagttttattcaagatgatatggtccactgctcatatctttgtgatgaaggcaaggactgctgtgaccgaatgggaagctgcaaatgtgggacacacacaggccattttgagtgcatctgtgaaaaggggtattacgggaaaggtctgcagtatgaatgcacagcttgcccatcggggacatacaaacctgaaggctcaccaggaggaatcagcagttgcattccatgtcctgatgaaaatcacacctctccacctggaagcacatcccctgaagactgtgtctgcagagagggatacagggcatctggccagacctgtgaacttgtccactgccctgccctgaagcctcccgaaaatggttactttatccaaaacacttgcaacaaccacttcaatgcagcctgtggggtccgatgtcaccctggatttgatcttgtgggaagcagcatcatcttatgtctacccaatggtttgtggtccggttcagagagctactgcagagtaagaacatgtcctcatctccgccagccgaaacatggccacatcagctgttctacaagggaaatgttatataagacaacatgtttggttgcctgtgatgaagggtacagactagaaggcagtgataagcttacttgtcaaggaaacagccagtgggatgggccagaaccccggtgtgtggagcgccactgttccacctttcagatgcccaaagatgtcatcatatccccccacaactgtggcaagcagccagccaaatttgggacgatctgctatgtaagttgccgccaagggttcattttatctggagtcaaagaaatgctgagatgtaccacttctggaaaatggaatgtcggagttcaggcagctgtgtgtaaagacgtggaggctcctcaaatcaactgtcctaaggacatagaggctaagactctggaacagcaagattctgccaatgttacctggcagattccaacagctaaagacaactctggtgaaaaggtgtcagtccacgttcatccagctttcaccccaccttaccttttcccaattggagatgttgctatcgtatacacggcaactgacctatccggcaaccaggccagctgcattttccatatcaaggttattgatgcagaaccacctgtcatagactggtgcagatctccacctcccgtccaggtctcggagaaggtacatgccgcaagctgggatgagcctcagttctcagacaactcaggggctgaattggtcattaccagaagtcatacacaaggagaccttttccctcaaggggagactatagtacagtatacagccactgacccctcaggcaataacaggacatgtgatatccatattgtcataaaaggttctccctgtgaaattccattcacacctgtaaatggggattttatatgcactccagataatactggagtcaactgtacattaacttgcttggagggctatgatttcacagaagggtctactgacaagtattattgtgcttatgaagatggcgtctggaaaccaacatataccactgaatggccagactgtgccaaaaaacgttttgcaaaccacgggttcaagtcctttgagatgttctacaaagcagctcgttgtgatgacacagatctgatgaagaagttttctgaagcatttgagacgaccctgggaaaaatggtcccatcattttgtagtgatgcagaggacattgactgcagactggaggagaacctgaccaaaaaatattgcctagaatataattatgactatgaaaatggctttgcaattggaccaggtggctggggtgcagctaataggctggattactcttacgatgacttcctggacactgtgcaagaaacagccacaagcatcggcaatgccaagtcctcacggattaaaagaagtgccccattatctgactataaaattaagttaatttttaacatcacagctagtgtgccattacccgatgaaagaaatgatacccttgaatgggaaaatcagcaacgactccttcagacattggaaactatcacaaataaactgaaaaggactctcaacaaagaccccatgtattcctttcagcttgcatcagaaatacttatagccgacagcaattcattagaaacaaaaaaggcttcccccttctgcagaccaggctcagtgctgagagggcgtatgtgtgtcaattgccctttgggaacctattataatctggaacatttcacctgtgaaagctgccggatcggatcctatcaagatgaagaagggcaacttgagtgcaagctttgcccctctgggatgtacacggaatatatccattcaagaaacatctctgattgtaaagctcagtgtaaacaaggcacctactcatacagtggacttgagacttgtgaatcgtgtccactgggcacttatcagccaaaatttggttcccggagctgcctctcgtgtccagaaaacacctcaactgtgaaaagaggagccgtgaacatttctgcatgtggagttccttgtccagaaggaaaattctcgcgttctgggttaatgccctgtcacccatgtcctcgtgactattaccaacctaatgcagggaaggccttctgcctggcctgtcccttttatggaactaccccattcgctggttccagatccatcacagaatgttcaagttttagttcaactttctcagcggcagaggaaagtgtggtgccccctgcctctcttggacatattaaaaagaggcatgaaatcagcagtcaggttttccatgaatgcttctttaacccttgccacaatagtggaacctgccagcaacttgggcgtggttatgtttgtctctgtccacttggatatacaggcttaaagtgtgaaacagacatcgatgagtgcagcccactgccttgcctcaacaatggagtttgtaaagacctagttggggaattcatttgtgagtgcccatcaggttacacaggtcagcggtgtgaagaaaatataaatgagtgtagctccagtccttgtttaaataaaggaatctgtgttgatggtgtggctggctatcgttgcacatgtgtgaaaggatttgtaggcctgcattgtgaaacagaagtcaatgaatgccagtcaaacccatgcttaaataatgcagtctgtgaagaccaggttgggggattcttgtgcaaatgcccacctggatttttgggtacccgatgtggaaagaacgtcgatgagtgtctcagtcagccatgcaaaaatggagctacctgtaaagacggtgccaatagcttcagatgcctgtgtgcagctggcttcacaggatcacactgtgaattgaacatcaatgaatgtcagtctaatccatgtagaaatcaggccacctgtgtggatgaattaaattcatacagttgtaaatgtcagccaggattttcaggcaaaaggtgtgaaacagaacagtctacaggctttaacctggattttgaagtttctggcatctatggatatgtcatgctagatggcatgctcccatctctccatgctctaacctgtaccttctggatgaaatcctctgacgacatgaactatggaacaccaatctcctatgcagttgataacggcagcgacaataccttgctcctgactgattataacggctgggttctttatgtgaatggcagggaaaagataacaaactgtccctcggtgaatgatggcagatggcatcatattgcaatcacttggacaagtgccaatggcatctggaaagtctatatcgatgggaaattatctgacggtggtgctggcctctctgttggtttgcccatacctggtggtggtgcgttagttctggggcaagagcaagacaaaaaaggagagggattcagcccagctgagtcttttgtgggctccataagccagctcaacctctgggactatgtcctgtctccacagcaggtgaagtcactggctacctcctgcccagaggaactcagtaaaggaaacgtgttagcatggcctgatttcttgtcaggaattgtggggaaagtgaagatcgattctaagagcatattttgttctgattgcccacgcttaggagggtcagtgcctcatctgagaactgcatctgaagatttaaagccaggttccaaagtcaatctgttctgtgatccaggcttccagctggtcgggaaccctgtgcagtactgtctgaatcaaggacagtggacacaaccacttcctcactgtgaacgcattagctgtggggtgccacctcctttggagaatggcttccattcagccgatgacttctatgctggcagcacagtaacctaccagtgcaacaatggctactatctattgggtgactcaaggatgttctgtacagataatgggagctggaacggcgtttcaccatcctgccttgatgtcgatgagtgtgcagttggatcagattgtagtgagcatgcttcttgcctgaacgtagatggatcctacatatgttcatgtgtcccaccgtacacaggagatgggaaaaactgtgcagaacctataaaatgtaaggctccaggaaatccggaaaatggccactcctcaggtgagatttatacagtaggtgccgaagtcacattttcgtgtcaggaaggataccagttgatgggagtaaccaaaatcacatgtttggagtctggagaatggaatcatctaataccatattgtaaagctgtttcatgtggtaaaccggctattccagaaaatggttgcattgaggagttagcatttacttttggcagcaaagtgacatataggtgtaataaaggatatactctggccggtgataaagaatcatcctgtcttgctaacagttcttggagtcattcccctcctgtgtgtgaaccagtgaagtgttctagtccggaaaatataaataatggaaaatatattttgagtgggcttacctacctttctactgcatcatattcatgcgatacaggatacagcttacagggcccttccattattgaatgcacggcttctggcatctgggacagagcgccacctgcctgtcacctcgtcttctgtggagaaccacctgccatcaaagatgctgtcattacggggaataacttcactttcaggaacaccgtcacttacacttgcaaagaaggctatactcttgctggtcttgacaccattgaatgcctggccgacggcaagtggagtagaagtgaccagcagtgcctggctgtctcctgtgatgagccacccattgtggaccacgcctctccagagactgcccatcggctctttggagacattgcattctactactgctctgatggttacagcctagcagacaattcccagcttctctgcaatgcccagggcaagtgggtacccccagaaggtcaagacatgccccgttgtatagctcatttctgtgaaaaacctccatcggtttcctatagcatcttggaatctgtgagcaaagcaaaatttgcagctggctcagttgtgagctttaaatgcatggaaggctttgtactgaacacctcagcaaagattgaatgtatgagaggtgggcagtggaacccttcccccatgtccatccagtgcatccctgtgcggtgtggagagccaccaagcatcatgaatggctatgcaagtggatcaaactacagttttggagccatggtggcttacagctgcaacaaggggttctacatcaaaggggaaaagaagagcacctgcgaagccacagggcagtggagtagtcctataccgacgtgccacccggtatcttgtggtgaaccacctaaggttgagaatggctttctggagcatacaactggcaggatctttgagagtgaagtgaggtatcagtgtaacccgggctataagtcagtcggaagtcctgtatttgtctgccaagccaatcgccactggcacagtgaatcccctctgatgtgtgttcctctcgactgtggaaaacctcccccgatccagaatggcttcatgaaaggagaaaactttgaagtagggtccaaggttcagtttttctgtaatgagggttatgagcttgttggtgacagttcttggacatgtcagaaatctggcaaatggaataagaagtcaaatccaaagtgcatgcctgccaagtgcccagagccgcccctcttggaaaaccagctagtattaaaggagttgaccaccgaggtaggagttgtgacattttcctgtaaagaagggcatgtcctgcaaggcccctctgtcctgaaatgcttgccatcccagcaatggaatgactctttccctgtttgtaagattgttctttgtaccccacctcccctaatttcctttggtgtccccattccttcttctgctcttcattttggaagtactgtcaagtattcttgtgtaggtgggtttttcctaagaggaaattctaccaccctctgccaacctgatggcacctggagctctccactgccagaatgtgttccagtagaatgtccccaacctgaggaaatccccaatggaatcattgatgtgcaaggccttgcctatctcagcacagctctctatacctgcaagccaggctttgaattggtgggaaatactaccaccctttgtggagaaaatggtcactggcttggaggaaaaccaacatgtaaagccattgagtgcctgaaacccaaggagattttgaatggcaaattctcttacacggacctacactatggacagaccgttacctactcttgcaaccgaggctttcggctcgaaggtcccagtgccttgacctgtttagagacaggtgattgggatgtagatgccccatcttgcaatgccatccactgtgattccccacaacccattgaaaatggttttgtagaaggtgcagattacagctatggtgccataatcatctacagttgcttccctgggtttcaggtggctggtcatgccatgcagacctgtgaagagtcaggatggtcaagttccatcccaacatgtatgccaatagactgtggcctccctcctcatatagattttggagactgtactaaactcaaagatgaccagggatattttgagcaagaagacgacatgatggaagttccatatgtgactcctcaccctccttatcatttgggagcagtggctaaaacctgggaaaatacaaaggagtctcctgctacacattcatcaaactttctgtatggtaccatggtttcatacacctgtaatccaggatatgaacttctggggaaccctgtgctgatctgccaggaagatggaacttggaatggcagtgcaccatcctgcatttcaattgaatgtgacttgcctactgctcctgaaaatggctttttgcgttttacagagactagcatgggaagtgctgtgcagtatagctgtaaacctggacacattctagcaggctctgacttaaggctttgtctagagaatagaaagtggagtggtgcctccccacgctgtgaagccatttcatgcaaaaagccaaatccagtcatgaatggatccatcaaaggaagcaactacacatacctgagcacgttgtactatgagtgtgaccccggatatgtgctgaatggcactgagaggagaacatgccaggatgacaaaaactgggatgaggatgagcccatttgcattcctgtggactgcagttcacccccagtctcagccaatggccaggtgagaggagacgagtacacattccaaaaagagattgaatacacttgcaatgaagggttcttgcttgagggagccaggagtcgggtttgtcttgccaatggaagttggagtggagccactcccgactgtgtgcctgtcagatgtgccaccccgccacaactggccaatggggtgacggaaggcctggactatggcttcatgaaggaagtaacattccactgtcacgagggctacatcttgcacggtgctccaaaactcacctgtcagtcagatggcaactgggatgcagagattcctctctgtaaaccagtcaactgtggacctcctgaagatcttgcccatggtttccctaatggtttttcctttattcatgggggccatatacagtatcagtgctttcctggttataagctccatggaaattcatcaagaaggtgcctctccaatggctcctggagtggcagctcaccttcctgcctgccttgcagatgttccacaccagtaattgaatatggaactgtcaatgggacagattttgactgtggaaaggcagcccggattcagtgcttcaaaggcttcaagctcctaggactttctgaaatcacctgtgaagccgatggccagtggagctctgggttcccccactgtgaacacacttcttgtggttctcttccaatgataccaaatgcgttcatcagtgagaccagctcttggaaggaaaatgtgataacttacagctgcaggtctggatatgtcatacaaggcagttcagatctgatttgtacagagaaaggggtatggagccagccttatccagtctgtgagcccttgtcctgtgggtccccaccgtctgtcgccaatgcagtggcaactggagaggcacacacctatgaaagtgaagtgaaactcagatgtctggaaggttatacgatggatacagatacagatacattcacctgtcagaaagatggtcgctggttccctgagagaatctcctgcagtcctaaaaaatgtcctctcccggaaaacataacacatatacttgtacatggggacgatttcagtgtgaataggcaagtttctgtgtcatgtgcagaagggtatacctttgagggagttaacatatcagtatgtcagcttgatggaacctgggagccaccattctccgatgaatcttgcagtccagtttcttgtgggaaacctgaaagtccagaacatggatttgtggttggcagtaaatacacctttgaaagcacaattatttatcagtgtgagcctggctatgaactagaggggaacagggaacgtgtctgccaggagaacagacagtggagtggaggggtggcaatatgcaaagagaccaggtgtgaaactccacttgaatttctcaatgggaaagctgacattgaaaacaggacgactggacccaacgtggtatattcctgcaacagaggctacagtcttgaagggccatctgaggcacactgcacagaaaatggaacctggagccacccagtccctctctgcaaaccaaatccatgccctgttccttttgtgattcccgagaatgctctgctgtctgaaaaggagttttatgttgatcagaatgtgtccatcaaatgtagggaaggttttctgctgcagggccacggcatcattacctgcaaccccgacgagacgtggacacagacaagcgccaaatgtgaaaaaatctcatgtggtccaccagctcacgtagaaaatgcaattgctcgaggcgtacattatcaatatggagacatgatcacctactcatgttacagtggatacatgttggagggtttcctgaggagtgtttgtttagaaaatggaacatggacatcacctcctatttgcagagctgtctgtcgatttccatgtcagaatgggggcatctgccaacgcccaaatgcttgttcctgtccagagggctggatggggcgcctctgtgaagaaccaatctgcattcttccctgtctgaacggaggtcgctgtgtggccccttaccagtgtgactgcccgcctggctggacggggtctcgctgtcatacagctgtttgccagtctccctgcttaaatggtggaaaatgtgtaagaccaaaccgatgtcactgtctttcttcttggacgggacataactgttccaggaaaaggaggactgggttttaaccactgcacgaccatctggctctcccaaaagcaggatcatctctcctcggtagtgcctgggcatcctggaacttatgcaaagaaagtccaacatggtgctgggtcttgtttagtaaacttgttacttggggttactttttttattttgtgatatattttgttattccttgtgacatactttcttacatgtttccatttttaaatatgcctgtattttctatataaaaattatattaaatagatgctgctctaccctcacaaaatgtacatattctgctgtctattgggaaagttcctggtacacatttttattcagttacttaaaatgatttttccattaaagtatattttgctactaaataatattttgctggatagtaccattttatgaggtggccaagggattcatagagaggactcatgatctttcatctgtgccactggcaccacataggagaccccttacaataaaggagacccctttgttctggttccatcttctatacaatatgtgtaataataaaagctttttctttcatttaatcaatcagagagtaactgttggacctggtactctccaccacataattatgtcctggtacttagggtagcctggctaattcttttcacaacatttgaaaagccgtaggcattaacttcatggatgtggagaaacagcataatgaccttggttcacaatgaaagtgctagccttctttctcgtggctggaataagaaatgcaagaactggaagattaacaaagagctgatacccggactggtaatcccacaactcactattttgggaggaaggggaagacagggaaagagaaggaaaaaggcaaatgggaaacattccccagagctgtgctcctggtctcacctgcaaaaaagaattgcagccacctaagagaaagctgagctgcccctcagtcctcactgtcacctacctctatcacaacaattgtaccaagatgaagccttccccagacttcagaaaataaagtcaaaccctagattttgttttaaaataggaaactcagaatcaacttgcctccatcctctgggaaaactgctcccacacaggccttggagtgtgttgtagcactgtggaggaatgcagaaaggatgaaagagatcttgattctcctagtggttctcttcactaccgtaggcatccctcagccattgactcctccttctttctcttgacattcactttcttggccagtcttacatgcttatgagtctactttccaataaatttactcatagtccattaa

SEQ ID NO: 21013 - DNA, 588 bp, Homo sapiens
  ENST00000476205
tggaacatggacatcacctcctatttgcagagctgtctgtcgatttccatgtcagaatgggggcatctgccaacgcccaaatgcttgttcctgtccagagggctggatggggcgcctctgtgaagaacgtgagttgctcttcagatcttactttgagtcctgacaaattgcctggatgctcccacctgaggggagttaccaggaaatggttgtactgttgggaagaattcatttgctgtaagtccttgtccacaccaaacagagcacatatgtgtcaacaggttgcagaagatctagaatattaatgactttgaaaatactgttattaagatccatctaaagtcattttcacatgttccctggcacaaatttgcaaaagtcttcttgagaaggagcttgttgtaaagtctccaagctatcctcttcccttaactcaaggtctactatgtgctatgtcagtcattgctgcagttggtataaacgtgcaccactgcaaaacatgtactttgcaggtaatatttgcagctcaccatttcctctttgttgttaagaatagtttctactcattaagaaaataagaaaagctgg

SEQ ID NO: 21014 - DNA, 5124 bp, Homo sapiens
  ENST00000467821
cactgatggatattccaatgggggagaccctagaccaattgcagcgtcactgcgagattcaggagtggagatcttcacttttggcatatggcaagggaacattcgagagctgaatgacatggcttccaccccaaaggaggagcactgttacctgctacacagttttgaagaatttgaggctttagctcgccgggcattgcatgaagatctaccttctgggagttttattcaagatgatatggtccactgctcatatctttgtgatgaaggcaaggactgctgtgaccgaatgggaagctgcaaatgtgggacacacacaggccattttgagtgcatctgtgaaaaggggtattacgggaaaggtctgcagtatgaatgcacagcttgcccatcggggacatacaaacctgaaggctcaccaggaggaatcagcagttgcattccatgtcctgatgaaaatcacacctctccacctggaagcacatcccctgaagactgtgtctgcagagagggatacagggcatctggccagacctgtgaacttgtccactgccctgccctgaagcctcccgaaaatggttactttatccaaaacacttgcaacaaccacttcaatgcagcctgtggggtccgatgtcaccctggatttgatcttgtgggaagcagcatcatcttatgtctacccaatggtttgtggtccggttcagagagctactgcagagtaagaacatgtcctcatctccgccagccgaaacatggccacatcagctgttctacaagggaaatgttatataagacaacatgtttggttgcctgtgatgaagggtacagactagaaggcagtgataagcttacttgtcaaggaaacagccagtgggatgggccagaaccccggtgtgtggagcgccactgttccacctttcagatgcccaaagatgtcatcatatccccccacaactgtggcaagcagccagccaaatttgggacgatctgctatgtaagttgccgccaagggttcattttatctggagtcaaagaaatgctgagatgtaccacttctggaaaatggaatgtcggagttcaggcagctgtgtgtaaagacgtggaggctcctcaaatcaactgtcctaaggacatagaggctaagactctggaacagcaagattctgccaatgttacctggcagattccaacagctaaagacaactctggtgaaaaggtgtcagtccacgttcatccagctttcaccccaccttaccttttcccaattggagatgttgctatcgtatacacggcaactgacctatccggcaaccaggccagctgcattttccatatcaaggttattgatgcagaaccacctgtcatagactggtgcagatctccacctcccgtccaggtctcggagaaggtacatgccgcaagctgggatgagcctcagttctcagacaactcaggggctgaattggtcattaccagaagtcatacacaaggagaccttttccctcaaggggagactatagtacagtatacagccactgacccctcaggcaataacaggacatgtgatatccatattgtcataaaaggttctccctgtgaaattccattcacacctgtaaatggggattttatatgcactccagataatactggagtcaactgtacattaacttgcttggagggctatgatttcacagaagggtctactgacaagtattattgtgcttatgaagatggcgtctggaaaccaacatataccactgaatggccagactgtgccaaaaaacgttttgcaaaccacgggttcaagtcctttgagatgttctacaaagcagctcgttgtgatgacacagatctgatgaagaagttttctgaagcatttgagacgaccctgggaaaaatggtcccatcattttgtagtgatgcagaggacattgactgcagactggaggagaacctgaccaaaaaatattgcctagaatataattatgactatgaaaatggctttgcaattggaccaggtggctggggtgcagctaataggctggattactcttacgatgacttcctggacactgtgcaagaaacagccacaagcatcggcaatgccaagtcctcacggattaaaagaagtgccccattatctgactataaaattaagttaatttttaacatcacagctagtgtgccattacccgatgaaagaaatgatacccttgaatgggaaaatcagcaacgactccttcagacattggaaactatcacaaataaactgaaaaggactctcaacaaagaccccatgtattcctttcagcttgcatcagaaatacttatagccgacagcaattcattagaaacaaaaaaggcttcccccttctgcagaccaggctcagtgctgagagggcgtatgtgtgtcaattgccctttgggaacctattataatctggaacatttcacctgtgaaagctgccggatcggatcctatcaagatgaagaagggcaacttgagtgcaagctttgcccctctgggatgtacacggaatatatccattcaagaaacatctctgattgtaaagctcagtgtaaacaaggcacctactcatacagtggacttgagacttgtgaatcgtgtccactgggcacttatcagccaaaatttggttcccggagctgcctctcgtgtccagaaaacacctcaactgtgaaaagaggagccgtgaacatttctgcatgtggagttccttgtccagaaggaaaattctcgcgttctgggttaatgccctgtcacccatgtcctcgtgactattaccaacctaatgcagggaaggccttctgcctggcctgtcccttttatggaactaccccattcgctggttccagatccatcacagaatgttcaagttttagttcaactttctcagcggcagaggaaagtgtggtgccccctgcctctcttggacatattaaaaagaggcatgaaatcagcagtcaggttttccatgaatgcttctttaacccttgccacaatagtggaacctgccagcaacttgggcgtggttatgtttgtctctgtccacttggatatacaggcttaaagtgtgaaacagacatcgatgagtgcagcccactgccttgcctcaacaatggagtttgtaaagacctagttggggaattcatttgtgagtgcccatcaggttacacaggtcagcggtgtgaagaaaatataaatgagtgtagctccagtccttgtttaaataaaggaatctgtgttgatggtgtggctggctatcgttgcacatgtgtgaaaggatttgtaggcctgcattgtgaaacagaagtcaatgaatgccagtcaaacccatgcttaaataatgcagtctgtgaagaccaggttgggggattcttgtgcaaatgcccacctggatttttgggtacccgatgtggaaagaacgtcgatgagtgtctcagtcagccatgcaaaaatggagctacctgtaaagacggtgccaatagcttcagatgcctgtgtgcagctggcttcacaggatcacactgtgaattgaacatcaatgaatgtcagtctaatccatgtagaaatcaggccacctgtgtggatgaattaaattcatacagttgtaaatgtcagccaggattttcaggcaaaaggtgtgaaacagaacagtctacaggctttaacctggattttgaagtttctggcatctatggatatgtcatgctagatggcatgctcccatctctccatgctctaacctgtaccttctggatgaaatcctctgacgacatgaactatggaacaccaatctcctatgcagttgataacggcagcgacaataccttgctcctgactgattataacggctgggttctttatgtgaatggcagggaaaagataacaaactgtccctcggtgaatgatggcagatggcatcatattgcaatcacttggacaagtgccaatggcatctggaaagtctatatcgatgggaaattatctgacggtggtgctggcctctctgttggtttgcccatacctggtatgttttaacaaaatgagtataattctgttggactctagaggtgatgctgcttaaatggacatcaggtttgctagcattgttgttcttggtttcaaacaaagattaacagctatctctcttatttcctactccctgattatcctaactgtgggttattagaagcttttttcctaagtaagctgtttgcctctctgtgtgagaaatgcctttgaagatctacattaagactaccaagaagcatgctgaattagcagctggttgctaaactgtcttctaaggagattaattactggtattttttgtttattttaaggattgttttgttttgtaatcagtatataagcaggaccactgctatccatcttttatggcccttttcaaatagatcttggcttgtcttctaaaaaatactttttaataaatatcccaggagttttagtttgaagaattgcaaactaaatttcattaggtgacccaggttctcagcattgtacatggcaataagcttgttctatctggatacatctatagaagtatatgcatatgacattattttttactttgctcatttgtttcaggtatactaaaagaaaattaaatagacaaaaatgaattaaagtattagaaactgactaatacattctagaagtaagttgtatgaaactaggatacgtatactaataaatatagcacaaaaatactaaacttcataaaaatgcggtgagatgacccttgcgaagcctcaaatacaatacttattttatttattagaaattattggccaggtacggtggctcacgcctgtaatcccagcactttggaaggctgaggagggtggatcacgaggtcaggagttggagaccgccctggacaatatggtgaagccctatctctactaaaaacgcacagaaaaattagccaggcatggtggtagatgcctgtaattccagctactcaggaggctgaggcaggagaatcgcttgaacccaggaggcgaagattgccgtgagccgagatcatgccactgcactccagcctgggcaatggagagaggctctgtctc

SEQ ID NO: 21015 - DNA, 3257 bp, Homo sapiens
  ENST00000374461
agggagagaaggagggaagcgggagatttttcttgactgccccctttccttcaaacattttataggcttcagggagagagaggaggaggagagagggaagaaaaaaagaggagagcgagaggggtagagagcgcgcgccgttccctccggagttcccgagctgctgaggagtctggattgtgtctgtccccagtgtcagatgaaagggcgctgaggctcttggccgctgccccgcgcccagctccgcgcacgcccctctgcgagtccggccgcccagcgcctcttcccgcccgagccgccgcctgcgctccggggcagccgctctgtctccagcgcgatgtggcctcgcctggccttttgttgctggggtctggcgctcgtttcgggctgggcgacctttcagcagatgtccccgtcgcgcaatttcagcttccgcctcttccccgagaccgcgcccggggcccccgggagtatccccgcgccgcccgctcctggcgacgaagcggcggggagcagagtggagcggctgggccaggcgttccggcgacgcgtgcggctgctgcgggagctcagcgagcgcctggagcttgtcttcctggtggatgattcgtccagcgtgggcgaagtcaacttccgcagcgagctcatgttcgtccgcaagctgctgtccgacttccccgtggtgcccacggccacgcgcgtggccatcgtgaccttctcgtccaagaactacgtggtgccgcgcgtcgattacatctccacccgccgcgcgcgccagcacaagtgcgcgctgctcctccaagagatccctgccatctcctaccgaggtggcggcacctacaccaagggcgccttccagcaagccgcgcaaattcttcttcatgctagagaaaactcaacaaaagttgtatttctcatcactgatggatattccaatgggggagaccctagaccaattgcagcgtcactgcgagattcaggagtggagatcttcacttttggcatatggcaagggaacattcgagagctgaatgacatggcttccaccccaaaggaggagcactgttacctgctacacagttttgaagaatttgaggctttagctcgccgggcattgcatgaagatctaccttctgggagttttattcaagatgatatggtccactgctcatatctttgtgatgaaggcaaggactgctgtgaccgaatgggaagctgcaaatgtgggacacacacaggccattttgagtgcatctgtgaaaaggggtattacgggaaaggtctgcagtatgaatgcacagcttgcccatcggggacatacaaacctgaaggctcaccaggaggaatcagcagttgcattccatgtcctgatgaaaatcacacctctccacctggaagcacatcccctgaagactgtgtctgcagagagggatacagggcatctggccagacctgtgaacttgtccactgccctgccctgaagcctcccgaaaatggttactttatccaaaacacttgcaacaaccacttcaatgcagcctgtggggtccgatgtcaccctggatttgatcttgtgggaagcagcatcatcttatgtctacccaatggtttgtggtccggttcagagagctactgcagagtaagaacatgtcctcatctccgccagccgaaacatggccacatcagctgttctacaagggaaatgttatataagacaacatgtttggttgcctgtgatgaagggtacagactagaaggcagtgataagcttacttgtcaaggaaacagccagtgggatgggccagaaccccggtgtgtggagcgccactgttccacctttcagatgcccaaagatgtcatcatatccccccacaactgtggcaagcagccagccaaatttgggacgatctgctatgtaagttgccgccaagggttcattttatctggagtcaaagaaatgctgagatgtaccacttctggaaaatggaatgtcggagttcaggcagctgtgtgtaaagacgtggaggctcctcaaatcaactgtcctaaggacatagaggctaagactctggaacagcaagattctgccaatgttacctggcagattccaacagctaaagacaactctggtgaaaaggtgtcagtccacgttcatccagctttcaccccaccttaccttttcccaattggagatgttgctatcgtatacacggcaactgacctatccggcaaccaggccagctgcattttccatatcaaggttattgatgcagaaccacctgtcatagactggtgcagatctccacctcccgtccaggtctcggagaaggtacatgccgcaagctgggatgagcctcagttctcagacaactcaggggctgaattggtcattaccagaagtcatacacaaggagaccttttccctcaaggggagactatagtacagtatacagccactgacccctcaggcaataacaggacatgtgatatccatattgtcataaaaggttctccctgtgaaattccattcacacctgtaaatggggattttatatgcactccagataatactggagtcaactgtacattaacttgcttggagggctatgatttcacagaagggtctactgacaagtattattgtgcttatgaagatggcgtctggaaaccaacatataccactgaatggccagactgtgccaaaaaacgttttgcaaaccacgggttcaagtcctttgagatgttctacaaagcagctcgttgtgatgacacagatctgatgaagaagttttctgaagcatttgagacgaccctgggaaaaatggtcccatcattttgtagtgatgcagaggacattgactgcagactggaggagaacctgaccaaaaaatattgcctagaatataattatgactatgaaaatggctttgcaattggtaattaaattctgtggcatcggtagttggcaagactaatctgcaaaataagaataattccagaaaagtgaggcaaactagaaacattaacttctattaatttattcatcaagtattttaggatggctaaataatttgataatgtgctgaaagatcattaaggttatatcaaattttagtaacaaataaattatttaaaattatttgccaggattcttaaaaatgacaaaaactaagaaaactaagtcacatatgctggtaaaattcaaatgttgatgtatcctaaaagagaatagtaataaagtcctaacagcaactttt

SEQ ID NO: 21016 - DNA, 12350 bp, Homo sapiens
  ENST00000401783
agggagagaaggagggaagcgggagatttttcttgactgccccctttccttcaaacattttataggcttcagggagagagaggaggaggagagagggaagaaaaaaagaggagagcgagaggggtagagagcgcgcgccgttccctccggagttcccgagctgctgaggagtctggattgtgtctgtccccagtgtcagatgaaagggcgctgaggctcttggccgctgccccgcgcccagctccgcgcacgcccctctgcgagtccggccgcccagcgcctcttcccgcccgagccgccgcctgcgctccggggcagccgctctgtctccagcgcgatgtggcctcgcctggccttttgttgctggggtctggcgctcgtttcgggctgggcgacctttcagcagatgtccccgtcgcgcaatttcagcttccgcctcttccccgagaccgcgcccggggcccccgggagtatccccgcgccgcccgctcctggcgacgaagcggcggggagcagagtggagcggctgggccaggcgttccggcgacgcgtgcggctgctgcgggagctcagcgagcgcctggagcttgtcttcctggtggatgattcgtccagcgtgggcgaagtcaacttccgcagcgagctcatgttcgtccgcaagctgctgtccgacttccccgtggtgcccacggccacgcgcgtggccatcgtgaccttctcgtccaagaactacgtggtgccgcgcgtcgattacatctccacccgccgcgcgcgccagcacaagtgcgcgctgctcctccaagagatccctgccatctcctaccgaggtggcggcacctacaccaagggcgccttccagcaagccgcgcaaattcttcttcatgctagagaaaactcaacaaaagttgtatttctcatcactgatggatattccaatgggggagaccctagaccaattgcagcgtcactgcgagattcaggagtggagatcttcacttttggcatatggcaagggaacattcgagagctgaatgacatggcttccaccccaaaggaggagcactgttacctgctacacagttttgaagaatttgaggctttagctcgccgggcattgcatgaagatctaccttctgggagttttattcaagatgatatggtccactgctcatatctttgtgatgaaggcaaggactgctgtgaccgaatgggaagctgcaaatgtgggacacacacaggccattttgagtgcatctgtgaaaaggggtattacgggaaaggtctgcagtatgaatgcacagcttgcccatcggggacatacaaacctgaaggctcaccaggaggaatcagcagttgcattccatgtcctgatgaaaatcacacctctccacctggaagcacatcccctgaagactgtgtctgcagagagggatacagggcatctggccagacctgtgaacttgtccactgccctgccctgaagcctcccgaaaatggttactttatccaaaacacttgcaacaaccacttcaatgcagcctgtggggtccgatgtcaccctggatttgatcttgtgggaagcagcatcatcttatgtctacccaatggtttgtggtccggttcagagagctactgcagagtaagaacatgtcctcatctccgccagccgaaacatggccacatcagctgttctacaagggaaatgttatataagacaacatgtttggttgcctgtgatgaagggtacagactagaaggcagtgataagcttacttgtcaaggaaacagccagtgggatgggccagaaccccggtgtgtggagcgccactgttccacctttcagatgcccaaagatgtcatcatatccccccacaactgtggcaagcagccagccaaatttgggacgatctgctatgtaagttgccgccaagggttcattttatctggagtcaaagaaatgctgagatgtaccacttctggaaaatggaatgtcggagttcaggcagctgtgtgtaaagacgtggaggctcctcaaatcaactgtcctaaggacatagaggctaagactctggaacagcaagattctgccaatgttacctggcagattccaacagctaaagacaactctggtgaaaaggtgtcagtccacgttcatccagctttcaccccaccttaccttttcccaattggagatgttgctatcgtatacacggcaactgacctatccggcaaccaggccagctgcattttccatatcaaggttattgatgcagaaccacctgtcatagactggtgcagatctccacctcccgtccaggtctcggagaaggtacatgccgcaagctgggatgagcctcagttctcagacaactcaggggctgaattggtcattaccagaagtcatacacaaggagaccttttccctcaaggggagactatagtacagtatacagccactgacccctcaggcaataacaggacatgtgatatccatattgtcataaaaggttctccctgtgaaattccattcacacctgtaaatggggattttatatgcactccagataatactggagtcaactgtacattaacttgcttggagggctatgatttcacagaagggtctactgacaagtattattgtgcttatgaagatggcgtctggaaaccaacatataccactgaatggccagactgtgccaaaaaacgttttgcaaaccacgggttcaagtcctttgagatgttctacaaagcagctcgttgtgatgacacagatctgatgaagaagttttctgaagcatttgagacgaccctgggaaaaatggtcccatcattttgtagtgatgcagaggacattgactgcagactggaggagaacctgaccaaaaaatattgcctagaatataattatgactatgaaaatggctttgcaattggaccaggtggctggggtgcagctaataggctggattactcttacgatgacttcctggacactgtgcaagaaacagccacaagcatcggcaatgccaagtcctcacggattaaaagaagtgccccattatctgactataaaattaagttaatttttaacatcacagctagtgtgccattacccgatgaaagaaatgatacccttgaatgggaaaatcagcaacgactccttcagacattggaaactatcacaaataaactgaaaaggactctcaacaaagaccccatgtattcctttcagcttgcatcagaaatacttatagccgacagcaattcattagaaacaaaaaaggcttcccccttctgcagaccaggctcagtgctgagagggcgtatgtgtgtcaattgccctttgggaacctattataatctggaacatttcacctgtgaaagctgccggatcggatcctatcaagatgaagaagggcaacttgagtgcaagctttgcccctctgggatgtacacggaatatatccattcaagaaacatctctgattgtaaagctcagtgtaaacaaggcacctactcatacagtggacttgagacttgtgaatcgtgtccactgggcacttatcagccaaaatttggttcccggagctgcctctcgtgtccagaaaacacctcaactgtgaaaagaggagccgtgaacatttctgcatgtggagttccttgtccagaaggaaaattctcgcgttctgggttaatgccctgtcacccatgtcctcgtgactattaccaacctaatgcagggaaggccttctgcctggcctgtcccttttatggaactaccccattcgctggttccagatccatcacagaatgttcaagttttagttcaactttctcagcggcagaggaaagtgtggtgccccctgcctctcttggacatattaaaaagaggcatgaaatcagcagtcaggttttccatgaatgcttctttaacccttgccacaatagtggaacctgccagcaacttgggcgtggttatgtttgtctctgtccacttggatatacaggcttaaagtgtgaaacagacatcgatgagtgcagcccactgccttgcctcaacaatggagtttgtaaagacctagttggggaattcatttgtgagtgcccatcaggttacacaggtcagcggtgtgaagaaaatataaatgagtgtagctccagtccttgtttaaataaaggaatctgtgttgatggtgtggctggctatcgttgcacatgtgtgaaaggatttgtaggcctgcattgtgaaacagaagtcaatgaatgccagtcaaacccatgcttaaataatgcagtctgtgaagaccaggttgggggattcttgtgcaaatgcccacctggatttttgggtacccgatgtggaaagaacgtcgatgagtgtctcagtcagccatgcaaaaatggagctacctgtaaagacggtgccaatagcttcagatgcctgtgtgcagctggcttcacaggatcacactgtgaattgaacatcaatgaatgtcagtctaatccatgtagaaatcaggccacctgtgtggatgaattaaattcatacagttgtaaatgtcagccaggattttcaggcaaaaggtgtgaaacagaacagtctacaggctttaacctggattttgaagtttctggcatctatggatatgtcatgctagatggcatgctcccatctctccatgctctaacctgtaccttctggatgaaatcctctgacgacatgaactatggaacaccaatctcctatgcagttgataacggcagcgacaataccttgctcctgactgattataacggctgggttctttatgtgaatggcagggaaaagataacaaactgtccctcggtgaatgatggcagatggcatcatattgcaatcacttggacaagtgccaatggcatctggaaagtctatatcgatgggaaattatctgacggtggtgctggcctctctgttggtttgcccatacctggtatgttaggtggtggtgcgttagttctggggcaagagcaagacaaaaaaggagagggattcagcccagctgagtcttttgtgggctccataagccagctcaacctctgggactatgtcctgtctccacagcaggtgaagtcactggctacctcctgcccagaggaactcagtaaaggaaacgtgttagcatggcctgatttcttgtcaggaattgtggggaaagtgaagatcgattctaagagcatattttgttctgattgcccacgcttaggagggtcagtgcctcatctgagaactgcatctgaagatttaaagccaggttccaaagtcaatctgttctgtgatccaggcttccagctggtcgggaaccctgtgcagtactgtctgaatcaaggacagtggacacaaccacttcctcactgtgaacgcattagctgtggggtgccacctcctttggagaatggcttccattcagccgatgacttctatgctggcagcacagtaacctaccagtgcaacaatggctactatctattgggtgactcaaggatgttctgtacagataatgggagctggaacggcgtttcaccatcctgccttgatgtcgatgagtgtgcagttggatcagattgtagtgagcatgcttcttgcctgaacgtagatggatcctacatatgttcatgtgtcccaccgtacacaggagatgggaaaaactgtgcagaacctataaaatgtaaggctccaggaaatccggaaaatggccactcctcaggtgagatttatacagtaggtgccgaagtcacattttcgtgtcaggaaggataccagttgatgggagtaaccaaaatcacatgtttggagtctggagaatggaatcatctaataccatattgtaaagctgtttcatgtggtaaaccggctattccagaaaatggttgcattgaggagttagcatttacttttggcagcaaagtgacatataggtgtaataaaggatatactctggccggtgataaagaatcatcctgtcttgctaacagttcttggagtcattcccctcctgtgtgtgaaccagtgaagtgttctagtccggaaaatataaataatggaaaatatattttgagtgggcttacctacctttctactgcatcatattcatgcgatacaggatacagcttacagggcccttccattattgaatgcacggcttctggcatctgggacagagcgccacctgcctgtcacctcgtcttctgtggagaaccacctgccatcaaagatgctgtcattacggggaataacttcactttcaggaacaccgtcacttacacttgcaaagaaggctatactcttgctggtcttgacaccattgaatgcctggccgacggcaagtggagtagaagtgaccagcagtgcctggctgtctcctgtgatgagccacccattgtggaccacgcctctccagagactgcccatcggctctttggagacattgcattctactactgctctgatggttacagcctagcagacaattcccagcttctctgcaatgcccagggcaagtgggtacccccagaaggtcaagacatgccccgttgtatagctcatttctgtgaaaaacctccatcggtttcctatagcatcttggaatctgtgagcaaagcaaaatttgcagctggctcagttgtgagctttaaatgcatggaaggctttgtactgaacacctcagcaaagattgaatgtatgagaggtgggcagtggaacccttcccccatgtccatccagtgcatccctgtgcggtgtggagagccaccaagcatcatgaatggctatgcaagtggatcaaactacagttttggagccatggtggcttacagctgcaacaaggggttctacatcaaaggggaaaagaagagcacctgcgaagccacagggcagtggagtagtcctataccgacgtgccacccggtatcttgtggtgaaccacctaaggttgagaatggctttctggagcatacaactggcaggatctttgagagtgaagtgaggtatcagtgtaacccgggctataagtcagtcggaagtcctgtatttgtctgccaagccaatcgccactggcacagtgaatcccctctgatgtgtgttcctctcgactgtggaaaacctcccccgatccagaatggcttcatgaaaggagaaaactttgaagtagggtccaaggttcagtttttctgtaatgagggttatgagcttgttggtgacagttcttggacatgtcagaaatctggcaaatggaataagaagtcaaatccaaagtgcatgcctgccaagtgcccagagccgcccctcttggaaaaccagctagtattaaaggagttgaccaccgaggtaggagttgtgacattttcctgtaaagaagggcatgtcctgcaaggcccctctgtcctgaaatgcttgccatcccagcaatggaatgactctttccctgtttgtaagattgttctttgtaccccacctcccctaatttcctttggtgtccccattccttcttctgctcttcattttggaagtactgtcaagtattcttgtgtaggtgggtttttcctaagaggaaattctaccaccctctgccaacctgatggcacctggagctctccactgccagaatgtgttccagtagaatgtccccaacctgaggaaatccccaatggaatcattgatgtgcaaggccttgcctatctcagcacagctctctatacctgcaagccaggctttgaattggtgggaaatactaccaccctttgtggagaaaatggtcactggcttggaggaaaaccaacatgtaaagccattgagtgcctgaaacccaaggagattttgaatggcaaattctcttacacggacctacactatggacagaccgttacctactcttgcaaccgaggctttcggctcgaaggtcccagtgccttgacctgtttagagacaggtgattgggatgtagatgccccatcttgcaatgccatccactgtgattccccacaacccattgaaaatggttttgtagaaggtgcagattacagctatggtgccataatcatctacagttgcttccctgggtttcaggtggctggtcatgccatgcagacctgtgaagagtcaggatggtcaagttccatcccaacatgtatgccaatagactgtggcctccctcctcatatagattttggagactgtactaaactcaaagatgaccagggatattttgagcaagaagacgacatgatggaagttccatatgtgactcctcaccctccttatcatttgggagcagtggctaaaacctgggaaaatacaaaggagtctcctgctacacattcatcaaactttctgtatggtaccatggtttcatacacctgtaatccaggatatgaacttctggggaaccctgtgctgatctgccaggaagatggaacttggaatggcagtgcaccatcctgcatttcaattgaatgtgacttgcctactgctcctgaaaatggctttttgcgttttacagagactagcatgggaagtgctgtgcagtatagctgtaaacctggacacattctagcaggctctgacttaaggctttgtctagagaatagaaagtggagtggtgcctccccacgctgtgaagccatttcatgcaaaaagccaaatccagtcatgaatggatccatcaaaggaagcaactacacatacctgagcacgttgtactatgagtgtgaccccggatatgtgctgaatggcactgagaggagaacatgccaggatgacaaaaactgggatgaggatgagcccatttgcattcctgtggactgcagttcacccccagtctcagccaatggccaggtgagaggagacgagtacacattccaaaaagagattgaatacacttgcaatgaagggttcttgcttgagggagccaggagtcgggtttgtcttgccaatggaagttggagtggagccactcccgactgtgtgcctgtcagatgtgccaccccgccacaactggccaatggggtgacggaaggcctggactatggcttcatgaaggaagtaacattccactgtcacgagggctacatcttgcacggtgctccaaaactcacctgtcagtcagatggcaactgggatgcagagattcctctctgtaaaccagtcaactgtggacctcctgaagatcttgcccatggtttccctaatggtttttcctttattcatgggggccatatacagtatcagtgctttcctggttataagctccatggaaattcatcaagaaggtgcctctccaatggctcctggagtggcagctcaccttcctgcctgccttgcagatgttccacaccagtaattgaatatggaactgtcaatgggacagattttgactgtggaaaggcagcccggattcagtgcttcaaaggcttcaagctcctaggactttctgaaatcacctgtgaagccgatggccagtggagctctgggttcccccactgtgaacacacttcttgtggttctcttccaatgataccaaatgcgttcatcagtgagaccagctcttggaaggaaaatgtgataacttacagctgcaggtctggatatgtcatacaaggcagttcagatctgatttgtacagagaaaggggtatggagccagccttatccagtctgtgagcccttgtcctgtgggtccccaccgtctgtcgccaatgcagtggcaactggagaggcacacacctatgaaagtgaagtgaaactcagatgtctggaaggttatacgatggatacagatacagatacattcacctgtcagaaagatggtcgctggttccctgagagaatctcctgcagtcctaaaaaatgtcctctcccggaaaacataacacatatacttgtacatggggacgatttcagtgtgaataggcaagtttctgtgtcatgtgcagaagggtatacctttgagggagttaacatatcagtatgtcagcttgatggaacctgggagccaccattctccgatgaatcttgcagtccagtttcttgtgggaaacctgaaagtccagaacatggatttgtggttggcagtaaatacacctttgaaagcacaattatttatcagtgtgagcctggctatgaactagaggggaacagggaacgtgtctgccaggagaacagacagtggagtggaggggtggcaatatgcaaagagaccaggtgtgaaactccacttgaatttctcaatgggaaagctgacattgaaaacaggacgactggacccaacgtggtatattcctgcaacagaggctacagtcttgaagggccatctgaggcacactgcacagaaaatggaacctggagccacccagtccctctctgcaaaccaaatccatgccctgttccttttgtgattcccgagaatgctctgctgtctgaaaaggagttttatgttgatcagaatgtgtccatcaaatgtagggaaggttttctgctgcagggccacggcatcattacctgcaaccccgacgagacgtggacacagacaagcgccaaatgtgaaaaaatctcatgtggtccaccagctcacgtagaaaatgcaattgctcgaggcgtacattatcaatatggagacatgatcacctactcatgttacagtggatacatgttggagggtttcctgaggagtgtttgtttagaaaatggaacatggacatcacctcctatttgcagagctgtctgtcgatttccatgtcagaatgggggcatctgccaacgcccaaatgcttgttcctgtccagagggctggatggggcgcctctgtgaagaaccaatctgcattcttccctgtctgaacggaggtcgctgtgtggccccttaccagtgtgactgcccgcctggctggacggggtctcgctgtcatacagctgtttgccagtctccctgcttaaatggtggaaaatgtgtaagaccaaaccgatgtcactgtctttcttcttggacgggacataactgttccaggaaaaggaggactgggttttaaccactgcacgaccatctggctctcccaaaagcaggatcatctctcctcggtagtgcctgggcatcctggaacttatgcaaagaaagtccaacatggtgctgggtcttgtttagtaaacttgttacttggggttactttttttattttgtgatatattttgttattccttgtgacatactttcttacatgtttccatttttaaatatgcctgtattttctatataaaaattatattaaatagatgctgctctaccctcacaaaatgtacatattctgctgtctattgggaaagttcctggtacacatttttattcagttacttaaaatgatttttccattaaagtatattttgctactaaataatattttgctggatagtaccattttatgaggtggccaagggattcatagagaggactcatgatctttcatctgtgccactggcaccacataggagaccccttacaataaaggagacccctttgttctggttccatcttctatacaatatgtgtaataataaaagctttttctttcatttaatcaatcagagagtaactgttggacctggtactctccaccacataattatgtcctggtacttagggtagcctggctaattcttttcacaacatttgaaaagccgtaggcattaacttcatggatgtggagaaacagcataatgaccttggttcacaatgaaagtgctagccttctttctcgtggctggaataagaaatgcaagaactggaagattaacaaagagctgatacccggactggtaatcccacaactcactattttgggaggaaggggaagacagggaaagagaaggaaaaaggcaaatgggaaacattccccagagctgtgctcctggtctcacctgcaaaaaagaattgcagccacctaagagaaagctgagctgcccctcagtcctcactgtcacctacctctatcacaacaattgtaccaagatgaagccttccccagacttcagaaaataaagtcaaaccctagattttgttttaaaataggaaactcagaatcaacttgcctccatcctctgggaaaactgctcccacacaggccttggagtgtgttgtagcactgtggaggaatgcagaaaggatgaaagagatcttgattctcctagtggttctcttcactaccgtaggcatccctcagccattgactcctccttctttctcttgacattcactttcttggccagtcttacatgcttatgagtctactttccaataaatttactcatagtccattaacttcc

SEQ ID NO: 21017 - DNA, 6729 bp, Homo sapiens
  ENST00000375400
ctgtcggcgggaagcggcgatcctgccaccgggaggtgtggaagagccgggtagattctggctacattggagattggttgctttctaaaactgaaggagaagcccatgaagagatggtggattctcactgagttttgactagcggaagaaaagagagagttcaagtggatggccttgaggacttgaaaagctgagatatgatgattttgaagtcatttcacatcgaagccatgatttaaatatcggcgttaagatttcaacaagaaaaacttaagcttccttggattcccacgtcaaaggaaagtttcaagctttcagaaggagttctcactcgaagataaagaacagctcgctaaccacgaaagaggaatcgatgctcagcttttagttgcacttcctaaagttgcagaattaagacaaatctttgaaccaaagaagaaagaattcttagaaatgaaaagaaaagaaagaattgccaggcgcctggaagggattgaaaatgacactcagcccatcctcttgcagagctgcacaggattggtgactcaccgcctgctggaggaagacacccctcgatacatgagagccagcgaccctgccagcccccacatcggccgatcaaatgaagaggaggaaacttctgattcttctctagaaaagcaaactcgatccaaatactgcacagaaacctccggtgtccacggtgactcaccctatggttcgggtaccatggacacccacagtctggagtccaaagccgaaagaattgcaaggtacaaagcagaaagaaggcgacagctggcagagaagtatgggctgactctggatcccgaggccgactccgagtatttatcccgctataccaagtccaggaaggagcctgatgctgtcgagaagcggggaggaaaaagtgacaaacaggaagagtcaagcagagatgctagttctctgtaccccgggaccgagacgatggggctcaggacctgtgccggtgaatccaaggactatgccctccatgtgggtgacggctcttccgacccggaggtgctgctgaacatagaaaaccaaagacgaggtcaagagctgagtgccacccggcaggcccatgacctgtccccagcagccgagagttcctcgaccttctctttctctgggcgagactcctccttcactgaagtgccacggtcccccaagcacgcccacagctcctccctgcagcaggcagcctcccggagcccctcctttggtgacccacagctatcccctgaggcccgacccaggtgcacttcacattcagaaacgccaactgtcgatgatgaagaaaaggtggatgaacgagccaagctgagcgtcgccgccaagaggttgcttttcagggagatggaaaaatcttttgatgaacaaaatgttccaaagcgacgctcaagaaacacagctgtggagcagaggctacgccgtctgcaggacaggtccctcacccagcccatcaccactgaagaggtggtcatcgcagccacattgcaggcctctgctcaccaaaaggccttagccaaggaccagacaaatgagggcaaagagcttgctgagcaaggagaacctgattcctccactctaagcttggccgaaaagttggccttgtttaacaaattgtcccagccagtctcaaaagcgatttctacccggaacagaatagacacgagacagaggagaatgaacgctcgctatcaaactcagccagtcacactgggagaggtggagcaggtgcagagtggaaagctcattcctttctcacctgccgtgaacacatcagtgtctaccgtagcatccacggttgctccaatgtatgccggagatcttcgcacaaagccacctcttgaccacaatgcaagtgccactgactataagttttcttcttcaatagaaaattcggactctccagttagaagcattctgaaatcgcaagcttggcagcctttggtagagggtagcgagaacaagggaatgttgagagaatatggagagacagaaagcaagagagctttgacaggtcgagacagtgggatggagaagtatgggtcctttgaggaagcagaagcatcctaccccatcctgaaccgagccagggaaggagacagccataaggaatctaaatatgctgttcccagaagaggaagcctggaacgggcgaaccctcccatcacccacctcggggatgaaccgaaggaattttccatggctaaaatgaatgcacaaggaaacttggacttgagggacaggctgccctttgaagagaaggtggaggtggagaatgttatgaaaaggaagttttcactaagagcggcagagttcggggagcccacttccgagcagacggggacagctgctgggaaaactattgctcaaaccacagcccccgtgtcctggaagccccaggattcttcggaacagccacaggagaagctctgcaagaatccatgtgcgatgtttgctgctggagagatcaaaacgccgacaggggagggccttcttgactcacccagcaaaaccatgtctattaaagaaagattggcactgttgaagaaaagcggggaggaagattggagaaacagactcagcaggaggcaggagggcggcaaggcgccggccagcagcctgcacacccaggaagcagggcggtccctcatcaagaagcgggtcacagaaagtcgagagagccaaatgacgattgaggagaggaagcagctcatcactgtgagagaggaggcctggaagacgagaggcagaggagcggccaacgactcgacccagttcactgtggctggcaggatggtgaagaaaggtttggcgtcacctactgccataaccccagtagcctcacccatttgcggtaaaacaagaggcaccacacccgtttccaaacccctggaagatatcgaagccagaccagatatgcagttagaatcggacctgaagttggacaggctggaaacctttctaagaaggctgaataacaaagttggcgggatgcacgaaacggtgctcactgtcaccggcaaatctgtgaaggaggtgatgaagccagatgatgatgaaacctttgccaaattttaccgcagcgtggattataatatgccaagaagtcctgtggagatggatgaggacttcgatgtcattttcgatccttatgcacccaaattgacgtcttccgtggccgagcacaagcgggcagttaggcccaagcgccgggttcaggcctccaaaaaccccctgaaaatgctggcggcaagagaagatctccttcaggaatacactgagcagagattaaacgttgccttcatggagtcaaagcggatgaaagtagaaaagatgtcttccaactccaacttctcagaagtcaccctggcgggtttagccagtaaagaaaacttcagcaacgtcagcctgcggagcgtcaacctgacggaacagaactctaacaacagcgccgtgccctacaagaggctgatgctgttgcagattaaaggaagaagacatgtgcagaccaggctggtggaacctcgagcttcggcgctcaacagtggggactgcttcctcctgctctctccccactgctgcttcctgtgggtaggagagtttgcaaacgtcatagaaaaggcgaaggcctcagaacttgcaactttaattcagacaaagagggaacttggttgtagagctacttatatccaaaccattgaagaaggaattaatacacacactcatgcagccaaagacttctggaagcttctgggtggccaaaccagttaccaatctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtactggtgtttgattttggtagtgaagtttacgtatggcatgggaaagaagtcacattagcacaacgaaaaatagcatttcagctggcaaagcacttatggaatggaacctttgactatgagaactgtgacatcaatcccctggatcctggagaatgcaatccgcttatccccagaaaaggacaggggcggcccgactgggcgatatttgggagacttactgaacacaatgagacgattttgttcaaagagaagtttctggattggacggaactgaagagatcgaatgagaagaaccccggggaacttgcccagcacaaggaagaccccaggactgatgtcaaggcatacgatgtgacacggatggtgtccatgccccagacgacagcaggcaccatcctggacggagtgaacgtcggccgtggctatggcctggtggaaggacacgacaggaggcagtttgagatcaccagcgtttccgtggatgtctggcacatcctggaattcgactatagcaggctccccaaacaaagcatcgggcagttccatgagggggatgcctatgtggtcaagtggaagttcatggtgagcacggcagtgggaagtcgccagaagggagagcactcggtgagggcagccggcaaagagaagtgcgtctacttcttctggcaaggccggcactccaccgtgagtgagaagggcacgtcggcgctgatgacggtggagctggacgaggaaaggggggcccaggtccaggttctccagggaaaggagcccccctgtttcctgcagtgtttccagggggggatggtggtgcactcggggaggcgggaagaggaagaagaaaatgtgcaaagtgagtggcggctgtactgcgtgcgtggagaggtgcccgtggaagggaatttgctggaagtggcctgtcactgtagcagcctgaggtccagaacttccatggtggtgcttaacgtcaacaaggccctcatctacctgtggcacggatgcaaagcccaggcccacacgaaggaggtcggaaggaccgctgcgaacaagatcaaggaacaatgtcccctggaagcaggactgcatagtagcagcaaagtcacaatacacgagtgtgatgaaggctccgagccactcggattctgggatgccttaggaaggagagacaggaaagcctacgattgcatgcttcaagatcctggaagttttaacttcgcgccccgcctgttcatcctcagcagctcctctggggattttgcagccacagagtttgtgtaccctgcccgagccccctctgtggtcagttccatgcccttcctgcaggaagatctgtacagcgcgccccagccagcacttttccttgttgacaatcaccacgaggtgtacctctggcaaggctggtggcccatcgagaacaagatcactggttccgcccgcatccgctgggcctccgaccggaagagtgcgatggagactgtgctccagtactgcaaaggaaaaaatctcaagaaaccagcccccaagtcttaccttatccacgctggtctggagcccctgacattcaccaatatgtttcccagctgggagcacagagaggacatcgctgagatcacagagatggacacggaagtttccaatcagatcaccctcgtggaagacgtcttagccaagctctgtaaaaccatttacccgctggccgacctcctggccaggccactcccggagggggtcgatcctctgaagcttgagatctatctcaccgacgaagacttcgagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatatatatttttggactggtgtttttcacaaagtatttttcaatcagagttttcagaacctgacattgttaaagatactgcttgtcccggagttgtgtattttgtaaatgttcaagggaactgtttggaaacttctttccaccattcaggaggttatcagaattaataaaagtatctgttatgtgcacttaagccgcagctgctatagatagcactgccttcttgttccagctaggcaatgccttttttttttttttttgaagcagttctctttataaagtgttattttgatagtttgtggattctaaaatatatatatatttatataaacaccatataagtcaaatatgtatttaacaaagcaatatgtattcattcactttcaagatttgttttggtgtcaaaataacatgaaaaggtagatggagttgcttctgttgaattagctctgccaccaatatgtatcttcatacacgtttggaaatgtttcctgcagcattaggtatgacttgttctgagtactgcttccggtgctaaaatgaacaaagaatttgtacttaatggcatggactctggagaatctatgcgaatcaacctttctaccttaatatctccccaaaaatgtatagtgccttgtttttatgtacagtttatatacagaaaagtttgctctgcatttttgatgatggtttggaacattatctacaattttactctcaaatagtcaaaataaaaacatctcaatttctaataccggttgtaaacagtacacatgtcattttgtgatataggactcccaaataaaagtatcagaataaacacaacaattaactggttcacattgaa

SEQ ID NO: 21018 - DNA, 7586 bp, Homo sapiens
  ENST00000355867
cactgctctgactgcgtcctccccaggctgaagtgtcctcaggtttcatgtggatttgcccagtaatggatggctccaccgaggccaggttggggaagttcagcctcgaggacactaggggacgaaaaacttcaaaaagaagactctttttattaatattttggcgttctttttggagaggaacttttgggatgtagcctttacctgtttcctgaatttgacatccaaaaagccttttggaaaacaccattctaaatttatcctgttctgaatcatcatcgcttctgatagatgcagttgcttgctgacatcgtgatctttgattttgtacaacgctatttgggctaacttttgggattttactttgtgcttagaatttgaaagtagtattcattggaaagagactccaagaaaatactcgaagacatcaaaagctggattcgagggtataacgtgttttgttttgttttttaaattagaaaaataaggaattgcagtgtgattttctttccccctttaacttagaggaacgaggattatacagaaatttgaaatttcaacaagaaaaacttaagcttccttggattcccacgtcaaaggaaagtttcaagctttcagaaggagttctcactcgaagataaagaacagctcgctaaccacgaaagaggaatcgatgctcagcttttagttgcacttcctaaagttgcagaattaagacaaatctttgaaccaaagaagaaagaattcttagaaatgaaaagaaaagaaagaattgccaggcgcctggaagggattgaaaatgacactcagcccatcctcttgcagagctgcacaggattggtgactcaccgcctgctggaggaagacacccctcgatacatgagagccagcgaccctgccagcccccacatcggccgatcaaatgaagaggaggaaacttctgattcttctctagaaaagcaaactcgatccaaatactgcacagaaacctccggtgtccacggtgactcaccctatggttcgggtaccatggacacccacagtctggagtccaaagccgaaagaattgcaaggtacaaagcagaaagaaggcgacagctggcagagaagtatgggctgactctggatcccgaggccgactccgagtatttatcccgctataccaagtccaggaaggagcctgatgctgtcgagaagcggggaggaaaaagtgacaaacaggaagagtcaagcagagatgctagttctctgtaccccgggaccgagacgatggggctcaggacctgtgccggtgaatccaaggactatgccctccatgtgggtgacggctcttccgacccggaggtgctgctgaacatagaaaaccaaagacgaggtcaagagctgagtgccacccggcaggcccatgacctgtccccagcagccgagagttcctcgaccttctctttctctgggcgagactcctccttcactgaagtgccacggtcccccaagcacgcccacagctcctccctgcagcaggcagcctcccggagcccctcctttggtgacccacagctatcccctgaggcccgacccagtacagggaaacccaaacatgagtggtttctccagaaagattccgaaggggacacaccttcacttatcaactggccttccagagttaaagttagagaaaaattggtgaaagaggaaagtgctcgaaacagccctgaactcgcctcagagtccgtaactcagaggagacaccagccagcgccagtccattacgtgtcatttcagtctgagcactcagcctttgatagggtccccagcaaggcagcaggctctacacgacagccaatccgtggctatgtccaacccgcagataccggtcacaccgccaagctagtgacgccagaaaccccagaaaatgcatctgagtgtagctgggtagcatcagccacccagaatgtccccaaacctcccagcttgacggttctagaaggtgacggaagggatagcccagttctccatgtctgcgagtcaaaagcagaagaagaagaaggggaaggagaaggagaagaaaaagaagaagatgtgtgcttcactgaagctctcgagcaaagcaagaaaaccctactggctttggagggtgatgggctagtgagaagcccagaagatccctctagaaatgaggactttggtaagcctgctgtgagcacagtcaccttagagcatcagaaggaactggaaaacgtggcacaaccccctcaagctccgcaccagcccactgagaggacaggcaggagcgagatggttctctacattcaaagtgagcctgtgtcccaagacgccaaaccaactggtcacaacagggaagcctcgaaaaagcgcaaggtccgtacccgctctctgtcagatttcacaggcccccctcagctccaggccttgaagtataaggacccagcttccaggagagagctggagctgcccagctccaagaccgaagggccttatggggagatcagcatgctggacacaaaagtctctgtcgcccagctccgaagtgcgttcctggcatctgccaacgcctgcaggagacctgaactcaaatcacgggtggagaggtcggctgaaggacctggcttgcccaccggtgtggaacgggagagagggtcccggaaaccaagacgctatttttctcctggtgaaagtagaaaaacttccgagagatttagaacccaacctataacttcagcagaacgaaaggaatcggataggtgcacttcacattcagaaacgccaactgtcgatgatgaagaaaaggtggatgaacgagccaagctgagcgtcgccgccaagaggttgcttttcagggagatggaaaaatcttttgatgaacaaaatgttccaaagcgacgctcaagaaacacagctgtggagcagaggctacgccgtctgcaggacaggtccctcacccagcccatcaccactgaagaggtggtcatcgcagccactgaacctatccccgcttcgtgttctgggggcacccaccctgtaatggcgagacttcctagccccactgtagctaggagcgctgtgcagcctgccagattgcaggcctctgctcaccaaaaggccttagccaaggaccagacaaatgagggcaaagagcttgctgagcaaggagaacctgattcctccactctaagcttggccgaaaagttggccttgtttaacaaattgtcccagccagtctcaaaagcgatttctacccggaacagaatagacacgagacagaggagaatgaacgctcgctatcaaactcagccagtcacactgggagaggtggagcaggtgcagagtggaaagctcattcctttctcacctgccgtgaacacatcagtgtctaccgtagcatccacggttgctccaatgtatgccggagatcttcgcacaaagccacctcttgaccacaatgcaagtgccactgactataagttttcttcttcaatagaaaattcggactctccagttagaagcattctgaaatcgcaagcttggcagcctttggtagagggtagcgagaacaagggaatgttgagagaatatggagagacagaaagcaagagagctttgacaggtcgagacagtgggatggagaagtatgggtcctttgaggaagcagaagcatcctaccccatcctgaaccgagccagggaaggagacagccataaggaatctaaatatgctgttcccagaagaggaagcctggaacgggcgaaccctcccatcacccacctcggggatgaaccgaaggaattttccatggctaaaatgaatgcacaaggaaacttggacttgagggacaggctgccctttgaagagaaggtggaggtggagaatgttatgaaaaggaagttttcactaagagcggcagagttcggggagcccacttccgagcagacggggacagctgctgggaaaactattgctcaaaccacagcccccgtgtcctggaagccccaggattcttcggaacagccacaggagaagctctgcaagaatccatgtgcgatgtttgctgctggagagatcaaaacgccgacaggggagggccttcttgactcacccagcaaaaccatgtctattaaagaaagattggcactgttgaagaaaagcggggaggaagattggagaaacagactcagcaggaggcaggagggcggcaaggcgccggccagcagcctgcacacccaggaagcagggcggtccctcatcaagaagcgggtcacagaaagtcgagagagccaaatgacgattgaggagaggaagcagctcatcactgtgagagaggaggcctggaagacgagaggcagaggagcggccaacgactcgacccagttcactgtggctggcaggatggtgaagaaaggtttggcgtcacctactgccataaccccagtagcctcacccatttgcggtaaaacaagaggcaccacacccgtttccaaacccctggaagatatcgaagccagaccagatatgcagttagaatcggacctgaagttggacaggctggaaacctttctaagaaggctgaataacaaagttggcgggatgcacgaaacggtgctcactgtcaccggcaaatctgtgaaggaggtgatgaagccagatgatgatgaaacctttgccaaattttaccgcagcgtggattataatatgccaagaagtcctgtggagatggatgaggacttcgatgtcattttcgatccttatgcacccaaattgacgtcttccgtggccgagcacaagcgggcagttaggcccaagcgccgggttcaggcctccaaaaaccccctgaaaatgctggcggcaagagaagatctccttcaggaatacactgagcagagattaaacgttgccttcatggagtcaaagcggatgaaagtagaaaagatgtcttccaactccaacttctcagaagtcaccctggcgggtttagccagtaaagaaaacttcagcaacgtcagcctgcggagcgtcaacctgacggaacagaactctaacaacagcgccgtgccctacaagaggctgatgctgttgcagattaaaggaagaagacatgtgcagaccaggctggtggaacctcgagcttcggcgctcaacagtggggactgcttcctcctgctctctccccactgctgcttcctgtgggtaggagagtttgcaaacgtcatagaaaaggcgaaggcctcagaacttgcaactttaattcagacaaagagggaacttggttgtagagctacttatatccaaaccattgaagaaggaattaatacacacactcatgcagccaaagacttctggaagcttctgggtggccaaaccagttaccaatctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtactggtgtttgattttggtagtgaagtttacgtatggcatgggaaagaagtcacattagcacaacgaaaaatagcatttcagctggcaaagcacttatggaatggaacctttgactatgagaactgtgacatcaatcccctggatcctggagaatgcaatccgcttatccccagaaaaggacaggggcggcccgactgggcgatatttgggagacttactgaacacaatgagacgattttgttcaaagagaagtttctggattggacggaactgaagagatcgaatgagaagaaccccggggaacttgcccagcacaaggaagaccccaggactgatgtcaaggcatacgatgtgacacggatggtgtccatgccccagacgacagcaggcaccatcctggacggagtgaacgtcggccgtggctatggcctggtggaaggacacgacaggaggcagtttgagatcaccagcgtttccgtggatgtctggcacatcctggaattcgactatagcaggctccccaaacaaagcatcgggcagttccatgagggggatgcctatgtggtcaagtggaagttcatggtgagcacggcagtgggaagtcgccagaagggagagcactcggtgagggcagccggcaaagagaagtgcgtctacttcttctggcaaggccggcactccaccgtgagtgagaagggcacgtcggcgctgatgacggtggagctggacgaggaaaggggggcccaggtccaggttctccagggaaaggagcccccctgtttcctgcagtgtttccagggggggatggtggtgcactcggggaggcgggaagaggaagaagaaaatgtgcaaagtgagtggcggctgtactgcgtgcgtggagaggtgcccgtggaagggaatttgctggaagtggcctgtcactgtagcagcctgaggtccagaacttccatggtggtgcttaacgtcaacaaggccctcatctacctgtggcacggatgcaaagcccaggcccacacgaaggaggtcggaaggaccgctgcgaacaagatcaaggaacaatgtcccctggaagcaggactgcatagtagcagcaaagtcacaatacacgagtgtgatgaaggctccgagccactcggattctgggatgccttaggaaggagagacaggaaagcctacgattgcatgcttcaagatcctggaagttttaacttcgcgccccgcctgttcatcctcagcagctcctctggggattttgcagccacagagtttgtgtaccctgcccgagccccctctgtggtcagttccatgcccttcctgcaggaagatctgtacagcgcgccccagccagcacttttccttgttgacaatcaccacgaggtgtacctctggcaaggctggtggcccatcgagaacaagatcactggttccgcccgcatccgctgggcctccgaccggaagagtgcgatggagactgtgctccagtactgcaaaggaaaaaatctcaagaaaccagcccccaagtcttaccttatccacgctggtctggagcccctgacattcaccaatatgtttcccagctgggagcacagagaggacatcgctgagatcacagagatggacacggaagtttccaatcagatcaccctcgtggaagacgtcttagccaagctctgtaaaaccatttacccgctggccgacctcctggccaggccactcccggagggggtcgatcctctgaagcttgagatctatctcaccgacgaagacttcgagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatatatatttttggactggtgtttttcacaaagtatttttcaatcagagttttcagaacctgacattgttaaagatactgcttgtcccggagttgtgtattttgtaaatgttcaagggaactgtt

SEQ ID NO: 21019 - DNA, 2889 bp, Homo sapiens
  ENST00000632315
agccacaggagaagctctgcaagaatccatgtgcgatgtttgctgctggagagatcaaaacgccgacaggggagggccttcttgactcacccagcaaaaccatgtctattaaagaaagattggcactgttgaagaaaagcggggaggaagattggagaaacagactcagcaggaggcaggagggcggcaaggcgccggccagcagcctgcacacccaggaagcagggcggtccctcatcaagaaggaagaaggaggagttgcggatgatagtgccatttctaatctgctttggcgggtcacagaaagtcgagagagccaaatgacgattgaggagaggaagcagctcatcactgtgagagaggaggcctggaagacgagaggcagaggagcggccaacgactcgacccagttcactgtggctggcaggatggtgaagaaaggtttggcgtcacctactgccataaccccagtagcctcacccatttgcggtaaaacaagaggcaccacacccgtttccaaacccctggaagatatcgaagccagaccagatatgcagttagaatcggacctgaagttggacaggctggaaacctttctaagaaggctgaataacaaagttggcgggatgcacgaaacggtgctcactgtcaccggcaaatctgtgaaggaggtgatgaagccagatgatgatgaaacctttgccaaattttaccgcagcgtggattataatatgccaagaagtcctgtggagatggatgaggacttcgatgtcattttcgatccttatgcacccaaattgacgtcttccgtggccgagcacaagcgggcagttaggcccaagcgccgggttcaggcctccaaaaaccccctgaaaatgctggcggcaagagaagatctccttcaggaatacactgagcagagattaaacgttgccttcatggagtcaaagcggatgaaagtagaaaagatgtcttccaactccaacttctcagaagtcaccctggcgggtttagccagtaaagaaaacttcagcaacgtcagcctgcggagcgtcaacctgacggaacagaactctaacaacagcgccgtgccctacaagaggctgatgctgttgcagattaaaggaagaagacatgtgcagaccaggctggtggaacctcgagcttcggcgctcaacagtggggactgcttcctcctgctctctccccactgctgcttcctgtgggtaggagagtttgcaaacgtcatagaaaaggcgaaggcctcagaacttgcaactttaattcagacaaagagggaacttggttgtagagctacttatatccaaaccattgaagaaggaattaatacacacactcatgcagccaaagacttctggaagcttctgggtggccaaaccagttaccaatctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtactggtgtttgattttggtagtgaagtttacgtatggcatgggaaagaagtcacattagcacaacgaaaaatagcatttcagctggcaaagcacttatggaatggaacctttgactatgagaactgtgacatcaatcccctggatcctggagaatgcaatccgcttatccccagaaaaggacaggggcggcccgactgggcgatatttgggagacttactgaacacaatgagacgattttgttcaaagagaagtttctggattggacggaactgaagagatcgaatgagaagaaccccggggaacttgcccagcacaaggaagaccccaggactgatgtcaaggcatacgatgtgacacggatggtgtccatgccccagacgacagcaggcaccatcctggacggagtgaacgtcggccgtggctatggcctggtggaaggacacgacaggaggcagtttgagatcaccagcgtttccgtggatgtctggcacatcctggaattcgactatagcaggctccccaaacaaagcatcgggcagttccatgagggggatgcctatgtggtcaagtggaagttcatggtgagcacggcagtgggaagtcgccagaagggagagcactcggtgagggcagccggcaaagagaagtgcgtctacttcttctggcaaggccggcactccaccgtgagtgagaagggcacgtcggcgctgatgacggtggagctggacgaggaaaggggggcccaggtccaggttctccagggaaaggagcccccctgtttcctgcagtgtttccagggggggatggtggtgcactcggggaggcgggaagaggaagaagaaaatgtgcaaagtgagtggcggctgtactgcgtgcgtggagaggtgcccgtggaagggaatttgctggaagtggcctgtcactgtagcagcctgaggtccagaacttccatggtggtgcttaacgtcaacaaggccctcatctacctgtggcacggatgcaaagcccaggcccacacgaaggaggtcggaaggaccgctgcgaacaagatcaaggaacaatgtcccctggaagcaggactgcatagtagcagcaaagtcacaatacacgagtgtgatgaaggctccgagccactcggattctgggatgccttaggaaggagagacaggaaagcctacgattgcatgcttcaagatcctggaagttttaacttcgcgccccgcctgttcatcctcagcagctcctctggggattttgcagccacagagtttgtgtaccctgcccgagccccctctgtggtcagttccatgcccttcctgcaggaagatc

SEQ ID NO: 21020 - DNA, 779 bp, Homo sapiens
  ENST00000460007
gagaagtttctggattggacggaactgaagagatcgaatgagaagaaccccggggaacttgcccagcacaaggaagaccccaggactgatgtcaaggcatacgatgtgacacggatggtgtccatgccccagacgacagcaggcaccatcctggacggagtgaacgtcggccgtggctatggcctggtggaaggacacgacaggaggcagtttgagatcaccagcgtttccgtggatgtctggcacatcctggaattcgactatagcaggctccccaaacaaagcatcgggcagttccatgagggggatgcctatgtggtcaagtggaagttcatgaacaaaagcacccagcatcgagttcatcattgtcttgttcaccattgtagcccagaatcctgaagtccccgctcattgaatatttgttgaatgcatgaacgaatgaagggaatctagagtgagacatattcttacagtgggaagtcgccagaagggagagcactcggtgagggcagccggcaaagagaagtgcgtctacttcttctggcaaggccggcactccaccgtgagtgagaagggcacgtcggcgctgatgacggtggagctggacgaggaaaggggggcccaggtctcaggctgtgcctcccatttctttcctcctcccactttttgtaagatgatcctggagaaaatgttgtatctgcaaataggaaatccacatgacaagtgcagatggccaatgggtggctttgaaaggtttccacctaaccaatcaaggcact

SEQ ID NO: 21021 - DNA, 368 bp, Homo sapiens
  ENST00000482607
gaaattcattcacattttacattgcagctactttgcaatgtaaaatgtgatgctctcctgttcttcttatccccaagctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtactggtgtttgattttggtagtgaagtttacgtatggcatgggaaagaagtcacattagcacaacgaaaaatagcatttcagctggcaaagcacttatggaatggaacctttgactatgagaactgtgacatcaatcccctgg

SEQ ID NO: 21022 - DNA, 622 bp, Homo sapiens
  ENST00000474106
agccttcagagtcagtcctgttcattagctgcggagttaacggcctctgtgctaatgaactcctctgatgtctcttctcttaagcatccttctagtttggcgtcacctactgccataaccccagtagcctcacccatttgcggtaaaacaagaggcaccacacccgtttccaaacccctggaagatatcgaagccagaccagatatgcagttagaatcggacctgaagttggacaggctggaaacctttctaagaaggctgaataacaaagttggcgggatgcacgaaacggtgctcactgtcaccggcaaatctgtgaaggaggtgatgaagccagatgatgatgaaacctttgccaaattttaccgcagcgtggattataatatgccaagaagtcctgtggagatggatgaggacttcgatgtcattttcgatccttatgcacccaaattgacgtcttccgtggccgagcacaagcgggcagttaggcccaagcgccgggttcaggcctccaaaaaccccctgaaaatgctggcggcaagagaagatctccttcaggaatacactgagcagagattaaacgttgccttcatggagtcaaagcggatgaaagtagaaaaga

SEQ ID NO: 21023 - DNA, 454 bp, Homo sapiens
  ENST00000491872
cctgaggttcacatcaccctattgtgtgagcacgtgcatgctgctgtttgaacccaggcatgaaatacttgaaggtgattgcgatgccctgaccaggctcttctcttccaatactctgccatgttccctgtttgttttaacctgtaggaagaaggaggagttgcggatgatagtgccatttctaatctgctttggcgggtcacagaaagtcgagagagccaaatgacgattgaggagaggaagcagctcatcactgtgagagaggaggcctggaagacgagaggcagaggagcggccaacgactcgacccagttcactgtggctggcaggatggtgaagaaaggtttggcgtcacctactgccataaccccagtagcctcacccatttgcggtaaaacaagaggcaccacacccgtttccaaacccctggaagatatcgaagccagaccagata

SEQ ID NO: 21024 - DNA, 645 bp, Homo sapiens
  ENST00000464984
cacagcccccgtgtcctggaagccccaggattcttcggaacagccacaggagaagctctgcaagaatccatgtgcgatgtttgctgctggagagatcaaaacgccgacaggggagggccttcttgactcacccagcaaaaccatgtctattaaagaaagattggcactgttgaagaaaagcggggaggaagattggagaaacagactcagcaggaggcaggagggcggcaaggcgccggccagcagcctgcacacccaggaagcagggcggtccctcatcaagaaggaagaaggaggagttgcggatgatagtgccatttctaatctgctttgggtaagcctgactctaacacaggtgtcctctcgatggtggccagaattacacttcgcgtgggtaatcctgatcctgggtggttccttcgtgcaccctccctggtgcttttcttatctccagaccagacacagcctttgtccggagtggagagctgagcccgtgcccttaaactattttttaatcatgtaatgaagatactttaaagaagatgatattttctgttaaatgttaaaactgtcaatgaaagtcatggttcctctctctgtaactgacaatcttctataaattaactcatttaattactgcacaaa

SEQ ID NO: 21025 - DNA, 262 bp, Homo sapiens
  ENST00000483758
gcacttgggctgtggtttcctggagatgggagatcgggagctttggtgtacttcttgaaggtttcagaaaaaggccaagacttcttcagaactatttcaacaagaaaaacttaagcttccttggattcccacgtcaaaggaaagtttcaagctttcagaaggagttctcactcgaagataaagaacagctcgctaaccacgaaagaggaatcgatgctcagcttttagttgcacttcctaaagttgcagaattaagacaaat

SEQ ID NO: 21026 - DNA, 287 bp, Homo sapiens
  ENST00000464726
attggagattggttgctttctaaaactgaaggagaagcccatgaagagatggtggattctcactgagttttgactagcggaagaaaagagagagttcaagtggatggccttgaggacttgaaaagctgagatatgatgattttgaagtcatttcacatcgaagccatgatttaaatatcggcgttaaggtaagtattgaggaaagaaatatgacacttttgtggttaacacattattggctttgcttgcactgttagaagagattaaagcacattgtgaagggtgat

SEQ ID NO: 21027 - DNA, 190 bp, Homo sapiens
  ENST00000490031
tctaaaactgaaggagaagcccatgaagagatggtggattctcactgagttttgactagcggaagaaaagaggaaatagatgaaaagtgaagtcggtgcctgcagtctctggggtctctgcgcctggtgttccaaggaggattttgatctggtccctcatcagactctgttgttgctcttagggttggat

SEQ ID NO: 21028 - DNA, 196 bp, Homo sapiens
  ENST00000465422
caccaccaaggccccgcgctagtgtgcacccccggcccgggcccggcaggtgggcgaggagggcgggcgcagtcgggctctgcaggagcgcgcggagattctggctacattggagattggttgctttctaaaactgaaggagaagcccatgaagagatggtggattctcactgagttttgactagcggaagaaaag

SEQ ID NO: 21029 - DNA, 8201 bp, Homo sapiens
  ENST00000375398
cactgctctgactgcgtcctccccaggctgaagtgtcctcaggtttcatgtggatttgcccagtaatggatggctccaccgaggccaggttggggaagttcagcctcgaggacactaggggacgaaaaacttcaaaaagaagactctttttattaatattttggcgttctttttggagaggaacttttgggatgtagcctttacctgtttcctgaatttgacatccaaaaagccttttggaaaacaccattctaaatttatcctgttctgaatcatcatcgcttctgatagatgcagttgcttgctgacatcgtgatctttgattttgtacaacgctatttgggctaacttttgggattttactttgtgcttagaatttgaaagtagtattcattggaaagagactccaagaaaatactcgaagacatcaaaagctggattcgagggtataacgtgttttgttttgttttttaaattagaaaaataaggaattgcagtgtgattttctttccccctttaacttagaggaacgaggattatacagaaatttgaaatttcaacaagaaaaacttaagcttccttggattcccacgtcaaaggaaagtttcaagctttcagaaggagttctcactcgaagataaagaacagctcgctaaccacgaaagaggaatcgatgctcagcttttagttgcacttcctaaagttgcagaattaagacaaatctttgaaccaaagaagaaagaattcttagaaatgaaaagaaaagaaagaattgccaggcgcctggaagggattgaaaatgacactcagcccatcctcttgcagagctgcacaggattggtgactcaccgcctgctggaggaagacacccctcgatacatgagagccagcgaccctgccagcccccacatcggccgatcaaatgaagaggaggaaacttctgattcttctctagaaaagcaaactcgatccaaatactgcacagaaacctccggtgtccacggtgactcaccctatggttcgggtaccatggacacccacagtctggagtccaaagccgaaagaattgcaaggtacaaagcagaaagaaggcgacagctggcagagaagtatgggctgactctggatcccgaggccgactccgagtatttatcccgctataccaagtccaggaaggagcctgatgctgtcgagaagcggggaggaaaaagtgacaaacaggaagagtcaagcagagatgctagttctctgtaccccgggaccgagacgatggggctcaggacctgtgccggtgaatccaaggactatgccctccatgtgggtgacggctcttccgacccggaggtgctgctgaacatagaaaaccaaagacgaggtcaagagctgagtgccacccggcaggcccatgacctgtccccagcagccgagagttcctcgaccttctctttctctgggcgagactcctccttcactgaagtgccacggtcccccaagcacgcccacagctcctccctgcagcaggcagcctcccggagcccctcctttggtgacccacagctatcccctgaggcccgacccagtacagggaaacccaaacatgagtggtttctccagaaagattccgaaggggacacaccttcacttatcaactggccttccagagttaaagttagagaaaaattggtgaaagaggaaagtgctcgaaacagccctgaactcgcctcagagtccgtaactcagaggagacaccagccagcgccagtccattacgtgtcatttcagtctgagcactcagcctttgatagggtccccagcaaggcagcaggctctacacgacagccaatccgtggctatgtccaacccgcagataccggtcacaccgccaagctagtgacgccagaaaccccagaaaatgcatctgagtgtagctgggtagcatcagccacccagaatgtccccaaacctcccagcttgacggttctagaaggtgacggaagggatagcccagttctccatgtctgcgagtcaaaagcagaagaagaagaaggggaaggagaaggagaagaaaaagaagaagatgtgtgcttcactgaagctctcgagcaaagcaagaaaaccctactggctttggagggtgatgggctagtgagaagcccagaagatccctctagaaatgaggactttggtaagcctgctgtgagcacagtcaccttagagcatcagaaggaactggaaaacgtggcacaaccccctcaagctccgcaccagcccactgagaggacaggcaggagcgagatggttctctacattcaaagtgagcctgtgtcccaagacgccaaaccaactggtcacaacagggaagcctcgaaaaagcgcaaggtccgtacccgctctctgtcagatttcacaggcccccctcagctccaggccttgaagtataaggacccagcttccaggagagagctggagctgcccagctccaagaccgaagggccttatggggagatcagcatgctggacacaaaagtctctgtcgcccagctccgaagtgcgttcctggcatctgccaacgcctgcaggagacctgaactcaaatcacgggtggagaggtcggctgaaggacctggcttgcccaccggtgtggaacgggagagagggtcccggaaaccaagacgctatttttctcctggtgaaagtagaaaaacttccgagagatttagaacccaacctataacttcagcagaacgaaaggaatcggataggtgcacttcacattcagaaacgccaactgtcgatgatgaagaaaaggtggatgaacgagccaagctgagcgtcgccgccaagaggttgcttttcagggagatggaaaaatcttttgatgaacaaaatgttccaaagcgacgctcaagaaacacagctgtggagcagaggctacgccgtctgcaggacaggtccctcacccagcccatcaccactgaagaggtggtcatcgcagccacattgcaggcctctgctcaccaaaaggccttagccaaggaccagacaaatgagggcaaagagcttgctgagcaaggagaacctgattcctccactctaagcttggccgaaaagttggccttgtttaacaaattgtcccagccagtctcaaaagcgatttctacccggaacagaatagacacgagacagaggagaatgaacgctcgctatcaaactcagccagtcacactgggagaggtggagcaggtgcagagtggaaagctcattcctttctcacctgccgtgaacacatcagtgtctaccgtagcatccacggttgctccaatgtatgccggagatcttcgcacaaagccacctcttgaccacaatgcaagtgccactgactataagttttcttcttcaatagaaaattcggactctccagttagaagcattctgaaatcgcaagcttggcagcctttggtagagggtagcgagaacaagggaatgttgagagaatatggagagacagaaagcaagagagctttgacaggtcgagacagtgggatggagaagtatgggtcctttgaggaagcagaagcatcctaccccatcctgaaccgagccagggaaggagacagccataaggaatctaaatatgctgttcccagaagaggaagcctggaacgggcgaaccctcccatcacccacctcggggatgaaccgaaggaattttccatggctaaaatgaatgcacaaggaaacttggacttgagggacaggctgccctttgaagagaaggtggaggtggagaatgttatgaaaaggaagttttcactaagagcggcagagttcggggagcccacttccgagcagacggggacagctgctgggaaaactattgctcaaaccacagcccccgtgtcctggaagccccaggattcttcggaacagccacaggagaagctctgcaagaatccatgtgcgatgtttgctgctggagagatcaaaacgccgacaggggagggccttcttgactcacccagcaaaaccatgtctattaaagaaagattggcactgttgaagaaaagcggggaggaagattggagaaacagactcagcaggaggcaggagggcggcaaggcgccggccagcagcctgcacacccaggaagcagggcggtccctcatcaagaagcgggtcacagaaagtcgagagagccaaatgacgattgaggagaggaagcagctcatcactgtgagagaggaggcctggaagacgagaggcagaggagcggccaacgactcgacccagttcactgtggctggcaggatggtgaagaaaggtttggcgtcacctactgccataaccccagtagcctcacccatttgcggtaaaacaagaggcaccacacccgtttccaaacccctggaagatatcgaagccagaccagatatgcagttagaatcggacctgaagttggacaggctggaaacctttctaagaaggctgaataacaaagttggcgggatgcacgaaacggtgctcactgtcaccggcaaatctgtgaaggaggtgatgaagccagatgatgatgaaacctttgccaaattttaccgcagcgtggattataatatgccaagaagtcctgtggagatggatgaggacttcgatgtcattttcgatccttatgcacccaaattgacgtcttccgtggccgagcacaagcgggcagttaggcccaagcgccgggttcaggcctccaaaaaccccctgaaaatgctggcggcaagagaagatctccttcaggaatacactgagcagagattaaacgttgccttcatggagtcaaagcggatgaaagtagaaaagatgtcttccaactccaacttctcagaagtcaccctggcgggtttagccagtaaagaaaacttcagcaacgtcagcctgcggagcgtcaacctgacggaacagaactctaacaacagcgccgtgccctacaagaggctgatgctgttgcagattaaaggaagaagacatgtgcagaccaggctggtggaacctcgagcttcggcgctcaacagtggggactgcttcctcctgctctctccccactgctgcttcctgtgggtaggagagtttgcaaacgtcatagaaaaggcgaaggcctcagaacttgcaactttaattcagacaaagagggaacttggttgtagagctacttatatccaaaccattgaagaaggaattaatacacacactcatgcagccaaagacttctggaagcttctgggtggccaaaccagttaccaatctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtactggtgtttgattttggtagtgaagtttacgtatggcatgggaaagaagtcacattagcacaacgaaaaatagcatttcagctggcaaagcacttatggaatggaacctttgactatgagaactgtgacatcaatcccctggatcctggagaatgcaatccgcttatccccagaaaaggacaggggcggcccgactgggcgatatttgggagacttactgaacacaatgagacgattttgttcaaagagaagtttctggattggacggaactgaagagatcgaatgagaagaaccccggggaacttgcccagcacaaggaagaccccaggactgatgtcaaggcatacgatgtgacacggatggtgtccatgccccagacgacagcaggcaccatcctggacggagtgaacgtcggccgtggctatggcctggtggaaggacacgacaggaggcagtttgagatcaccagcgtttccgtggatgtctggcacatcctggaattcgactatagcaggctccccaaacaaagcatcgggcagttccatgagggggatgcctatgtggtcaagtggaagttcatggtgagcacggcagtgggaagtcgccagaagggagagcactcggtgagggcagccggcaaagagaagtgcgtctacttcttctggcaaggccggcactccaccgtgagtgagaagggcacgtcggcgctgatgacggtggagctggacgaggaaaggggggcccaggtccaggttctccagggaaaggagcccccctgtttcctgcagtgtttccagggggggatggtggtgcactcggggaggcgggaagaggaagaagaaaatgtgcaaagtgagtggcggctgtactgcgtgcgtggagaggtgcccgtggaagggaatttgctggaagtggcctgtcactgtagcagcctgaggtccagaacttccatggtggtgcttaacgtcaacaaggccctcatctacctgtggcacggatgcaaagcccaggcccacacgaaggaggtcggaaggaccgctgcgaacaagatcaaggaacaatgtcccctggaagcaggactgcatagtagcagcaaagtcacaatacacgagtgtgatgaaggctccgagccactcggattctgggatgccttaggaaggagagacaggaaagcctacgattgcatgcttcaagatcctggaagttttaacttcgcgccccgcctgttcatcctcagcagctcctctggggattttgcagccacagagtttgtgtaccctgcccgagccccctctgtggtcagttccatgcccttcctgcaggaagatctgtacagcgcgccccagccagcacttttccttgttgacaatcaccacgaggtgtacctctggcaaggctggtggcccatcgagaacaagatcactggttccgcccgcatccgctgggcctccgaccggaagagtgcgatggagactgtgctccagtactgcaaaggaaaaaatctcaagaaaccagcccccaagtcttaccttatccacgctggtctggagcccctgacattcaccaatatgtttcccagctgggagcacagagaggacatcgctgagatcacagagatggacacggaagtttccaatcagatcaccctcgtggaagacgtcttagccaagctctgtaaaaccatttacccgctggccgacctcctggccaggccactcccggagggggtcgatcctctgaagcttgagatctatctcaccgacgaagacttcgagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatatatatttttggactggtgtttttcacaaagtatttttcaatcagagttttcagaacctgacattgttaaagatactgcttgtcccggagttgtgtattttgtaaatgttcaagggaactgtttggaaacttctttccaccattcaggaggttatcagaattaataaaagtatctgttatgtgcacttaagccgcagctgctatagatagcactgccttcttgttccagctaggcaatgccttttttttttttttttgaagcagttctctttataaagtgttattttgatagtttgtggattctaaaatatatatatatttatataaacaccatataagtcaaatatgtatttaacaaagcaatatgtattcattcactttcaagatttgttttggtgtcaaaataacatgaaaaggtagatggagttgcttctgttgaattagctctgccaccaatatgtatcttcatacacgtttggaaatgtttcctgcagcattaggtatgacttgttctgagtactgcttccggtgctaaaatgaacaaagaatttgtacttaatggcatggactctggagaatctatgcgaatcaacctttctaccttaatatctccccaaaaatgtatagtgccttgtttttatgtacagtttatatacagaaaagtttgctctgcatttttgatgatggtttggaacattatctacaattttactctcaaatagtcaaaataaaaacatctcaatttctaataccggttgtaaacagtacacatgtcattttgtgatataggactcccaaataaaagtatcagaataaacacaacaattaactggt

SEQ ID NO: 21030 - DNA, 6813 bp, Homo sapiens
  ENST00000610966
aaagggtgctcactggtacccggacaaccatttcacagactggtgtgccctataggcatcccagtgatacaccatcagccagagagcctgtgaactcttccaagcagaagggctctccctgccccctctccccgcgcagctcgctctgccctccgcctcctcttctccgcccactctcgccgcggtctcctggcggcggaggctttgtctcgtgggctggtccccagcggctccctccccgaacagctgctgctccagggaggaagcggcgcgggtgctgtccagcttcccggtgctgaaaaccggagggctcgtcatccaccactaccatgtaagggccatgagaagggctcatcctggcgcagcgcggacatggaggaggacttattccagctaaggcagctgccggttgtgaaattccgtcgcacaggcgagagtgcaaggtcagaggacgacacggcttcaggagagcatgaagtccagattgaaggggtccacgtgggcctagaggctgtggagctggatgatggggcagctgtgcccaaggagtttgccaatcccactgatgatactttcatggtggaagatgcagtggaagccattggctttggaaaatttcagtggaagctgtctgttctcactggcttggcttggatggctgatgccatggagatgatgatcctcagcatcctggcaccacagctgcattgcgagtggaggctcccaagctggcaggtggcattgctgacctcggtggtctttgtaggcatgatgtccagctccacgctctggggaaatatctcagaccagtacggcaggaaaacagggctgaagatcagcgtgctgtggactctgtactatggcatccttagtgcatttgcgcccgtgtatagctggatcctggtgctccggggcctggtgggcttcgggatcggaggagttccccagtcggtgacgctgtatgccgagttccttcccatgaaagccagagctaaatgtattttgctgattgaggtattctgggccatcgggacagtgttcgaggtcgtcctggctgtgttcgtgatgcccagcctgggctggcgttggctgctcatcctctcagctgtcccgctcctcctctttgccgtgctgtgtttctggctgcctgaaagtgcaaggtatgatgtgctgtcagggaaccaggaaaaggcaatcgccaccttaaagaggatagcaactgaaaacggagctcccatgccgctggggaaactcatcatctccagacaggaagaccgaggcaaaatgagggaccttttcacaccccattttagatggacaactttgctgctgtggtttatatggttttccaatgcattctcttactacgggttagttctactcaccacagaactcttccaggcaggagatgtctgcggcatctccagtcggaagaaggctgtagaggcaaaatgcagcctggcctgcgagtacctgagtgaggaggattacatggacttgctgtggaccaccctctctgagtttccaggtgtccttgtgactctgtggattattgaccgcctggggcgcaagaagaccatggccctgtgctttgtcatcttctccttctgcagcctcctgctgtttatctgtgttggaagaaatgtgctcactctgttactcttcattgcaagagcgtttatttctggaggctttcaagcggcatatgtttacacacctgaggtctaccccacggcaacgcgggccctcggcctgggcacctgcagcggcatggcaagagtgggtgctctcatcactccgttcatcgcccaggtgatgctggaatcctctgtgtacctgactctggcagtttacagtggctgctgcctcctggctgccctggcctcctgctttttgcccattgagaccaaaggccgaggactgcaggagtccagccaccgggagtggggccaggagatggtcggccgaggaatgcacggtgcaggtgttaccaggtcgaactctggctctcaggaatagtgaccgatgggggactgagctggtctttgaggctgcagagcttggggggctggcaggccccaactggggcactgattgtcactgccgacatcaagaactcacccaagagtatgacctggaccaacagggttttgtgtcttgactcagtttgctcatcttcattgaggtccacccagggatggggagatgtttgctctagggggttctctgtatatgtggtgaaagctttgttcataacctgtggatctacatgggaagactacccatattaggagggtctggtaatgccagcaaccaatcagacaccacccagagtcacccggccaaaccctcagtgaacaaccaaaatatctctctgtagataccgtccaggctcaggcccatgtgacacctgctgtccacccaccggacctgttcagtaggtttctcccacactcacagccccaggctttcttctttgaaattgcaggcgatctaggtgtggtctgagcagctatttcctggcaggggccccccggtttgcctccctagagcctgaccagtggattctctggcagatggacatggtgcattcaaactggagccacatgcccccacccagccccctctggagttgccgttgttggcaccaagagatccagatgtgtccctggggacagctggtcttgcaccaggtgacaacctcagaacgccgttaccccctgggaactgaggactgaggccaaagtgaatcaagctgaagtcagagcacgggcctccccttctgaagcagcgaaggccacggttccgacttctttcctggccccctccttggtcaggctgaatggtgacttttattgttttttgagacggagtcttgatctgtcgcccaggctggagtgcagtagcgtgatctcggctcactgcaactctgcctcccgggttcaagcaattctcctgtctcagcctcccgagtagctgggattacaggtgcccacctgtactttttagtagagacagggtttcaccatgttggccaggctggtctcgaactcctgacctcaagtgatccacccgcctcggcctcccacagtgctgagattacaggtgggagccactgcacccggcctgaatgatgactcttgaggggaaaaagtttactcaggtttgcaggtacaaaatccaaaatccagggctttgggttttgtgcatgggtagacagctgaatgggcagagaaaccagaaggatgctacacccaccatctcatcccatggggatcaggggaccaggattccctgatgcgaagctgctcctctgtccagggacgtcttgatcattacacaaaggcagcccctggagttccattcatggagcctgccgtggagtggagaggggtgggaggactcaggtgtgtgaaatgtatatgttttcaaaggaagcagtgggaggccagttggttttgagttggtctccgcaggcaacatcacttctgggatttggtttactggagccttttttcccatggtgaaggcaggggacatagacaaggagggaggaagctggcagatcccatcaaaggccagagcagacagacctactgcttgaagtaaacattgcaaggaagccaatttgtgcgttcaactcttattaaaacatgtcagtgatggacattgcaagagcctaagtttattcattgtcatcatgtcctagtgacagtccagcctaacggtctgactacctttgttcatcggaattcatctcaatgctttagtgtgataatctcctttccaatgagtggggaaagacataccgttggcagccaacattgtggctgagcttgttggagacaacactttcttctaatggtgtgcaggtcatgatgggggacttcttccagctcaagttctaaatcaactgcaaacaatactgtgtctctaaaatgtgggctgcagccccctccgcccaggcagttgaagaggagatggcttggcagatctctgtctctctctgacaaccacatttccttgaaccacgtgtggctgtagctctaattatttctggacagctgagctctcctgggtaacacagaacttttgcttgtctcttttgccttccggctggtcagacgctactggatgatcatgtccgctccctcaccctagaataacccagtggagctgggggctgggggggatagagtgcttggtgggcaggaatatttcccagagactagggtaaaggggtttacagttgagggccttctctacttgagaaagtgaaagttaaaaactcctgctgggtatggtggctcatgcctataatcccagcacttttggaggccgaggcgggcggatcacaaggtcaggagatcgagaccatcctggctaacatggtgaaaccccgtctctactaaaaatacaaaaaaaaattagccaggtgtggtggcgggtgcctgtagtcccagctactcaggaggctgaggccggagaatggcgtgaacccaggaggcagagcttgcagtgagccgagatcgcgccactgcactccagcctgggcgacagagcaagactccatctcaaaaacaaaacaaaacaaaacaaaaactctttgccttgtaaatagcctgcctttttcaaaaaaatcaatattatcaaatgatacaagagctatcacaaaaggcacccaaacttctgaatatgtgagacctttagctgagaacatttgtatctaattttgaacaatcctattcaaaaagctcctattttcgttaatggaaatgccatgtttctcttagagttacgaaagatctcagaaagtggcaaaagatatttaatgtagccagagctatatatttctgtttttctcgtacttcaagtattctgaaaaacatataactgaccttggtggtgttcacaatgggatgaaacagtatcttaggaattgactttgaaattagtatggaaattcattgtttttaatataacattgagcaacagaaagccttgaatgataagatcaagagtctcccctgccattattttcaatggcaaaaactgcaattactttttttttttttttgagatgaagtctcagctcactgcaactctgtctcccaggttcaagcgattctccctcctcagcctcctgagtagctgggattacaggtgcccgccttgatgcttggctaatttttgtatttttagtatagacaaggtttcaccatgttggtcaggctggtctcaaactcctgacctcaagtgatccgcccaccttggcctcccaaatgcaattacttttgcaccaacctaagaacagtaatctcagtcaatagtggcttaaaccattagaaccaaaaccaggcagagatcagagaaggttcaacgctcaacaatgttatcaagaacccagcttctttttgccttttcttttcaccatcctctgcatgttggccatctgaccctgtgcttgaaacctcatggtcacaaaatggctgcccctgtgctggacatcatatttcttttcaaagaaggtagaatgggaaaggagcagtcataaaaggttttctttcagaagagtctgttggttttggttagaaaaggaagtcccctggcagatttaccattgcttctcattgatcagacctgggtgtcatgcccatcccagcatgagtcctgctgtagggctggaaggaagggcctacgagcaccaagggatacccacagcctcctgaacacaaaattgggattctgttagcacagaagaaggatagcaatggctgttggatgggcgatggttgcaaggagcctgccgtggatgtgtaggccacagagctctcatcagcactgttttcgtggccaggaacagaaattctactcaggataattaaaattaaggaacagagctttattataagactgggatcggtagttaatttcctacaggggaaattcagggcatgtaaatcagtgaaatggaaaaggtgtaaggacaagagaaacaccagccctgtctgcaggggggggctgcaactcccttccagctgatgttgttccaccatgggtccagtgtgaccagatcttacaatgttcaaaagaggagtctaggtttttctgtgaaatctccaaatattagtatattggatcaaaaatgttcaaatgatgtgtgagctcaataaaatgcatctgcagtgcagctttggttgatgggctgatggttcactctgacagtttagagagattgcataggaataaagtacagcctggtgtcattcagaggaacagggatctgggaaaccactggggcccaagacagctgcccctctgaatctgtggctcttgtttcttcccttttctggcagaaatgagtctagcttccatctgtttccttgtggctgctgtgtatgcataatcatgcacagagcttccatagcctcataacccagctctgcaaacatacctgactcagctgctcagtgccccactcccagatcttcaggaatgaagctgattggcccagtttagtgttggattgagtcttggtccaattcaattgggtcaggaagaagtggtggagaggtacagacacggtggcattggcctgccctttagcagggtggtgcagacaattgctggtatgcctggaatctgcagtgacatgtgcataaactctcaagtctattcatcagaactctcttacagatcataacgtggcaagtggtcagtatgcatggaatatccagcatgtcctggacatgttattcaacactgaggatgcaaaatatcataagacatggtcctggctgggtgcagtggctc

SEQ ID NO: 21031 - DNA, 439 bp, Homo sapiens
  ENST00000551211
agaggatagcaactgaaaacggagctcccatgccgctggggaaactcatcatctccagacaggaagaccgaggcaaaatgagggaccttttcacaccccattttagatggacaactttgctgctgtggtttatatggtaagagctgtttgttgaccactttgacccctttccactccctgtgccctgttttgggttttgttttaatgcaatggacagatagcactttgatttcaggcagcgtttgcaaatttcagtagttcgaacatcatcctcctgatttccgtcatatccaggttatcatctgtacgtactatcatttccttcatctttttctttaacttgactgcttttaatcaccgtgcaggctggagtgcagtggcgctctcctagcttactgcagccttgaactcctgaactcaagcaatcctccctcctcag

SEQ ID NO: 21032 - DNA, 695 bp, Homo sapiens
  ENST00000550436
tggtccccagcggctccctccccgaacagctgctgctccagggaggaagcggcgcgggtgctgtccagcttcccggtgctgaaaaccggagggctcgtcatccaccactaccatgtaagggccatgagaagggctcatcctggcgcagcgcggacatggaggaggacttattccagctaaggcagctgccggttgtgaaattccgtcgcacaggcgagagtgcaaggtcagaggacgacacggcttcaggagagcatgaagtccagattgaaggggtccacgtgggcctagaggctgtggagctggatgatggggcagctgtgcccaaggagtttgccaatcccactgatggtggtctttgtaggcatgatgtccagctccacgctctggggaaatatctcagaccagtacggcaggaaaacagggctgaagatcagcgtgctgtggactctgtactatggcatccttagtgcatttgcgcccgtgtatagctggatcctggtgctccggggcctggtgggcttcgggatcggaggagttccccagtcggtgacgctgtatgccgagttccttcccatgaaagccagagctaaatgtattttgctgattgaggtattctgggccatcgggacagtgttcgaggtcgtcctggctgtgttcgtgatgcccagcctgggctggcgttggctgctcat

SEQ ID NO: 21033 - DNA, 639 bp, Homo sapiens
  ENST00000546618
ggctttgtctcgtgggctggtccccagcggctccctccccgaacagctgctgctccagggaggaagcggcgcgggtgctgtccagcttcccggtgctgaaaaccggagggctcgtcatccaccactaccatgtaagggccatgagaagggctcatcctggcgcagcgcggacatggaggaggacttattccagctaaggcagctgccggttgtgaaattccgtcgcacaggcgagagtgcaaggtcagaggacgacacggcttcaggagagcatgaagtccagattgaaggggtccacgtgggcctagaggctgtggagctggatgatggggcagctgtgcccaaggagtttgccaatcccactgatgatactttcatggtggaagatgcagtggaagccattggctttggaaaatttcagtggaagctgtctgttctcactggcttggcttgggtggtctttgtaggcatgatgtccagctccacgctctggggaaatatctcagaccagtacggcaggaaaacagggctgaagatcagcgtgctgtggactctgtactatggcatccttagtgcatttgcgcccgtgtatagctggatcctggtgctccggggcctggtgggcttcgggatcggagg

SEQ ID NO: 21034 - DNA, 597 bp, Homo sapiens
  ENST00000548229
gtgggctggtccccagcggctccctccccgaacagctgctgctccagggaggaagcggcgcgggtgctgtccagcttcccggtgctgaaaaccggagggctcgtcatccaccactaccatgtaagggccatgagaagggctcatcctggcgcagcgcggacatggaggaggacttattccagctaaggcagctgccggttgtgaaattccgtcgcacaggcgagagtgcaaggtcagaggacgacacggcttcaggagagcatgaagtccagattgaaggggtccacgtgggcctagaggctgtggagctggatgatggggcagctgtgcccaaggagtttgccaatcccactgatgatactttcatggtggaagatgcagtggaagccattggctttggaaaatttcagtggaagctgtctgttctcactggcttggcttgggcaagtatttctggggggcagtggctcagcctccaagaaacccccatgctgctcaactgggtttccatggcctacaaggaaggacacagttctttgcacatggagcctttgcttgaatttcaatcaacaaaatttatgtggcgtaataagtggt

SEQ ID NO: 21035 - DNA, 3538 bp, Homo sapiens
  ENST00000447399
aggtgactgcgcggcgggctgtggctgcggaggttgaggggcgtccgaggcgcggaggggctggctgggcaggaggggttggcggggcagcagggccgcggccatggggagcttgaaggaggagctgctcaaagccatctggcacgccttcaccgcactcgaccaggaccacagcggcaaggtctccaagtcccagctcaaggtcctttcccataacctgtgcacggtgctgaaggttcctcatgacccagttgcccttgaagagcacttcagggatgatgatgagggtccagtgtccaaccagggctacatgccttatttaaacaggttcattttggaaaagattgaatacctgcttaagaagcttacagaagctatgggaggaggttggcagcaagaacaatttgaacattataaaatcaactttgatgacagtaaaaatggcctttctgcatgggaacttattgagcttattggaaatggacagtttagcaaaggcatggaccggcagactgtgtctatggcaattaatgaagtctttaatgaacttatattagatgtgttaaagcagggttacatgatgaaaaagggccacagacggaaaaactggactgaaagatggtttgtactaaaacccaacataatttcttactatgtgagtgaggatctgaaggataagaaaggagacattctcttggatgaaaattgctgtgtagagtccttgcctgacaaagatggaaagaaatgcctttttctcgtaaaatgttttgataagacttttgaaatcagtgcttcagataagaagaagaaacaggagtggattcaagccattcattctactattcatctgttgaagctgggcagccctccaccacacaaagaagcccgccagcgtcggaaagaactccggaagaagcagctggctgaacaagaggaactggagcgacaaatgaaggaactccaggccgccaacgaaagcaagcagcaggagctggaggccgtgcggaagaaactggaggaagcagcatctcgtgcagcagaagaggaaaagaaacgccttcagactcaagtggaacttcaggccaggttcagcacagagctggaaagagagaagcttatcagacagcagatggaagaacaggttgctcaaaagtcctctgaactggaacagtatttacagcgagtacgggagctggaagacatgtacctaaagctgcaggaggctcttgaagatgagagacaggcccggcaagatgaagagacagtgcggaagcttcaggccaggttgttggaggaagagtcttccaagagggctgaactagaaaagtggcacttggagcagcagcaggccattcagacaaccgaggcggagaagcaggagttggagaatcagcgtgtcctgaaggaacaggccctgcaggaggccatggagcagctggagcagcttgagttagaacggaagcaagcacttgagcagtacgaggaagttaaaaagaagctggagatggcaactaataagaccaagagctggaaggacaaagtggcccatcatgaaggattaattcgactgatagaaccaggttcaaagaaccctcacctgatcactaactggggacctgcagctttcactgaggcagaacttgaagagagagagaagaactggaaagagaaaaagaccacggagtgactgagcttgctggcagtcacgtcagttatgtagatactgcatggcaggagagctttacgctaaagacaaaagaaacagctttgggggccgggcgtggtggctcacgcctgtaatcccagcactttgggaggccgaggcgggtggatcacctgaggtcaggagttcaagagcagcctggccaacctggtgaaaccctgtctctactaaaaatacaaaaaaaattagctgagcgtggtggcgggcgcctgtaatcccagctacttgggaggctgaggcaggagaatcacttgaacgtgggaggcggaggttgcagcgagctgagatcatgccgttgtactccagcttgggcaacagagtgagactccatctcaaaacaaaacaaaacaaaacaaaacaaaaaaacccggctttgctgcttttaactcttcttccttctgtgcctctctaagtgggtcagtatcctaaggaagccttcttatttatcttcctgcaaacaagggttacctgaaaagaaaaaaaaagtcaacattgtcaagctgtttgtttactctttctttgaaaacatcaccttctgaaatttgtcttttagctctctcagattcttccccaaatgaggcagggtgcagacagcacagtcagctctgcagagtttggaggggctcactgccactgggtactcagaacctctgtggactggatgtcagctctttcctttggcagcgtgtttccttttccgagtatgtgctgttaaactagattggccggttcgctttccatttcctgacacttgacatggaatgcctttgaccattggtgctctgacagagaagtcatggagtcattgccatttcctggttgcccttttggaatgtgatcctgttagtagaggttttctagcttctactaagatatttctttccctaaccatcatacacttggcatgtttcattcccatctcctttcccctcaccttaaaggagactacccctttgccccatattgtcaacctaattttctctcgtactctctctagtgaatgatgtgctaccaagtatatgccaggctgtgagaggattatactgagtagtagaaagaagctaatttgaaataaaaattatttgtataattaagaaagcagattagatgcacatggtcaacaggaagttgactgtatgtctgctagttagattcaaaacatcataaagatgatagcatgtcaatatattagcctagccattatgttagcctttgttaggtgggcagcttttctgctttttcccttcctctgtggtgacaacggaggaaatatccaacagaaatacgtctaacagggaaattgggatcatagtttatatgcatctgatttgaaaggagtattgaggaaggttttcatatatgatctatctttggattaaaaagaacatttatgaaatcaagccttctaacactagttataattgagaagcaacagtaactccgtggacagcaatcaagcttaaaattgtaaataaatatggggataattcagttgttgcaaaaaaagggcagaattcagtagaataaagtccttttctcttacaggtattaaatgaggacagagaacctcaggtgttcttatgctagtgcttgctgagtgcatactaagaaagcaattccaaatagatgtatacatctagagagagtggtattagagattcagtgtatgtatttatttacatgagaggaaactggaatataatcccataaattatcaccttttatgactggaaaatatttgccaatgaagaaatggtctgtaggtatttgtcttaagatttttggctgtttaataaaaatgtaactttaacggtt

SEQ ID NO: 21036 - DNA, 4882 bp, Homo sapiens
  ENST00000318950
aggtgactgcgcggcgggctgtggctgcggaggttgaggggcgtccgaggcgcggaggggctggctgggcaggaggggttggcggggcagcagggccgcggccatggggagcttgaaggaggagctgctcaaagccatctggcacgccttcaccgcactcgaccaggaccacagcggcaaggtctccaagtcccagctcaaggtcctttcccataacctgtgcacggtgctgaaggttcctcatgacccagttgcccttgaagagcacttcagggatgatgatgagggtccagtgtccaaccagggctacatgccttatttaaacaggttcattttggaaaaggtccaagacaactttgacaagattgaattcaataggatgtgttggaccctctgtgtcaaaaaaaacctcacaaagaatcccctgctcattacagaagaagatgcatttaaaatatgggttattttcaactttttatctgaggacaagtatccattaattattgtgtcagaagagattgaatacctgcttaagaagcttacagaagctatgggaggaggttggcagcaagaacaatttgaacattataaaatcaactttgatgacagtaaaaatggcctttctgcatgggaacttattgagcttattggaaatggacagtttagcaaaggcatggaccggcagactgtgtctatggcaattaatgaagtctttaatgaacttatattagatgtgttaaagcagggttacatgatgaaaaagggccacagacggaaaaactggactgaaagatggtttgtactaaaacccaacataatttcttactatgtgagtgaggatctgaaggataagaaaggagacattctcttggatgaaaattgctgtgtagagtccttgcctgacaaagatggaaagaaatgcctttttctcgtaaaatgttttgataagacttttgaaatcagtgcttcagataagaagaagaaacaggagtggattcaagccattcattctactattcatctgttgaagctgggcagccctccaccacacaaagaagcccgccagcgtcggaaagaactccggaagaagcagctggctgaacaagaggaactggagcgacaaatgaaggaactccaggccgccaacgaaagcaagcagcaggagctggaggccgtgcggaagaaactggaggaagcagcatctcgtgcagcagaagaggaaaagaaacgccttcagactcaagtggaacttcaggccaggttcagcacagagctggaaagagagaagcttatcagacagcagatggaagaacaggttgctcaaaagtcctctgaactggaacagtatttacagcgagtacgggagctggaagacatgtacctaaagctgcaggaggctcttgaagatgagagacaggcccggcaagatgaagagacagtgcggaagcttcaggccaggttgttggaggaagagtcttccaagagggctgaactagaaaagtggcacttggagcagcagcaggccattcagacaaccgaggcggagaagcaggagttggagaatcagcgtgtcctgaaggaacaggccctgcaggaggccatggagcagctggagcagcttgagttagaacggaagcaagcacttgagcagtacgaggaagttaaaaagaagctggagatggcaactaataagaccaagagctggaaggacaaagtggcccatcatgaaggattaattcgactgatagaaccaggttcaaagaaccctcacctgatcactaactggggacctgcagctttcactgaggcagaacttgaagagagagagaagaactggaaagagaaaaagaccacggagtgactgagcttgctggcagtcacgtcagttatgtagatactgcatggcaggagagctttacgctaaagacaaaagaaacagctttgggggccgggcgtggtggctcacgcctgtaatcccagcactttgggaggccgaggcgggtggatcacctgaggtcaggagttcaagagcagcctggccaacctggtgaaaccctgtctctactaaaaatacaaaaaaaattagctgagcgtggtggcgggcgcctgtaatcccagctacttgggaggctgaggcaggagaatcacttgaacgtgggaggcggaggttgcagcgagctgagatcatgccgttgtactccagcttgggcaacagagtgagactccatctcaaaacaaaacaaaacaaaacaaaacaaaaaaacccggctttgctgcttttaactcttcttccttctgtgcctctctaagtgggtcagtatcctaaggaagccttcttatttatcttcctgcaaacaagggttacctgaaaagaaaaaaaaagtcaacattgtcaagctgtttgtttactctttctttgaaaacatcaccttctgaaatttgtcttttagctctctcagattcttccccaaatgaggcagggtgcagacagcacagtcagctctgcagagtttggaggggctcactgccactgggtactcagaacctctgtggactggatgtcagctctttcctttggcagcgtgtttccttttccgagtatgtgctgttaaactagattggccggttcgctttccatttcctgacacttgacatggaatgcctttgaccattggtgctctgacagagaagtcatggagtcattgccatttcctggttgcccttttggaatgtgatcctgttagtagaggttttctagcttctactaagatatttctttccctaaccatcatacacttggcatgtttcattcccatctcctttcccctcaccttaaaggagactacccctttgccccatattgtcaacctaattttctctcgtactctctctagtgaatgatgtgctaccaagtatatgccaggctgtgagaggattatactgagtagtagaaagaagctaatttgaaataaaaattatttgtataattaagaaagcagattagatgcacatggtcaacaggaagttgactgtatgtctgctagttagattcaaaacatcataaagatgatagcatgtcaatatattagcctagccattatgttagcctttgttaggtgggcagcttttctgctttttcccttcctctgtggtgacaacggaggaaatatccaacagaaatacgtctaacagggaaattgggatcatagtttatatgcatctgatttgaaaggagtattgaggaaggttttcatatatgatctatctttggattaaaaagaacatttatgaaatcaagccttctaacactagttataattgagaagcaacagtaactccgtggacagcaatcaagcttaaaattgtaaataaatatggggataattcagttgttgcaaaaaaagggcagaattcagtagaataaagtccttttctcttacaggtattaaatgaggacagagaacctcaggtgttcttatgctagtgcttgctgagtgcatactaagaaagcaattccaaatagatgtatacatctagagagagtggtattagagattcagtgtatgtatttatttacatgagaggaaactggaatataatcccataaattatcaccttttatgactggaaaatatttgccaatgaagaaatggtctgtaggtatttgtcttaagatttttggctgtttaataaaaatgtaactttaacggtttcttatagttgcctttataaagtgtattgtctaaaatatttttgtatcatgtgcctttgaaatttgacagctgatttgggtgttggatttctgcccagccatttatcagtattatcattttattcagtagctggcaggtgtattagaccaacgagacttaggtaaggaatggaacctttcctgtggtttgactgcacattacaccagaagactccagtatccctcattccagaatgaggaaaaagtattctacaaagaacctaatcacctctgtgaaatctatgggatggaaacagtgtggccttaggagtcaaatagtctctgcatggtggggaggatcatgatggaatatgtgaatttctacttctagaagttgtgaaataggtcctgcacttttgcagaatgtccttctttaaacctggcttattccacagctgtagctgataacatgacctggggcttagctgctctagccctgggttcttggagacctcacactgcctggcccctggccatccacctaaggactgcctgctttctggtcacatgtggaccttgatacgactaagcggttacatatgtggttgtgcaaaagctttctgtttaatgcatagtgttaccgatttacatcttggttttcagtggcactatgtctaggaggcaatatccttttaaacagtgctttggctaagatagatacttgtgaatcaaagatagcacagaaatgaactaagtatatcccatttggaattatattttgatactatttaaaatggtttcacctgttaaagggccaacagaactcttggttttacttttgtaattactgtacagaaaatttcaagagtgtttgagtgcttgtcatcaggtgttttccttaataagtagggatatgatcatttacaggaattatatatgaaaaaagtttttgaaatgtatttttgtgatgtgctatgttgaggggaaaccaaatatttatgattttaaaacattcgtatgaaaacattgtacaatgtaatatgctcaactttctcaattttttgctaatttttctaagatacattaaaaatgttttatatttttttttaagtaaaatggacccagtaagaaaattaaaaataccagaacatacactttaaactgtctgatttaataaaacagtggggggta

SEQ ID NO: 21037 - DNA, 813 bp, Homo sapiens
  ENST00000526358
gactgcgcggcgggctgtggctgcggaggttgaggggcgtccgaggcgcggaggggctggctgggcaggaggggttggcggggcagcagggccgcggccatggggagcttgaaggaggagctgctcaaagccatctggcacgccttcaccgcactcgaccaggaccacagcggcaaggtctccaagtcccagctcaaggtcctttcccataacctgtgcacggtgctgaaggttcctcatgacccagttgcccttgaagagcacttcagggatgatgatgagggtccagtgtccaaccagggctacatgccttatttaaacaggttcattttggaaaagattaccaagacccttcctgcctcagagccttcagacatgctgcttcctgtgctgtccaagacaactttgacaagattgaattcaataggatgtgttggaccctctgtgtcaaaaaaaacctcacaaagaatcccctgctcattacagaagaagatgcatttaaaatatgggttattttcaactttttatctgaggacaagtatccattaattattgtgtcagaagagattgaatacctgcttaagaagcttacagaagctatgggaggaggttggcagcaagaacaatttgaacattataaaatcaactttgatgacagtaaaaatggcctttctgcatgggaacttattgagcttattggaaatggacagtttagcaaaggcatggaccggcagactgtgtctatggcaattaatgaagtctttaatgaacttatattagatgtgttaaagcagggttacatgatgaaaaagg

SEQ ID NO: 21038 - DNA, 716 bp, Homo sapiens
  ENST00000531814
tgcggaggttgaggggcgtccgaggcgcggaggggctggctgggcaggaggggttggcggggcagcagggccgcggccatggggagcttgaaggaggagctgctcaaagccatctggcacgccttcaccgcactcgaccaggaccacagcggcaaggtctccaagtcccagctcaaggtcctttcccataacctgtgcacggtgctgaaggttcctcatgacccagttgcccttgaagagcacttcagggatgatgatgagggtccagtgtccaaccagggctacatgccttatttaaacaggttcattttggaaaagattgaatacctgcttaagaagcttacagaagctatgggaggaggttggcagcaagaacaatttgaacattataaaatcaactttgatgacagtaaaaatggcctttctgcatgggaacttattgagcttattggaaatggacagtttagcaaaggcatggaccggcagactgtgtctatggcaattaatgaagtctttaatgaacttatattagatgtgttaaagcaggtaagaattctgttactgtttttttttctcatctttagaatttgacattttaaaattaatatttttgtcacaaagatgagtataagtcacttattttcttacactgatttcgtttttttattttttgtttttttgagacagtcttgctctgtcgcccagtctggagtgca

SEQ ID NO: 21039 - DNA, 3006 bp, Homo sapiens
  ENST00000524817
ggctggctgggcaggaggggttggcggggcagcagggccgcggccatggggagcttgaaggaggagctgctcaaagccatctggcacgccttcaccgcactcgaccaggaccacagcggcaaggtctccaagtcccagctcaaggtcctttcccataacctgtgcacggtgctgaaggttcctcatgacccagttgcccttgaagagcacttcagggatgatgatgagggtccagtgtccaaccagggctacatgccttatttaaacaggttcattttggaaaaggtccaagacaactttgacaagattgaattcaataggatgtgttggaccctctgtgtcaaaaaaaacctcacaaagaatcccctgctcattacagaagaagatgcatttaaaatatgggttattttcaactttttatctgaggacaagtatccattaattattgtgtcagaagagattgaatacctgcttaagaagcttacagaagctatgggaggaggttggcagcaagaacaatttgaacattataaaatcaactttgatgacagtaaaaatggcctttctgcatgggaacttattgagcttattggaaatggacagtttagcaaaggcatggaccggcagactgtgtctatggcaattaatgaagtctttaatgaacttatattagatgtgttaaagcagggttacatgatgaaaaagggccacagacggaaaaactggactgaaagatggtttgtactaaaacccaacataatttcttactatgtgagtgaggatctgaaggataagaaaggagacattctcttggatgaaaattgctgtgtagagtccttgcctgacaaagatggaaagaaatgcctttttctcgtaaaatgttttgataagacttttgaaatcagtgcttcagataagaagaagaaacaggagtggattcaagccattcattctactattcatctgttgaagctgggcagccctccaccacacaaagaagcccgccagcgtcggaaagaactccggaagaagcagctggctgaacaagaggaactggagcgacaaatgaaggaactccaggccgccaacgaaagcaagcagcaggagctggaggccgtgcggaagaaactggaggaagcagcatctcgtgcagcagaagaggaaaagaaacgccttcagactcaagtggaacttcaggccaggttcagcacagagctggaaagagagaagcttatcagacagcagatggaagaacaggttgctcaaaagtcctctgaactggaacagtatttacagcgagtacgggagctggaagacatgtacctaaagctgcaggaggctcttgaagatgagagacaggcccggcaagatgaagagacagtgcggaagcttcaggccaggtgccagatttgtttgcagactttgcctttatgtactttgcctgggctaatacagtttcttggaatgactaacactctggtggagagggagaagtgtctctgctctggctgtgactgagctcgaggtgctgtccagattagaaagactgtggagactcgaccggctggagtgtttcttttcattctgaggcgctgggaaacccttgcttctggggctaaataagggcctattttagagcagtctggtaggtatgtttgatgaggtacccttagtcttattcgagaaaatccacaaacccagaattacctctgataagagcttggcatcttcaacacgctccagaccagagagggccattggtatgcaggcagaggcctgttcaggccaacgttgccgtcaggttttgaggaataaggaagaaatatgcagtttctatttggtcattcaggattggtaacattccttcagtaattactacttgaaatcctaattttaaaagtatttgaaacctagattttttttccccttagaactttatgatagtcatgttcgcagatgaaaattctcaattttgggccttcatggcagcagggaggacaaaataaaatgaagactcccaaagggaaaaattgagcctatcctctgccagtttctactttgctgccccatttacattatttaaggtgtctgggatgggagacaacactaaaaagtattcactacagtagcagcacagggtccagtctttgatctctgaccccctgttttggggagcagttatgagatgagctagggtagattttccatggctgccattttacatgtggagcagcaaaagatgtttctttaatctttagataggaagagaaagaagaagccatctttagttgtatattttgccaaaagtgacttcaaaaataaataaattgttttggacatttagattttaaatttaaatttttttaaggaaaaattattttctaaatagaaaattaagcatgtagcatattgccaggcatatataggccccacaggtgcacattcactgcactgtgaggttaatcaggttcttggaactcccctccagtgccactcggcagtgattttagcagaagagtcactctacgggaatgtttgagtgccatgtgacgtccagagtgacgttctacatgacactcaacattttttgagccacctcataatttgagccgtgttgagagttaatagattgtttttgtgcaaagaattcgcaggtgaaatatgctatatgtattactgcagttttgtgggaagttgattatgacacagcagagactagatcacagagggaaccagataattctagaaatactagtcttagttatttagtgtttatagaatgagtgatattttgaataagggataattttggataattgaagccagtggttttttaaccaatgttatgtatcagaatcacctcacaaagcttctgaaaaatacaccacaaagtgtggctcacccaccacactttgggaggccgaggctggaggatcacttgaacccaggagtttatgaccagcctgagcaacatggtgaaacctcatctttaaaaaaaaaaaaaaa

SEQ ID NO: 21040 - DNA, 1131 bp, Homo sapiens
  ENST00000534662
agaattgatgcaggccactagagactaaaacggcaacacatgatttattatttagtataattgaatagtggagaatggtaatgtttgtctctccttggcccaatataatgaatcaaaaggcccttaagttatttggttatgatacgtatatgattgtgttgaaagtcagcaggaaatgaatctagattagttgtctggcacagtcactgggaatgctgagcagatcgaagctgggtgctaatgacaacttcataaggcttgggagggcaccttcagaaaggttcaggatgaacctggcaagctacttctagagctgagtttgctactaataggcgctttctgagttacaaacataacaagtcatctgattttgaagaaactgaagcttggagtgtgaatgacgtgggttcagtaagagattgaatacctgcttaagaagcttacagaagctatgggaggaggttggcagcaagaacaatttgaacattataaaatcaactttgatgacagtaaaaatggcctttctgcatgggaacttattgagcttattggaaatggacagtttagcaaaggcatggaccggcagactgtgtctatggcaattaatgaagtctttaatgaacttatattagatgtgttaaagcagggttacatgatgaaaaagggccacagacggaaaaactggactgaaagatggtttgtactaaaacccaacataatttcttactatgtgagtgaggatctgaaggataagaaaggagacattctcttggatgaaaattgctgtgtagagtccttgcctgacaaagatggaaagaaatgcctttttctcgtaaaatgttttgataagacttttgaaatcagtgcttcagataagaagaagaaacaggagtggattcaagccattcattctactattcatctgttgaagctgggcagccctccaccacacaaagaagcccgccagcgtcggaaagaactccggaagaagcagctggctgaacaagaggaactggagcgacaaatgaaggaactccaggccgccaacgaaagcaagcagcaggagctggaggccgtgcggaagaaactggaggaagcagcatctcgtgcagcagaagaggaaaagaaacg

SEQ ID NO: 21041 - DNA, 977 bp, Homo sapiens
  ENST00000534562
attttcctgttggtctggggcagagttcctccttcagaatattgagaggtcaggcagaaagggttacatgatgaaaaagggccacagacggaaaaactggactgaaagatggtttgtactaaaacccaacataatttcttactatgtgagtgaggatctgaaggataagaaaggagacattctcttggatgaaaattgctgtgtagagtccttgcctgacaaagatggaaagaaatgcctttttctcgtaaaatgttttgataagacttttgaaatcagtgcttcagataagaagaagaaacaggagtggattcaagccattcattctactattcatctgttgaagctgggcagccctccaccacacaaagaagcccgccagcgtcggaaagaactccggaagaagcagctggctgaacaagaggaactggagcgacaaatgaaggaactccaggccgccaacgaaagcaagcagcaggagctggaggccgtgcggaagaaactggaggaagcagcatctcgtgcagcagaagaggaaaagaaacgccttcagactcaagtggaacttcaggccaggttcagcacagagctggaaagagagaagcttatcagacagcagatggaagaacaggttgctcaaaagtcctctgaactggaacagtatttacagcgagtacgggagctggaagacatgtacctaaagctgcaggaggctcttgaagatgagagacaggcccggcaagatgaagagacagtgcggaagcttcagcgagctgagatcatgccgttgtactccagcttgggcaacagagtgagactccatctcaaaacaaaacaaaacaaaacaaaacaaaaaaacccggctttgctgcttttaactcttcttccttctgtgcctctctaagtgggtcagtatcctaaggaagccttcttatttatcttcctgcaaacaagggttacctgaaaagaaaaaaaaa

SEQ ID NO: 21042 - DNA, 6129 bp, Homo sapiens
  ENST00000380155
tctccctgggagtcgcgcagagtggagtcaaaggcaaccagtgctcgctgcggtctctggggatcgggaccgcggcggcggcccgcgagcgggatgttccggggcttgagcagttggttgggcttgcagcagccggtggcaggcggtgggcagcccaatggagatgctccacccgagcagccgtccgagacggtggctgagtctgcggaggaggagctgcagcaagcgggagaccaggagctcctccaccaggccaaagacttcggcaactatttatttaactttgcatctgctgccacaaaaaagataactgaatcagttgctgaaacagcacaaacaataaagaaatccgtagaagaaggaaaaatagatggcatcattgacaagacaattataggagattttcagaaggaacagaaaaaatttgttgaagagcaacatacaaagaagtcagaagcagctgtgcccccatgggttgacactaacgatgaagaaacaattcaacaacaaattttggccttatcagctgacaagaggaatttccttcgtgaccctccggctggcgtgcaatttaatttcgactttgatcagatgtaccccgtggccctggtcatgctccaggaggatgagctgctaagcaagatgagatttgccctcgttcctaaacttgtgaaggaagaagtgttctggaggaactacttttaccgcgtctccctgattaagcagtcagcccagctcacggccctggctgcccaacagcaggccgcagggaaggaggagaagagcaatggcagagagcaagatttgccgctggcagaggcagtacggcccaaaacgccacccgttgtaatcaaatctcagcttaaaactcaagaggatgaggaagaaatttctactagcccaggtgtttctgagtttgtcagtgatgccttcgatgcctgtaacctaaatcaggaagatctaaggaaagaaatggagcaactagtgcttgacaaaaagcaagaggagacagccgtactggaagaggattctgcagattgggaaaaagaactgcagcaggaacttcaagaatatgaagtggtgacagaatctgaaaaacgagatgaaaactgggataaggaaatagagaaaatgcttcaagaggaaaattagctgttcctgaaatagaagaataatccttaacagtctgcaaactgacattaaattctagatgttgacaattactgaatcagaaggcatgaaagagtataattttatgaaattcaaaattattcttttttcaagttgaaacttgcctcttctactttaaaaaagtatatagaacagttacttctaataatcagaaagagatgttttatagaacatttctttaatataaagttagagatgtcttcataggcagtatggctatctttgccacagaaacataagtaaaattttagagttctgttttccatgaggtcaaaaatataatttattcctcagtcatggttttctaaatatctgtactccacattccattttaattgatatgagggtgttaaagtacctacttaatgggttgattactatcaaaatgaccaaattataccaaagaacttaagaggaagcactttcagaactattcacttgccaggtattttctaaaattccacctgaaagccaaaagataaaataaataagttgattttaatgatataagcatcacacaattttacattaagaaatactgtgcaggccatgcgtggtggctcaggcctgtaatcccagcactttgggaggccgaggtgggcagatcaccggaggtcaggagttcgagaccagccttgccaacatagtgaaaccctgtctctactaaaaatacaaaaattagccgggcatggtggcaggcacctgtaatcccagctactagggaggcttttgaacccaggaggcagaggttgcagcgagctgagatcgcgccactgcactccagcctgggtgatagagtgagattcagtctcaaaaaaaaaaaaaaaaaaaagctgtgcgaaaatatttgtttttctctggggccttttctttcttttctttttaaactataccagaaattttacatcacagtttttatacaaagtgggaccttccatactttttgtattacaataaccttcagaagcccattccccttaaagtctgttgttcttgttttaatcatcaccacatataaatgttttagctttgtcttaaactgtgagtcttcataaaattgtgttcctccgagttcaccttctaggactttattgattaatccttctctttctgctataccagcagacacatattcatagaatatgattatttttaaagaacaaggtgaggaggctgaggcaggagaattgcttgaacctgggagatggaggttgcagtgagctgagatcacgccactgcactccagcctgggtgacagagtgagagactccgtctcaaaaatgaatgaatgaatgaatgaatgaatgaacgaacgaacaaggtggtttaatgtcagaaaacttcctaagcatttgctccccaaacctttcatgtttttcaagaagcctttattacataaaggggaatagaattaaaatgtttctttataagaaaaatatacatatttgtgttcttggccccattaaaactagtcagtagtcctttggcaaagatatagtcaacaagagaactgggtatgagtccaggcattactcctgttcatagttgtggatgcatgtgtctgagccagactgtctcaactggagtctcttgggttatagcagtaaacccgtgtattccatgaaaccactgggcccatcatcaaaaggtttccacttgtggtgccacagttgcttattactgagtttgggttccaagatgactggcaacttctgaaataatctcattgaaggaaagagtttcattttttttttaaaagagtttgctggaggaaaagaagcatgttaaatgtttttaagcagctaaaagtcctagatggaagcatatcaggatgtgtcggtgcttggctcttagtgaatgcactaaaattcttattgataaatgttgaataaacacacacaaaaaagtatcagagaaagagaaaaaccctacaatggcaatagaggtgtgtgacagttattgctatcaattttacataatatctcatttaaaaacaacctaattatgcattgcctgtgaaaataaaaggataaaataagattttgtacatactgtaagaatacagttgtgctgtatttttatggattcatcaaggagtaaaatgttctgctttagtaaattatataggtaactgaagtgttattcctttaaagagcaaaataatttatcaccatgtttggtggaaaatttctaagtatttattacatgcctaggggttagccaacaagatataccaagcatgaaaacctgtaaaacttaataaaatgctaaaatatgaacatcacactatggagattatgcctcactactcaaagagtgtggctcaggaaccagtgtagcttggccatgccctggcagtatgttggaaatgcctgccccagaccagttgatgttactaagaacgcccaggggatgagaatggactttatttacagtttgggaagcactggtctaatatgctctcagggaagctgaggtttctactgctttttactttttacccttccactagatgtcctttgcagcagtgtttttctagttggcattacaggtgtctcctctgaggttccagttatttctatactaccaaaattaaaaagacccaagggctgggcatggtggttcacacctgtaatcccagcactttgggaggctgaggcaggcagattgcttgagctcaggagttcaagaccagcctgggcaacatagggagacccctgcctctacaaaaatacaaatgagccaggtgtggtagcccacacctgtggtcctagctacttggaaggctgaggcaggaggatcgcttgagcccaggagatccaggctgcagtaagccatgatcatgccactgcacttcagcctgggtgacagagactctgtttcaaaaaagggagggggggcaagtttttagggggatgagaaatattcttggtaaatcgggcatttctttttttgtttgtttttttttcttggagacagaatcttgctctgtcacccaggctggagtgcagtggcttgatctcagctcacggcaacctccgcctcccaagttcaagcgattctcccacctcagcctccagagtagctgggattacaggcaaccgccaccatgcccagctaatttttttgtatttttagcagagatggggtttcaccgtgttggccaggctggtctcaagctcctgatctcaaatgatccgcacgccttgacctcccaaagtgttgggattacaggcatgagccacagccttaattggtaatttttgaaaaaaaaactagagaaacattgtttcagagataaagcagcaattacacttgtactcccagtgatttaagatgcactattgtaatcaagatgatttgctttaatcaaaatattgttaaaaataggatttcaggacatttaaaaggtttcagcagaaatcttatgattatgtctgacttgcagtattttatttgcctctttgacggctttttttttttttttttttttgagacagagtctcacactgttgcctgggctggaatgcaatggcgcagtctcagctcactgcaaacctccggctcccgggttcaggcagttctcctgcctcagcctccctagtagctgggattataggcatgtgccaccacacccggctaatttttgtatttttagtagagacagggtttcgccatgttggtcaggctggtcttgaactcccaacctcaggtgatccgcccgcctcggcctcccaaagtgctgggattacaggcgtgagccactgcgcccaaccttaatggctttttggtattaaaaaccaggactctgaatgtgcatcaataattcaaataattttatatagttactctttctagtaatagatacccccctccatttttaagtaaagataaacattttttaattaggaaaattaggcacatttaattttagcaaatttagtttttcaacttttttttttttctttttttttttttttgagatggaggctcactctgttgccctggctggagtgcagtggccgcaacctcggctcactgcaacctccgcctcctgggttcaagtgattctcctgcctcagcctcccgagtagctgggattacaggcgtgtgccaccacacctggctaatttttgtatttttagtagagacggggtttcaccatgttggccaggctggtcttgaacgactggcctcaggtgatccgcccacctcggcctctcaaagtgctgggattacaggcatgagccaccatgcccagccagtttttcaacttttaaaaataaaagtggtagaatttttttttttctttttgagacagggtcttgctctgtcactcaggctagagtgcagtggtgggatctcagctcactgcagcctccgcctcccaggcttaagggatcctccctcctcagcctcccgagtagctgggaccacaggcatgcaccaccacgcctggctaatttttgtattttttgtagagatgggtgtctccccatgttgctcaggctgttcttgaacttctgagctcaggtgatctatctgcctcggccttccaaagtgctgggattacaggcatgatgagccactgcacctggccaaaagtggcagaaattttgatatggtttataatcagttttattgtggggaagatgggccattttaatgaatgattatttctattggctaaactaccgagtcacgacatgacaaatacacatgaagctttaatcacatgcagttatatacttctcacaaatcatcaaattatttatctggtcttcacactaagggatttacttagataagccatcgatgatttcagttgttaaaagtgtggctttttaaacagcatttattcagtgcatcctgatttatttcaaaatgaaaaattgttacctttttttctgaataaataaagcttacttttagtggcaa

SEQ ID NO: 21043 - DNA, 604 bp, Homo sapiens
  ENST00000495743
caggcggtgggcagcccaatggagatgctccacccgagcagccgtccgagacggtggctgagtctgcggaggaggagctgcagcaagcgggagaccaggagctcctccaccaggccaaagacttcggcaactatttatttaactttgcatctgctgccacaaaaaagataactgaatcagttgctgaaacagcacaaacaataaagaaatccgtagaagaaggaaaaatagatggcatcattgacaagacaattataggagattttcagaaggaacagaaaaaatttgttgaagagcaacatacaaagaagtcaggtatggtataggtttgtcttaattaacctgccaggttttattgagcacctgttatgtgctagataccacactgagggtctgagaacacaaaaatgcatatgcaatggccccatcctttgggtagcacaaagactagtgagggagacaaacccataaacttccatgatttaaaggaagggactagattgtttctgggtgagggctgccagtgctggccccactggggagctggctgtgaaaggggcaagtaagctttcagttctgactttctcttttcttttcccccacc

SEQ ID NO: 21044 - DNA, 3522 bp, Homo sapiens
  ENST00000369522
ctgggagcctggcaagcccacacagcgacggttatttagccgttgaactgccagccgcccggggcccacgcgctccgggccgctcaggctgagcgatttcccgccttttctgaggttctgaggcgggagccattggttctttctgttgccctcatagaccgtatgtagcagttcgcgtgggcacagaacccacggtttcccgctagttcttcaaagatatttacaaccgtaacagagaaaatggaaaagcaaaagccctttgcattgttcgtaccaccgagatcaagcagcagtcaggtgtctgcggtgaaacctcagaccctgggaggcgattccactttcttcaagagtttcaacaaatgtactgaagatgattttgagtttccatttgcaaagactaatctctccaaaaatggggaaaacattgattcagatcctgctttacaaaaagttaatttcttgcccgtgcttgagcaggttggtaattctgactgtcactatcaggaaggactaaaagactctgatttggagaattcagagggattgagcagagtgtattcaaaactgtataaggaggctgaaaagataaaaaaatggaaagtaagtacagaagctgaactgagacagaaagaaagtaagttgcaagaaaacagaaagataattgaagcacagcgaaaagccattcaggaactgcaatttggaaatgaaaaagtaagtttgaaattagaagaaggaatacaagaaaataaagatttaataaaagagaataatgccacaaggcatttatgtaatctactcaaagaaacctgtgctagatctgcagaaaagacaaagaaatatgaatatgaacgggaagaaaccaggcaagtttatatggatctaaataataacattgagaaaatgataacagcttttgaggaacttcgtgtgcaagctgagaattccagactggaaatgcattttaagttaaaggaagattatgaaaaaatccaacaccttgaacaagaatacaagaaggaaataaatgacaaggaaaagcaggtatcactactattgatccaaatcactgagaaagaaaataaaatgaaagatttaacatttctgctagaggaatccagagataaagttaatcaattagaggaaaagacaaaattacagagtgaaaacttaaaacaatcaattgagaaacagcatcatttgactaaagaactagaagatattaaagtgtcattacaaagaagtgtgagtactcaaaaggctttagaggaagatttacagatagcaacaaaaacaatttgtcagctaactgaagaaaaagaaactcaaatggaagaatctaataaagctagagctgctcattcgtttgtggttactgaatttgaaactactgtctgcagcttggaagaattattgagaacagaacagcaaagattggaaaaaaatgaagatcaattgaaaatacttaccatggagcttcaaaagaaatcaagtgagctggaagagatgactaagcttacaaataacaaagaagtagaacttgaagaattgaaaaaagtcttgggagaaaaggaaacacttttatatgaaaataaacaatttgagaagattgctgaagaattaaaaggaacagaacaagaactaattggtcttctccaagccagagagaaagaagtacatgatttggaaatacagttaactgccattaccacaagtgaacagtattattcaaaagaggttaaagatctaaaaactgagcttgaaaacgagaagcttaagaatactgaattaacttcacactgcaacaagctttcactagaaaacaaagagctcacacaggaaacaagtgatatgaccctagaactcaagaatcagcaagaagatattaataataacaaaaagcaagaagaaaggatgttgaaacaaatagaaaatcttcaagaaacagaaacccaattaagaaatgaactagaatatgtgagagaagagctaaaacagaaaagagatgaagttaaatgtaaattggacaagagtgaagaaaattgtaacaatttaaggaaacaagttgaaaataaaaacaagtatattgaagaacttcagcaggagaataaggccttgaaaaaaaaaggtacagcagaaagcaagcaactgaatgtttatgagataaaggtcaataaattagagttagaactagaaagtgccaaacagaaatttggagaaatcacagacacctatcagaaagaaattgaggacaaaaagatatcagaagaaaatcttttggaagaggttgagaaagcaaaagtaatagctgatgaagcagtaaaattacagaaagaaattgataagcgatgtcaacataaaatagctgaaatggtagcacttatggaaaaacataagcaccaatatgataagatcattgaagaaagagactcagaattaggactttataagagcaaagaacaagaacagtcatcactgagagcatctttggagattgaactatccaatctcaaagctgaacttttgtctgttaagaagcaacttgaaatagaaagagaagagaaggaaaaactcaaaagagaggcaaaagaaaacacagctactcttaaagaaaaaaaagacaagaaaacacaaacatttttattggaaacacctgaaatttattggaaattggattctaaagcagttccttcacaaactgtatctcgaaatttcacatcagttgatcatggcatatccaaagataaaagagactatctgtggacatctgccaaaaatactttatctacaccattgccaaaggcatatacagtgaagacaccaacaaaaccaaaactacagcaaagagaaaacttgaatatacccattgaagaaagtaaaaaaaagagaaaaatggcctttgaatttgatattaattcagatagttcagaaactactgatcttttgagcatggtttcagaagaagagacattgaaaacactgtataggaacaataatccaccagcttctcatctttgtgtcaaaacaccaaaaaaggccccttcatctctaacaacccctggatctacactgaagtttggagctataagaaaaatgcgggaggaccgttgggctgtaattgctaaaatggatagaaaaaaaaaactaaaagaagctgaaaagttatttgtttaatttcagagaatcagtgtagttaaggagcctaataacgtgaaacttatagttaatattttgttcttatttgccagagccaaattttatctggaagttgagacttaaaaaatacttgcatgaatgatttgtgtttctttatatttttagcctaaatgttaactacatattgtctggaaacctgtcattgtattcagataattagatgattatatattgttgttactttttcttgtattcatgaaaactgtttttactaagttttcaaatttgtaaagttagcctttgaatgctaagaatgcattattgagggtcattctttattctttactattaaaatattttggatgcaaa

SEQ ID NO: 21045 - DNA, 2554 bp, Homo sapiens
  ENST00000455987
ccacgcgctccgggccgctcaggctgagcgatttcccgccttttctgaggttctgaggcgggagccattggttctttctgttgccctcatagaccgtatgtagcagttcgcgtgggcacagaacccacggtttcccgctagttcttcaaagtagatatttacaaccgtaacagagaaaatggaaaagcaaaagccctttgcattgttcgtaccaccgagatcaagcagcagtcaggtgtctgcggtgaaacctcagaccctgggaggcgattccactttcttcaagagtttcaacaaatgtactgaagatgattttgagtttccatttgcaaagactaatctctccaaaaatggggaaaacattgattcagatcctgctttacaaaaagttaatttcttgcccgtgcttgagcaggttggtaattctgactgtcactatcaggaaggactaaaagactctgatttggagaattcagagggattgagcagagtgtattcaaaactgtataaggaggctgaaaagataaaaaaatggaaagtaagtacagaagctgaactgagacagaaagaaagtaagttgcaagaaaacagaaagataattgaagcacagcgaaaagccattcaggaactgcaatttggaaatgaaaaagtaagtttgaaattagaagaaggaatacaagaaaataaagatttaataaaagagaataatgccacaaggcatttatgtaatctactcaaagaaacctgtgctagatctgcagaaaagacaaagaaatatgaatatgaacgggaagaaaccaggcaagtttatatggatctaaataataacattgagaaaatgataacagcttttgaggaacttcgtgtgcaagctgagaattccagactggaaatgcattttaagttaaaggaagattatgaaaaaatccaacaccttgaacaagaatacaagaaggaaataaatgacaaggaaaagcaggtatcactactattgatccaaatcactgagaaagaaaataaaatgaaagatttaacatttctgctagaggaatccagagataaagttaatcaattagaggaaaagacaaaattacagagtgaaaacttaaaacaatcaattgagaaacagcatcatttgactaaagaactagaagatattaaagtgtcattacaaagaagtgtgagtactcaaaaggctttagaggaagatttacagatagcaacaaaaacaatttgtcagctaactgaagaaaaagaaactcaaatggaagaatctaataaagctagagctgctcattcgtttgtggttactgaatttgaaactactgtctgcagcttggaagaattattgagaacagaacagcaaagattggaaaaaaatgaagatcaattgaaaatacttaccatggagcttcaaaagaaatcaagtgagctggaagagatgactaagcttacaaataacaaagaagtagaacttgaagaattgaaaaaagtcttgggagaaaaggaaacacttttatatgaaaataaacaatttgagaagattgctgaagaattaaaaggaacagaacaagaactaattggtcttctccaagccagagagaaagaagtacatgatttggaaatacagttaactgccattaccacaagtgaacagtattattcaaaagaggttaaagatctaaaaactgagcttgaaaacgagaagcttaagaatactgaattaacttcacactgcaacaagctttcactagaaaacaaagagctcacacaggaaacaagtgatatgaccctagaactcaagaatcagcaagaagatattaataataacaaaaagcaagaagaaaggatgttgaaacaaatagaaaatcttcaagaaacagaaacccaattaagaaatgaactagaatatgtgagagaagagctaaaacagaaaagagatgaagttaaatgtaaattggacaagagtgaagaaaattgtaacaatttaaggaaacaagttgaaaataaaaacaagtatattgaagaacttcagcaggagaataaggccttgaaaaaaaaaggtacagcagaaagcaagcaactgaatgtttatgagataaaggtcaataaattagagttagaactagaaagtgccaaacagaaatttggagaaatcacagacacctatcagaaagaaattgaggacaaaaagatatcagaagaaaatcttttggaagaggttgagaaagcaaaagtaatagctgatgaagcagtaaaattacagaaagaaattgataagcgatgtcaacataaaatagctgaaatggtagcacttatggaaaaacataagcaccaatatgataagatcattgaagaaagagactcagaattaggactttataagagcaaagaacaagaacagtcatcactgagagcatctttggagattgaactatccaatctcaaagctgaacttttgtctgttaagaagcaacttgaaatagaaagagaagagaaggaaaaactcaaaagagaggcaaaagaaaacacagctactcttaaagaaaaaaaa

SEQ ID NO: 21046 - DNA, 3452 bp, Homo sapiens
  ENST00000369518
caggaacttaagacagttcctcctggcgatgtgatggaatttaatgggacaggagaagggaacgggctttcttttcaggccagcgtggcagcgggcggtagggcgaaagggagaaggaaacgagggtttattccgttgcccactccgcgatatttacaaccgtaacagagaaaatggaaaagcaaaagccctttgcattgttcgtaccaccgagatcaagcagcagtcaggtgtctgcggtgaaacctcagaccctgggaggcgattccactttcttcaagagtttcaacaaatgtactgaagatgattttgagtttccatttgcaaagactaatctctccaaaaatggggaaaacattgattcagatcctgctttacaaaaagttaatttcttgcccgtgcttgagcaggttggtaattctgactgtcactatcaggaaggactaaaagactctgatttggagaattcagagggattgagcagagtgtattcaaaactgtataaggaggctgaaaagataaaaaaatggaaagtaagtacagaagctgaactgagacagaaagaaagtaagttgcaagaaaacagaaagataattgaagcacagcgaaaagccattcaggaactgcaatttggaaatgaaaaagtaagtttgaaattagaagaaggaatacaagaaaataaagatttaataaaagagaataatgccacaaggcatttatgtaatctactcaaagaaacctgtgctagatctgcagaaaagacaaagaaatatgaatatgaacgggaagaaaccaggcaagtttatatggatctaaataataacattgagaaaatgataacagcttttgaggaacttcgtgtgcaagctgagaattccagactggaaatgcattttaagttaaaggaagattatgaaaaaatccaacaccttgaacaagaatacaagaaggaaataaatgacaaggaaaagcaggtatcactactattgatccaaatcactgagaaagaaaataaaatgaaagatttaacatttctgctagaggaatccagagataaagttaatcaattagaggaaaagacaaaattacagagtgaaaacttaaaacaatcaattgagaaacagcatcatttgactaaagaactagaagatattaaagtgtcattacaaagaagtgtgagtactcaaaaggctttagaggaagatttacagatagcaacaaaaacaatttgtcagctaactgaagaaaaagaaactcaaatggaagaatctaataaagctagagctgctcattcgtttgtggttactgaatttgaaactactgtctgcagcttggaagaattattgagaacagaacagcaaagattggaaaaaaatgaagatcaattgaaaatacttaccatggagcttcaaaagaaatcaagtgagctggaagagatgactaagcttacaaataacaaagaagtagaacttgaagaattgaaaaaagtcttgggagaaaaggaaacacttttatatgaaaataaacaatttgagaagattgctgaagaattaaaaggaacagaacaagaactaattggtcttctccaagccagagagaaagaagtacatgatttggaaatacagttaactgccattaccacaagtgaacagtattattcaaaagaggttaaagatctaaaaactgagcttgaaaacgagaagcttaagaatactgaattaacttcacactgcaacaagctttcactagaaaacaaagagctcacacaggaaacaagtgatatgaccctagaactcaagaatcagcaagaagatattaataataacaaaaagcaagaagaaaggatgttgaaacaaatagaaaatcttcaagaaacagaaacccaattaagaaatgaactagaatatgtgagagaagagctaaaacagaaaagagatgaagttaaatgtaaattggacaagagtgaagaaaattgtaacaatttaaggaaacaagttgaaaataaaaacaagtatattgaagaacttcagcaggagaataaggccttgaaaaaaaaaggtacagcagaaagcaagcaactgaatgtttatgagataaaggtcaataaattagagttagaactagaaagtgccaaacagaaatttggagaaatcacagacacctatcagaaagaaattgaggacaaaaagatatcagaagaaaatcttttggaagaggttgagaaagcaaaagtaatagctgatgaagcagtaaaattacagaaagaaattgataagcgatgtcaacataaaatagctgaaatggtagcacttatggaaaaacataagcaccaatatgataagatcattgaagaaagagactcagaattaggactttataagagcaaagaacaagaacagtcatcactgagagcatctttggagattgaactatccaatctcaaagctgaacttttgtctgttaagaagcaacttgaaatagaaagagaagagaaggaaaaactcaaaagagaggcaaaagaaaacacagctactcttaaagaaaaaaaagacaagaaaacacaaacatttttattggaaacacctgaaatttattggaaattggattctaaagcagttccttcacaaactgtatctcgaaatttcacatcagttgatcatggcatatccaaagataaaagagactatctgtggacatctgccaaaaatactttatctacaccattgccaaaggcatatacagtgaagacaccaacaaaaccaaaactacagcaaagagaaaacttgaatatacccattgaagaaagtaaaaaaaagagaaaaatggcctttgaatttgatattaattcagatagttcagaaactactgatcttttgagcatggtttcagaagaagagacattgaaaacactgtataggaacaataatccaccagcttctcatctttgtgtcaaaacaccaaaaaaggccccttcatctctaacaacccctggatctacactgaagtttggagctataagaaaaatgcgggaggaccgttgggctgtaattgctaaaatggatagaaaaaaaaaactaaaagaagctgaaaagttatttgtttaatttcagagaatcagtgtagttaaggagcctaataacgtgaaacttatagttaatattttgttcttatttgccagagccaaattttatctggaagttgagacttaaaaaatacttgcatgaatgatttgtgtttctttatatttttagcctaaatgttaactacatattgtctggaaacctgtcattgtattcagataattagatgattatatattgttgttactttttcttgtattcatgaaaactgtttttactaagttttcaaatttgtaaagttagcctttgaatgctaagaatgcattattgagggtcattctttattctttactattaaaatattttggatgc

SEQ ID NO: 21047 - DNA, 579 bp, Homo sapiens
  ENST00000477215
tcagagggattgagcagagtgtattcaaaactgtataaggaggctgaaaagataaaaaaatggaaagtaagtacagaagctgaactgagacagaaagaaagtaagttgcaagaaaacagaaagataattgaagcacagcgaaaagccattcaggaactgcaatttggaaatgaaaaagtaagtttgaaattagaagaaggaatacaagaaaataaagatttaataaaagagaataatgccacaaggcatttatgtaatctactcaaagaaacctgtgctagatctgcagaaaagacaaagaaatatgaatatgaacgggaagaaaccaggcaagtttatatggatctaaataataacattgagaaaatgataacagcttttgaggaacttcgtgtgcaagctgagaattccagactggaaatgcattttaagttaaaggaagattatgaaaaaatccaacaccttgaacaagaatacaagaaggaaataaatgacaaggaaaagcaggttttttaaaaaaccaactctttgtattctttatatttgctaattcattaaaaacttaaaatttcaaaagaa

SEQ ID NO: 21048 - DNA, 396 bp, Homo sapiens
  ENST00000468191
tgtttatttttgctaataagcaaaatgggatgaacttttctgttttataaattagtttggaaatgaaaaagtaagtttgaaattagaagaaggaatacaagaaaataaagatttaataaaagagaataatgccacaaggcatttatgtaatctactcaaagaaacctgtgctagatctgcagaaaagacaaagaaattgcctgctatgtcatgaaatcttctagatgctgatgaaaaacagcagtgaacaaagtctctactcttacaagagtgtatattccatggtgtatatgtgccacattttctttatccagtctgtcattgatgggcatttgggttggttccaagtctttgctgttgtaaatagtgctgcaataaacatacgtgtgcatgtgt

SEQ ID NO: 21049 - DNA, 763 bp, Homo sapiens
  ENST00000482717
attgtgatgtcatgcttgggaagacaaagtaaaaaggagaaaaggaaacacttttatatgaaaataaacaatttgagaagattgctgaagaattaaaaggaacagaacaagaactaattggtcttctccaagccagagagaaagaagtacatgatttggaaatacagttaactgccattaccacaagtgaacagtattattcaaaagaggttaaagatctaaaaactgagcttgaaaacgagaagcttaagaatactgaattaacttcacactgcaacaagctttcactagaaaacaaagagctcacacaggaaacaagtgatatgaccctagaactcaagaatcagcaagaagatattaataaatgaactagaatatgtgagagaagagctaaaacagaaaagagatgaagttaaatgtaaattggacaagagtgaagaaaattgtaacaatttaaggaaacaagttgaaaataaaaacaagtatattgaagaacttcagcaggagaataaggccttgaaaaaaaaaggtacagcagaaagcaagcaactgaatgtttatgagataaaggtcaataaattagagttagaactagaaagtgccaaacagaaatttggagaaatcacagacacctatcagaaagaaattgaggacaaaaagatatcagaagaaaatcttttggaagaggttgagaaagcaaaagtaatagctgatgaagcagtaaaattacagaaagaaattgataagcgatgtcaacataaaa

SEQ ID NO: 21050 - DNA, 783 bp, Homo sapiens
  ENST00000493377
gttccagggctgtgtctactgaattgtctgtcatcatgtttagtctttgaatttacttaatattgactaattttctctttttaaagaattttagccagggggaagctcatagttctttccacagctccatttgggcagtttgattactttcactatgtgtatggtttggcattcctgatttgttaatgtttataaatagggagaaaaggaaacacttttatatgaaaataaacaatttgagaagattgctgaagaattaaaaggaacagaacaagaactaattggtcttctccaagccagagagaaagaagtacatgatttggaaatacagttaactgccattaccacaagtgaacagtattattcaaaagaggttaaagatctaaaaactgagcttgaaaacgagaagcttaagaatactgaattaacttcacactgcaacaagctttcactagaaaacaaagagctcacacaggaaacaagtgatatgaccctagaactcaagaatcagcaagaagatattaataataacaaaaagcaagaagaaaggatgttgaaacaaatagaaaatcttcaagaaacagaaacccaattaagaaatgaactagaatatgtgagagaagagctaaaacagaaaagagatgaagttaaatgtaaattggacaagagtgaagaaaatgtatgttatatttaataatggatcgtatcacaaaatttcaaattataaaagcaacaccatatgtctaaactaaaataaagggaagtatactgttgtataaataa

SEQ ID NO: 21051 - DNA, 800 bp, Homo sapiens
  ENST00000477590
gaaaaactcaaaagagaggcaaaagaaaacacagctactcttaaagaaaaaaaagacaagaaaacacaaacatttttattggaaacacctgaaatttattggaaattggattctaaagcagttccttcacaaactgtatctcgaaatttcacatcagttgatcatggcatatccaaagataaaagagactatctgtggacatctgccaaaaatactttatctacaccattgccaaagagcatggtttcagaagaagagacattgaaaacactgtataggaacaataatccaccagcttctcatctttgtgtcaaaacaccaaaaaaggccccttcatctctaacaacccctggatctacactgaagtttggagctataagaaaaatgcgggaggaccgttgggctgtaattgctaaaatggatagaaaaaaaaaactaaaagaagctgaaaagttatttgtttaatttcagagaatcagtgtagttaaggagcctaataacgtgaaacttatagttaatattttgttcttatttgccagagccaaattttatctggaagttgagacttaaaaaatacttgcatgaatgatttgtgtttctttatatttttagcctaaatgttaactacatattgtctggaaacctgtcattgtattcagataattagatgattatatattgttgttactttttcttgtattcatgaaaactgtttttactaagttttcaaatttgtaaagttagcctttgaatgctaagaatgcattattgagggtcattctttattctttactattaaa

SEQ ID NO: 21052 - DNA, 3109 bp, Homo sapiens
  ENST00000618516
ccacgcgctccgggccgctcaggctgagcgatttcccgccttttctgaggttctgaggcgggagccattggttctttctgttgccctcatagaccgtatgtagcagttcgcgtgggcacagaacccacggtttcccgctagttcttcaaagtagatatttacaaccgtaacagagaaaatggaaaagcaaaagccctttgcattgttcgtaccaccgagatcaagcagcagtcaggtgtctgcggtgaaacctcagaccctgggaggcgattccactttcttcaagagtttcaacaaatgtactgaagatgattttgagtttccatttgcaaagactaatctctccaaaaatggggaaaacattgattcagatcctgctttacaaaaagttaatttcttgcccgtgcttgagcaggttggtaattctgactgtcactatcaggaaggactaaaagactctgatttggagaattcagagggattgagcagagtgtattcaaaactgtataaggaggctgaaaagataaaaaaatggaaagtaagtacagaagctgaactgagacagaaagaaagtaagttgcaagaaaacagaaagataattgaagcacagcgaaaagccattcaggaactgcaatttggaaatgaaaaagtaagtttgaaattagaagaaggaatacaagaaaataaagatttaataaaagagaataatgccacaaggcatttatgtaatctactcaaagaaacctgtgctagatctgcagaaaagacaaagaaatatgaatatgaacgggaagaaaccaggcaagtttatatggatctaaataataacattgagaaaatgataacagcttttgaggaacttcgtgtgcaagctgagaattccagactggaaatgcattttaagttaaaggaagattatgaaaaaatccaacaccttgaacaagaatacaagaaggaaataaatgacaaggaaaagcaggtatcactactattgatccaaatcactgagaaagaaaataaaatgaaagatttaacatttctgctagaggaatccagagataaagttaatcaattagaggaaaagacaaaattacagagtgaaaacttaaaacaatcaattgagaaacagcatcatttgactaaagaactagaagatattaaagtgtcattacaaagaagtgtgagtactcaaaaggctttagaggaagatttacagatagcaacaaaaacaatttgtcagctaactgaagaaaaagaaactcaaatggaagaatctaataaagctagagctgctcattcgtttgtggttactgaatttgaaactactgtctgcagcttggaagaattattgagaacagaacagcaaagattggaaaaaaatgaagatcaattgaaaatacttaccatggagcttcaaaagaaatcaagtgagctggaagagatgactaagcttacaaataacaaagaagtagaacttgaagaattgaaaaaagtcttgggagaaaaggaaacacttttatatgaaaataaacaatttgagaagattgctgaagaattaaaaggaacagaacaagaactaattggtcttctccaagccagagagaaagaagtacatgatttggaaatacagttaactgccattaccacaagtgaacagtattattcaaaagaggttaaagatctaaaaactgagcttgaaaacgagaagcttaagaatactgaattaacttcacactgcaacaagctttcactagaaaacaaagagctcacacaggaaacaagtgatatgaccctagaactcaagaatcagcaagaagatattaataataacaaaaagcaagaagaaaggatgttgaaacaaatagaaaatcttcaagaaacagaaacccaattaagaaatgaactagaatatgtgagagaagagctaaaacagaaaagagatgaagttaaatgtaaattggacaagagtgaagaaaattgtaacaatttaaggaaacaagttgaaaataaaaacaagtatattgaagaacttcagcaggagaataaggccttgaaaaaaaaaggtacagcagaaagcaagcaactgaatgtttatgagataaaggtcaataaattagagttagaactagaaagtgccaaacagaaatttggagaaatcacagacacctatcagaaagaaattgaggacaaaaagatatcagaagaaaatcttttggaagaggttgagaaagcaaaagtaatagctgatgaagcagtaaaattacagaaagaaattgataagcgatgtcaacataaaatagctgaaatggtagcacttatggaaaaacataagcaccaatatgataagatcattgaagaaagagactcagaattaggactttataagagcaaagaacaagaacagtcatcactgagagcatctttggagattgaactatccaatctcaaagctgaacttttgtctgttaagaagcaacttgaaatagaaagagaagagaaggaaaaactcaaaagagaggcaaaagaaaacacagctactcttaaagaaaaaaaagacaagaaaacacaaacatttttattggaaacacctgaaatttattggaaattggattctaaagcagttccttcacaaactgtatctcgaaatttcacatcagttgatcatggcatatccaaagataaaagagactatctgtggacatctgccaaaaatactttatctacaccattgccaaaggcatatacagtgaagacaccaacaaaaccaaaactacagcaaagagaaaacttgaatatacccattgaagaaagtaaaaaaaagagaaaaatggcctttgaatttgatattaattcagatagttcagaaactactgatcttttgagcatggtttcagaagaagagacattgaaaacactgtataggaacaataatccaccagcttctcatctttgtgtcaaaacaccaaaaaaggccccttcatctctaacaacccctggatctacactgaagtttggagctataagaaaaatgcgggaggaccgttgggctgtaattgctaaaatggatagaaaaaaaaaactaaaagaagctgaaaagttatttgtttaa

SEQ ID NO: 21053 - DNA, 3034 bp, Homo sapiens
  ENST00000613524
ccacgcgctccgggccgctcaggctgagcgatttcccgccttttctgaggttctgaggcgggagccattggttctttctgttgccctcatagaccgtatgtagcagttcgcgtgggcacagaacccacggtttcccgctagttcttcaaagtagatatttacaaccgtaacagagaaaatggaaaagcaaaagccctttgcattgttcgtaccaccgagatcaagcagcagtcaggtgtctgcggtgaaacctcagaccctgggaggcgattccactttcttcaagagtttcaacaaatgtactgaagatgattttgagtttccatttgcaaagactaatctctccaaaaatggggaaaacattgattcagatcctgctttacaaaaagttaatttcttgcccgtgcttgagcaggttggtaattctgactgtcactatcaggaaggactaaaagactctgatttggagaattcagagggattgagcagagtgtattcaaaactgtataaggaggctgaaaagataaaaaaatggaaagtaagtacagaagctgaactgagacagaaagaaagtaagttgcaagaaaacagaaagataattgaagcacagcgaaaagccattcaggaactgcaatttggaaatgaaaaagtaagtttgaaattagaagaaggaatacaagaaaataaagatttaataaaagagaataatgccacaaggcatttatgtaatctactcaaagaaacctgtgctagatctgcagaaaagacaaagaaatatgaatatgaacgggaagaaaccaggcaagtttatatggatctaaataataacattgagaaaatgataacagcttttgaggaacttcgtgtgcaagctgagaattccagactggaaatgcattttaagttaaaggaagattatgaaaaaatccaacaccttgaacaagaatacaagaaggaaataaatgacaaggaaaagcaggtatcactactattgatccaaatcactgagaaagaaaataaaatgaaagatttaacatttctgctagaggaatccagagataaagttaatcaattagaggaaaagacaaaattacagagtgaaaacttaaaacaatcaattgagaaacagcatcatttgactaaagaactagaagatattaaagtgtcattacaaagaagtgtgagtactcaaaaggctttagaggaagatttacagatagcaacaaaaacaatttgtcagctaactgaagaaaaagaaactcaaatggaagaatctaataaagctagagctgctcattcgtttgtggttactgaatttgaaactactgtctgcagcttggaagaattattgagaacagaacagcaaagattggaaaaaaatgaagatcaattgaaaatacttaccatggagcttcaaaagaaatcaagtgagctggaagagatgactaagcttacaaataacaaagaagtagaacttgaagaattgaaaaaagtcttgggagaaaaggaaacacttttatatgaaaataaacaatttgagaagattgctgaagaattaaaaggaacagaacaagaactaattggtcttctccaagccagagagaaagaagtacatgatttggaaatacagttaactgccattaccacaagtgaacagtattattcaaaagaggttaaagatctaaaaactgagcttgaaaacgagaagcttaagaatactgaattaacttcacactgcaacaagctttcactagaaaacaaagagctcacacaggaaacaagtgatatgaccctagaactcaagaatcagcaagaagatattaataataacaaaaagcaagaagaaaggatgttgaaacaaatagaaaatcttcaagaaacagaaacccaattaagaaatgaactagaatatgtgagagaagagctaaaacagaaaagagatgaagttaaatgtaaattggacaagagtgaagaaaattgtaacaatttaaggaaacaagttgaaaataaaaacaagtatattgaagaacttcagcaggagaataaggccttgaaaaaaaaaggtacagcagaaagcaagcaactgaatgtttatgagataaaggtcaataaattagagttagaactagaaagtgccaaacagaaatttggagaaatcacagacacctatcagaaagaaattgaggacaaaaagatatcagaagaaaatcttttggaagaggttgagaaagcaaaagtaatagctgatgaagcagtaaaattacagaaagaaattgataagcgatgtcaacataaaatagctgaaatggtagcacttatggaaaaacataagcaccaatatgataagatcattgaagaaagagactcagaattaggactttataagagcaaagaacaagaacagtcatcactgagagcatctttggaaaaactcaaaagagaggcaaaagaaaacacagctactcttaaagaaaaaaaagacaagaaaacacaaacatttttattggaaacacctgaaatttattggaaattggattctaaagcagttccttcacaaactgtatctcgaaatttcacatcagttgatcatggcatatccaaagataaaagagactatctgtggacatctgccaaaaatactttatctacaccattgccaaaggcatatacagtgaagacaccaacaaaaccaaaactacagcaaagagaaaacttgaatatacccattgaagaaagtaaaaaaaagagaaaaatggcctttgaatttgatattaattcagatagttcagaaactactgatcttttgagcatggtttcagaagaagagacattgaaaacactgtataggaacaataatccaccagcttctcatctttgtgtcaaaacaccaaaaaaggccccttcatctctaacaacccctggatctacactgaagtttggagctataagaaaaatgcgggaggaccgttgggctgtaattgctaaaatggatagaaaaaaaaaactaaaagaagctgaaaagttatttgtttaa

SEQ ID NO: 21054 - DNA, 3126 bp, Homo sapiens
  ENST00000358763
gctcccgggacccggagcggatcgactggcgggcgccgcgccgaggcaccaccgggcgccgagttcctggcggctcgcacgcaggtaaataaaggcagctaaagctgactgctggttgcgcaaaatccccctggctcttctggctaaagtcctaccactccctgtacctggcagcagcctgtcttctgggcctcacctacacacgtctgggtaggagccagtcatctccatccatccacagccatgaatttcctccggcgacgtctctctgacagcagcttcatggccaacctgcctaatggctatatgacggacctgcaacgcccagatagctccaccagctcacctgcttcccccgccatggagaggaggcacccccagcccctggctgcctccttctcctctccaggatccagcctttttagctccctctccagtgccatgaagcaggcccctcaggccacctcaggactgatggagcctccaggtccctccacgcccattgttcaaagacccaggatcctgttggtgatcgatgatgcccatacagactggtcgaagtatttccatgggaagaaggtgaatggagagattgagatccgagtggagcaggctgaattctcagagttgaacctagctgcctatgtgaccgggggctgcatggtggacatgcaggtcgtgagaaatgggaccaaagtggtgagcagatccttcaagccagacttcatcctggtccgccagcatgcctacagcatggccctgggggaagactaccgcagcctggtcatcggcctgcagtatggagggctgcctgctgtcaactctctctactccgtctacaacttctgcagcaagccctgggtgttctctcagctcattaagatcttccattccctgggtcctgagaagttcccgcttgtggagcaaacatttttccccaaccataagccaatggtcacagccccacacttcccggtggtagtcaagctgggacatgcccacgctggaatgggaaagatcaaagtggaaaaccagcttgacttccaggacatcaccagcgtggtcgccatggccaaaacctacgccaccaccgaggccttcatcgactccaagtacgacatccgcatccagaaaattggatccaactacaaggcttacatgagaacctccatctctgggaactggaaggccaacacaggctctgccatgctggagcaggtggccatgacagagaggtacaggctgtgggtggacagctgctcggaaatgtttggcggcctggacatctgtgccgtcaaggctgtccacagcaaggatggcagagattacatcatcgaggtaatggacagctcaatgccgctgattggagagcatgtggaagaggacagacagctgatggccgaccttgttgtctccaaaatgagccagctcccgatgccaggaggcacagcgccctcccccctcagaccttgggctccacagattaaatcagcgaaatccccagggcaagcccagctggggcctcagctaggccagccccagccacgcccacctccgcaaggaggccctcgccaagctcagtctcctcagccccagagatctggaagcccctcccaacagaggctctccccacaaggccagcagcccctgagcccccagtccggatctccacagcagcaaaggtcaccaggctctccgcagctatcccgggcatccagtggcagctccccaaaccaggcctccaagccaggtgccaccctcgcctcacagccccggccccctgtgcagggccgtagtacctcccagcagggtgaagagtccaagaagccagcaccaccccatccgcatctcaacaaatctcagtccctgactaacagcctcagcacatccgacacctcccagcgtgggaccccaagtgaagacgaggccaaggctgaaaccatccgcaacctgaggaagtcttttgccagcctgttctctgactaacgccatccaggctgggaggggaagagtgctctgctacactcgtccccctcctgcctcatcttccttctcagccttggttcctgatgggaacagaatggagggcctgagaacatactttctaaatgcctttgacccaggaaccgattatctatatttgttcccattttccttcaccgtgacattccagcattgtctgactgtgaggtgggcctttgagagcctccaggttcctcaaaacaggcctgagcgatgggcatcacaccctctgcctacccacgtgcctgcttacctgccagataaccaagtgagatgtctgcgagtggctagttttcacattcttactagtgtttggctcacctttgggcaaaggccccctctaggccttgccccacctccatcaaacgcagacactgtagtcagacctcagcaatataggaggcaataatcttttaacagtgttttgcaaacaaacaaaaagagaaaaatcccagccaggggaactcgccacctgcccacgctagttccatccacgctcaagacccgcccttagaccaggcaggcaaaggcccccatcacactcggccactagtggggtcctgaggccaagaaagaaaccagaccctgtatgacaagtggggtctttcagaacacgacagaaacaggggggcccttgtaatgccactcatactcagagcattattcttatttggacagccaagggcagatcacaggttattgtaggaataaagactagtttacaaaggagaaagaggccctggacttcccaaggaaagggtcaggttagggctcctgtacccattctgttccaccactgtttgatctctctggcctcccaccaggaatgccgtttcctttttatggatctgttgggaaccagagagaatcaacagatcaatgacataggatccgaagtgcaatgatagtcacttctagtttggcatttcacaaactctgtacagcaaggtattggtaggttactcaatttcaaaagggccccatggccaaatatgtttaggaaccgctgtttgtatttctttttttggagacgcattgtatataatatatgtcaaaggctttcggaattcctgcaggaaagaaatcagctttgttaaatccaaa

SEQ ID NO: 21055 - DNA, 827 bp, Homo sapiens
  ENST00000483062
gtgatgcccaaccgccatctctcctggcatgggggtccctcagctctcccttcctccccacaggtaatggacagctcaatgccgctgattggagagcatgtggaagaggacagacagctgatggccgaccttgttgtctccaaaatgagccagctcccgatgccaggaggcacagcgccctcccccctcagaccttgggctccacagattaaatcagcgaaatccccagggcaagcccagctggggcctcagctaggccagccccagccacgcccacctccgcaaggaggccctcgccaagctcagtctcctcagccccagagatctggaagcccctcccaacagaggctctccccacaaggccagcagcccctgagcccccagtccggatctccacagcagcaaaggtcaccaggctctccgcagctatcccgggcatccagtggcagctccccaaaccaggcctccaagccaggtgccaccctcgcctcacagccccggccccctgtgcagggccgtagtacctcccagcagggtgaagagtccaagaagccagcaccaccccatccgcatctcaacaaatctcagtccctgactaacagcctcagcacatccgacacctcccagcgtgggaccccaagtgaagacgaggccaaggctgaaaccatccgcaacctgaggaagtcttttgccagcctgttctctgactaacgccatccaggctgggaggggaagagtgctctgctacactcgtccccctcctgcctcatcttccttctcagccttggttcctgatgggaacagaatggagggcctgagaacatact

SEQ ID NO: 21056 - DNA, 742 bp, Homo sapiens
  ENST00000467095
cttgattgttgggggccttggaattctactcaaagtcatttctgggtggctacaacatccccaagcttagatgcctcttggcttgcttgtggaagcctgtgtgccctgtacggtgagagggagaaaccaagattctctttgagctttctgtggctcctcttccaactgggaaaccttaataagactcagtctccacctctatgtggtgagaagaatggtatcttccctactgacctctctaggtcaagtgatatgttgcttttgaaagttcttggaaaagtttagagagcaactcaaaaagaggccctcgccaagctcagtctcctcagccccagagatctggaagcccctcccaacagaggctctccccacaaggccagcagcccctgagcccccagtccggatctccacagcagcaaaggtcaccaggctctccgcagctatcccgggcatccagtggcagctccccaaaccaggcctccaagccaggtgccaccctcgcctcacagccccggccccctgtgcagggccgtagtacctcccagcagggtgaagagtccaagaagccagcaccaccccatccgcatctcaacaaatctcagtccctgactaacagcctcagcacatccgacacctcccagcgtgggaccccaagtgaagacgaggccaaggctgaaaccatccgcaacctgaggaagtcttttgccagcctgttctctgactaacgccatccaggctggga

SEQ ID NO: 21057 - DNA, 713 bp, Homo sapiens
  ENST00000461446
acttctgggatgtgatgcccaaccgccatctctcctggcatgggggtccctcagctctcccttcctccccacaggtaatggacagctcaatgccgctgattggagagcatgtggaagaggacagacagctgatggccgaccttgttgtctccaaaatgagccagctcccgatgccaggaggcacagcgccctcccccctcagaccttgggaggccctcgccaagctcagtctcctcagccccagagatctggaagcccctcccaacagaggctctccccacaaggccagcagcccctgagcccccagtccggatctccacagcagcaaaggtcaccaggctctccgcagctatcccgggcatccagtggcagctccccaaaccaggcctccaagccaggtgccaccctcgcctcacagccccggccccctgtgcagggccgtagtacctcccagcagggtgaagagtccaagaagccagcaccaccccatccgcatctcaagtctgttgcctcccctcctatgactgagcctcctgaggcagggcctgaatcatattcgtcttacacccctgtcccctagcacaggggaagtgctcagcaagcagttgctacaggctggcatttaggaagcactcagaatggcatctgccattcaaaaagatggcactaaaagaattccaaaagcgggtgggggacagaattagccataaaga

SEQ ID NO: 21058 - DNA, 574 bp, Homo sapiens
  ENST00000459990
gtcttattcctccactaaacaggtgtctgtggagggcacacctgcttagcaggacacggggcccattcctaaccttgggggctcccagtctggtggtggagacatagtaagcaaggggtgacagtgccgtggataagctgtcccgtgtgaaaccaggtaatggacagctcaatgccgctgattggagagcatgtggaagaggacagacagctgatggccgaccttgttgtctccaaaatgagccagctcccgatgccaggaggcacagcgccctcccccctcagaccttgggaggccctcgccaagctcagtctcctcagccccagagatctggaagcccctcccaacagaggctctccccacaaggccagcagcccctgagcccccagtccggatctccacagcagcaaaggtcaccaggctctccgcagctatcccgggcatccagtggcagctccccaaaccaggcctccaagccaggtgccaccctcgcctcacagccccggccccctgtgcagggccgtagtacctcccagcagggtgaagagtccaagaagccagcaccaccccatcc

SEQ ID NO: 21059 - DNA, 507 bp, Homo sapiens
  ENST00000468922
ctaaacaggtgtctgtggagggcacacctgcttagcaggacacggggcccattcctaaccttgggggctcccagtctggtggtggagacatagtaagcaaggggtgacagtgccgtggataagctgtcccgtgtgaaaccaggtaatggacagctcaatgccgctgattggagagcatgtggaagaggacagacagctgatggccgaccttgttgtctccaaaatgagccagctcccgatgccaggaggcacagcgccctcccccctcagaccttgggctccacagattaaatcagcgaaatccccagggcaagcccagctggggcctcagctaggccagccccagccacgcccacctccgcaaggaggccctcgccaagctcagtctcctcagccccagagatctggaagcccctcccaacagaggctctccccacaaggccagcagcccctgagcccccagtccggatctccacagcagcaaaggtcaccaggctctccgcagct

SEQ ID NO: 21060 - DNA, 488 bp, Homo sapiens
  ENST00000462268
ctggtccgccagcatgcctacagcatggccctgggggaagactaccgcagcctggtcatcggcctgcagtatggagggctgcctgctgtcaactctctctactccgtctacaacttctgcagcaagccctgggtgttctctcagctcattaagatcttccattccctgggtcctgagaagttcccgcttgtggagcaaacatttttccccaaccataagccaatggtctcaccctccttaccctagtcctggccctgatcatccagctctgttcccctccagggtacatgctcttaaccaccccactatgtggcctctcccagtcaagggcaccatcaggattcaaagagctttgaaggaggtgacttatactgggagctggacgagaaggaagattgcaaagaggctcccaggggatggctctggcaaaatacaaagaaaaaagtttataaagcgtttaaataaacctgtgaaagacaagaaagata

SEQ ID NO: 21061 - DNA, 523 bp, Homo sapiens
  ENST00000467824
taccgcagcctggtcatcggcctgcagtatggagggctgcctgctgtcaactctctctactccgtctacaacttctgcagcaagccctgggtgttctctcagctcattaagatcttccattccctgggtcctgagaagttcccgcttgtggagcaaacatttttccccaaccataagccaatggtgagtgcccttttttactctgtttctttgcatgatgcggaatgaatacagatgacttgtcctcggtctctttggatggaggaggtggactctaggggttgtacactgaccacgcagactctaaggcggagtcacagtgtcctgtgggagtgcctggatttcctaagggaagtcgtctctccaggtgaaattcaggcaatagggcaaataacaaaggtgaaccacattccttggaacttggagattttcagcaaatcaggggacacgttctgggggcatgttagaaccagaggctgattataaaggtaaaagatgttttcaaggtgggatgttgttttac

SEQ ID NO: 21062 - DNA, 595 bp, Homo sapiens
  ENST00000472027
acctgtgcttttgttcctggaaacttaggttgagcctttcccctgctctctgcctgaaaacatcctccttgtcacagtctggaggccctggcaatgcagtttcagaaggctgaattctcagagttgaacctagctgcctatgtgaccgggggctgcatggtggacatgcaggtcgtgagaaatgggaccaaagtggtgaggtaagtaggattaaaatatgcagaaccttctgagaattgcatacgtggaacctcatgtagcccacccctccgtccacttcctgcgacctaactcctttgccacatgtactttcctgtacagaatgtctgcttcccaggtgtggttgcagtagtaatgaccagcggcacatatcatacgtgcagcacctgtggtgtccccaagtgagccctgggcttggagagaaaagacttgggttccatttctggctttgaggctctgctctggcatattatttagtcccttttgtcctctacttctcatctgcagcatgatgatatgcactgaagttagaggctgctaaagtttacagaaactcacatgtatgacagcaccctgttaactctgaagtgcggta

SEQ ID NO: 21063 - DNA, 855 bp, Homo sapiens
  ENST00000441821
ttgggtttgggaggtcaggtttgtcatgccatttccgatttccagtcatcctgggggcaggatgaaatttcagagtggtttcctggccaagctagaagcagagaatagctatggatacagcacctcgtgtatctatccagcacttacttggctttttctgagtgccaggaactgtgccaagccctagcagcatgaagaatggcctttggggagcttctggggctaagagggacagtaggaggagcaattgcagtgcagggtagtgcggaagactcgagatggagaagaggacggtgaggaagccaggaaggtttcagagaggagcaggtaaataaaggcagctaaagctgactgctggttgcgcaaaatccccctggctcttctggctaaagtcctaccactccctgtacctggcagcagcctgtcttctgggcctcacctacacacgtctgggtaggagccagtcatctccatccatccacagccatgaatttcctccggcgacgtctctctgacagcagcttcatggccaacctgcctaatggctatatgacggacctgcaacgcccagatagctccaccagctcacctgcttcccccgccatggagaggaggcacccccagcccctggctgcctccttctcctctccaggatccagcctttttagctccctctccagtgccatgaagcaggcccctcaggccacctcaggactgatggagcctccaggtccctccacgcccattgttcaaagacccaggatcctgttggtgatcgatgatgcccatacagactggtcgaagtatttccatgggaagaaggtgaatggagagattgagatccgagtggagcag

SEQ ID NO: 21064 - DNA, 632 bp, Homo sapiens
  ENST00000412575
ggattacaggcgtgagccaccctgtccggcgggaatgtaaattaatacggccattatggaaaacggcatggaggttcctcagaaaactaaaaatagaactaccatatgatccagcaggctcacttctggcaggtaaataaaggcagctaaagctgactgctggttgcgcaaaatccccctggctcttctggctaaagtcctaccactccctgtacctggcagcagcctgtcttctgggcctcacctacacacgtctgggtaggagccagtcatctccatccatccacagccatgaatttcctccggcgacgtctctctgacagcagcttcatggccaacctgcctaatggctatatgacggacctgcaacgcccagatagctccaccagctcacctgcttcccccgccatggagaggaggcacccccagcccctggctgcctccttctcctctccaggatccagcctttttagctccctctccagtgccatgaagcaggcccctcaggccacctcaggactgatggagcctccaggtccctccacgcccattgttcaaagacccaggatcctgttggtgatcgatgatgcccatacagactggtcgaagtatttccatgggaagaaggtgaa

SEQ ID NO: 21065 - DNA, 561 bp, Homo sapiens
  ENST00000619146
cagatcaaagtggaaaaccagcttgacttccaggacatcaccagcgtggtcgccatggccaaaacctacgccaccaccgaggccttcatcgactccaagtacgacatccgcatccagaaaattggatccaactacaaggcttacatgagaacctccatctctgggaactggaaggccaacacaggctctgccatgctggagcaggtggccatgacagagaggtacaggctgtgggtggacagctgctcggaaatgtttggcggcctggacatctgtgccgtcaaggctgtccacagcaaggatggcagagattacatcatcgaggtaatggacagctcaatgccgctgattggagagcatgtggaagaggacagacagctgatggccgaccttgttgtctccaaaatgagccagctcccgatgccaggaggcacagcgccctcccccctcagaccttgggctccacagattaaatcagcgaaatccccagggcaagcccagctggggcctcagctaggccagccccagccacgcccacctccgcaagggaatgtcccacct

SEQ ID NO: 21066 - DNA, 972 bp, Homo sapiens
  ENST00000332840
cagatcaaagtggaaaaccagcttgacttccaggacatcaccagcgtggtcgccatggccaaaacctacgccaccaccgaggccttcatcgactccaagtacgacatccgcatccagaaaattggatccaactacaaggcttacatgagaacctccatctctgggaactggaaggccaacacaggctctgccatgctggagcaggtggccatgacagagaggtacaggctgtgggtggacagctgctcggaaatgtttggcggcctggacatctgtgccgtcaaggctgtccacagcaaggatggcagagattacatcatcgaggtaatggacagctcaatgccgctgattggagagcatgtggaagaggacagacagctgatggccgaccttgttgtctccaaaatgagccagctcccgatgccaggaggcacagcgccctcccccctcagaccttgggctccacagattaaatcagcgaaatccccagggcaagcccagctggggcctcagctaggccagccccagccacgcccacctccgcaaggaggccctcgccaagctcagtctcctcagccccagagatctggaagcccctcccaacagaggctctccccacaaggccagcagcccctgagcccccagtccggatctccacagcagcaaaggtcaccaggctctccgcagctatcccgggcatccagtggcagctccccaaaccaggcctccaagccaggtgccaccctcgcctcacagccccggccccctgtgcagggccgtagtacctcccagcagggtgaagagtccaagaagccagcaccaccccatccgcatctcaacaaatctcagtccctgactaacagcctcagcacatccgacacctcccagcgtgggaccccaagtgaagacgaggccaaggctgaaaccatccgcaacctgaggaagtcttttgccagcctgttctctgactaa

SEQ ID NO: 21067 - DNA, 2522 bp, Homo sapiens
  ENST00000376862
agacactggccgcgggccaccatctggacgcgatcccccgctagggcctccctggtctgggccaaagttggtggccaccttcgcgcgggctgcgccctccttctcttccctgccctcctcccccggggcccgcgcccgctgcctccagcacgcgcgtcggcaggctcggcaagcgaagaggagcggctcgccccagggcgcccctcgcccagcctgccggccaggcgagcgcgacgagagtctccccgcaccccttcctctcccgggggccgagagggttgggctccgccccggcgccgcagctcccgactccccgccgctcgggctgccgccgctgccccgcgcccggcgctcggggcagccgggggcgcaggcggagagcgcagggcggggagaggcgtggggagcagagcggcgctgaggggagggcagaggaggagagagcctggcagcggaggagcagaggcgggcgccgcaccgccccgcacgctcgctcgctcgggagagtcgcgggcggccgcttgggcgcacttgccgggtcaccttgtcccggaggagaaatggcttccctgaggcaagtgtaacctacattcccagcccaccagcctgacgcccagccagggagagagtaccatggatggcatcattgaacagaagagcatgctggtgcacagtaaaatcagtgatgctggcaagaggaatggtttaattaacaccagaaacttgatggccgagagcagagatggtctggtgtctgtttacccagcgccccagtaccagagccaccgggtgggggccagcacagtgccggccagcctggacagcagcaggagtgagccgatgcagcagctgctggaccccaacaccctgcagcagtcagtggagtcccgctaccggcccaacatcatcctctattcagagggcgtgctgcgctcctggggggacggtgtggccgccgactgctgcgagaccaccttcatcgaggaccggtcgcccaccaaagacagcctcgagtacccggatgggaagttcattgacctctcagctgatgacataaaaatccacaccctgtcctacgatgtggaggaggaggaggagttccaggagctggagagcgactactcaagcgacacagagagtgaggacaatttcctcatgatgcccccgcgggaccacctgggcctcagtgtcttctccatgctctgctgcttctggcctctgggcatcgcagccttctacttgtcccatgagaccaacaaagccgtggccaagggggacttgcaccaggccagcaccagctcccggcgggccctattcctggcagtgctgtccatcaccattgggactggcgtctatgtgggcgtggccgtggccctcatcgcctacctctccaagaacaaccacctgtgagcttcctgcgaatggagggggagcacccggggccaggtctgtgtggacgtggaggaagcaggcataccgcatgatgctgtacagtacaaatgattgccaaatgatgccacgaagccctgggatttcctacccatggatttattttgtttttatcctttaatttcatgttcacagcactgtgtagagcaccagacagacgggcactgctaatccttccaaaggaaagctccaaagatcccagcccgcaaggctgtctctggatggattctggtggatgaatggcaacgcggctctctgcagcctgccagtgcccagagtgccaccgcattagcaatatacaaacagtccaaaaaagtgtttattttttatggaatacggtgcaataggcagaggacaagggacacatcactcttctgtctgtggccctgctggagtcctttgtgccccccggagtccacacgccttccctgcaagacgagaatggggctgggaagaaagaggcaacaccacggctggcaggagccccgctgcactgctctgcagacccattggcctgaccctgagaagcagagccagcaaagcccgggacctgcccctctttctttcccttcacaccaccccagcctcaggatgtcaagccacctccggaacgtgtctacactccacagctaccccgcagcaatacgcactcttgggacctcgctgatctaggatggggaggcaggccaccgcccctcccaagactcctcaagaaagagccccgcggttgctccggaaactcgaggcactgcagctatgggcactgcctcagcctaaagacacaggggcgcctcccaatcaccgcgctggcggatgctcaccccgtcataagcagaaactagtgatcctggaaatgagatgggccttactctgtcgactaaatgaatagctattttcttgtcattttttaaagtgcaactcttgcttcatgctgcttaagttaccagatgaatgctgagaaataagtaatcacagacattttaataccatttcattgctgttttacgagtgttcattacttaacaaaaaattatcttttagctttttcgcttaagacttttctttctgatgaa

SEQ ID NO: 21068 - DNA, 417 bp, Homo sapiens
  ENST00000482637
tgcccccgcgggaccacctgggcctcagtgtcttctccatgctctgctgcttctggcctctgggcatcgcagccttctacttgtcccatgagtccctttcagatcgattcattggccgtcgactggacacctgccacgttcgcgtgtttagtcccattggattcaacggatatcactggtcacacagcatcctccttactcaggcatttgcagcctgtgtagatggtaaaggggggcacaccccttgctggtgggacgcaaagaggctctgagtgctgaggaggggggagtgcagtaccctgggtgtgcggaaggccgtctgaccctgtcttccactgggagtccatgaacagatttctctctgaattccctcctccttccttcccctcgtgtccttttccatggtcctcttccaga

SEQ ID NO: 21069 - DNA, 2420 bp, Homo sapiens
  ENST00000554823
gacaggctctgaggactgctcagctggcccaggcccccctccccagcagctgccccagaaccatggagagtctgagtgaactacagaacccgctgctgcccaggagccctgcccatctccatggcccctatccctacccggagaccccacccagctggtcctgccaggaaaagctctactcctacctcctaggtggcgctgggcctgccggagcccaccagctcctggacccagggtccctgcagctggccgtggaggcctggtaccggcccagctgcctcctggggagagacaaggtcaaggagcccagggcaggcagctgtgagacaagcttcacagaggacagggagccccaggaggggcctccagagcagcccacaggacctggccaagctgcagagaatgtcaccatccagactgtgtcctatggggtacaagaggagctgcgggaccaggaggatgaccaggaggaagaggagagcgatgccacttcaacggagagtgaaagtgaagacaacttcctcacgctgcctcccagggaccacctgggacttactctcttctccatgctctgctgcttctggccactgggcattgctgccttctacttctcccaggggaccagcaaggccatctccaaaggggacttccgcctggccagcaccacctcccgccgggccctcttcctagccacactcgccatcgccgtgggggccggtctctacgtggctgtggtggtggctctggcagcttacatgtcccagaacggtcatggctagtagccagtagggcctgcatcctgactcccctgcccacctgaggaagcagtggggcttggagttgcagaccctatggaaaggcccggcccctgaagatgatcccgtgagagtggcttgctgagggggagacccccattccacagcctgcagagctcagccttcacttctgcttgcccgctgctcccagccccagagcagggcccggggcgccactctctaacccaggctacagacgggaaacagaaggcagggctgcccaccaggccatcccagcagggcctagctccatccattctgcccattccctagaggatctcctgccctacagccagcccaccacctaccctgccaacctccccacagagaaagagcaggaggttacagggagaaaagggggtgcccagagcacaaggggacccgtcccaatcctttcagcccacagggatcttcacctggggacagcctgagcttcccccaactccactgtctggccccatcatgcccagacctcagcaggccaagaaggaaatacgtggaggcaagggggcctcttgctgtctctgattctagagggtgcttatctctgcatgggcttgtgaggcactgtagattctagatagggaagaggagcctcggtatgtaaactctgaaccaagggcaggttcttggagcttcttcatgcgggtgcaaaaggcagttgcaatgacagagaatagagggtcctgaaatattgctgtactacatgactcttcctactctccccccactccccgcccctatcatccttttctgggctttgcctgggggtccgtgagctggtgccatcacaagtagactagacccagagagtgccctcagctcaccagccactgagcgcacggccctaggtccagccctacagaaaacgcagcaaggagagaccctagggagtagtgagtatagatgagggaagggactcagggaaggaatggcctgctgagtagtcagcggtgcttaggaaggcttcctggaggaggtatcccttgagcaagtcctaggatgaatagaattcatctaagggatttggtcacataactctttgtatttgtaggcagggatgtggcaggaaccttccatgggaagcttccaggctgtttggattctgcctggaacatctgggctggagccaaactacagccattcctaagggttctgccaactcaaggaggaacgtcacacctgtctctcaaagaccaatgatgttttcccatctctgaatgctagggggtcagtggtgggtacctggttacccctggggcatcttcactgatatctctgctcagtgccagtctcaacaccctcagccactagggcacatccagaattttagagacatctccaggtaggcggggggcagcaccaatgtgggcaggcctgtctggactcaagctacaggcccctgctgtgcatgatgtgggaacctggtcattcccatgccccatccagagcccagggctgtggctccaccactgagcatcccttgtcccactgtcctcccctgcctcgggcactgcccagccctccactcctgcatcacagcagttttaaggtcccattattgtactgatttatccttgtaataaatgtttctgtaacacctgg

SEQ ID NO: 21070 - DNA, 488 bp, Homo sapiens
  ENST00000554953
ggcggcggcgggctgcgggcgggagctgtccgcggtgctgaagcggcggctgctcagggacgcggggacgagagcaggggagccctcctgggagttccaccgcgaccgcgaggcgggggcgccgtcgctcaccggcccatgccgagcccccgagccccgcggaggaggcgggaccgtccgcggcgggacaggctctgaggactgctcagctggcccaggcccccctccccagcagctgccccagaaccatggagagtctgagtgaactacagaacccgctgctgcccaggagccctgcccatctccatggcccctatccctacccggagaccccacccagctggtcctgccaggaaaagctctactcctacctcctaggtggcgctgggcctgccggagcccaccagctcctggacccagggtccctgcagctggccgtggaggcctggtaccggcccagctgcctcctggggagagacaaggtcaag

SEQ ID NO: 21071 - DNA, 2607 bp, Homo sapiens
  ENST00000331628
ggcggcggcgggctgcgggcgggagctgtccgcggtgctgaagcggcggctgctcagggacgcggggacgagagcaggggagccctcctgggagttccaccgcgaccgcgaggcgggggcgccgtcgctcaccggcccatgccgagcccccgagccccgcggaggaggcgggaccgtccgcggcgggacaggctctgaggactgctcagctggcccaggcccccctccccagcagctgccccagaaccatggagagtctgagtgaactacagaacccgctgctgcccaggagccctgcccatctccatggcccctatccctacccggagaccccacccagctggtcctgccaggaaaagctctactcctacctcctaggtggcgctgggcctgccggagcccaccagctcctggacccagggtccctgcagctggccgtggaggcctggtaccggcccagctgcctcctggggagagacaaggtcaaggagcccagggcaggcagctgtgagacaagcttcacagaggacagggagccccaggaggggcctccagagcagcccacaggacctggccaagctgcagagaatgtcaccatccagactgtgtcctatggggtacaagaggagctgcgggaccaggaggatgaccaggaggaagaggagagcgatgccacttcaacggagagtgaaagtgaagacaacttcctcacgctgcctcccagggaccacctgggacttactctcttctccatgctctgctgcttctggccactgggcattgctgccttctacttctcccaggggaccagcaaggccatctccaaaggggacttccgcctggccagcaccacctcccgccgggccctcttcctagccacactcgccatcgccgtgggggccggtctctacgtggctgtggtggtggctctggcagcttacatgtcccagaacggtcatggctagtagccagtagggcctgcatcctgactcccctgcccacctgaggaagcagtggggcttggagttgcagaccctatggaaaggcccggcccctgaagatgatcccgtgagagtggcttgctgagggggagacccccattccacagcctgcagagctcagccttcacttctgcttgcccgctgctcccagccccagagcagggcccggggcgccactctctaacccaggctacagacgggaaacagaaggcagggctgcccaccaggccatcccagcagggcctagctccatccattctgcccattccctagaggatctcctgccctacagccagcccaccacctaccctgccaacctccccacagagaaagagcaggaggttacagggagaaaagggggtgcccagagcacaaggggacccgtcccaatcctttcagcccacagggatcttcacctggggacagcctgagcttcccccaactccactgtctggccccatcatgcccagacctcagcaggccaagaaggaaatacgtggaggcaagggggcctcttgctgtctctgattctagagggtgcttatctctgcatgggcttgtgaggcactgtagattctagatagggaagaggagcctcggtatgtaaactctgaaccaagggcaggttcttggagcttcttcatgcgggtgcaaaaggcagttgcaatgacagagaatagagggtcctgaaatattgctgtactacatgactcttcctactctccccccactccccgcccctatcatccttttctgggctttgcctgggggtccgtgagctggtgccatcacaagtagactagacccagagagtgccctcagctcaccagccactgagcgcacggccctaggtccagccctacagaaaacgcagcaaggagagaccctagggagtagtgagtatagatgagggaagggactcagggaaggaatggcctgctgagtagtcagcggtgcttaggaaggcttcctggaggaggtatcccttgagcaagtcctaggatgaatagaattcatctaagggatttggtcacataactctttgtatttgtaggcagggatgtggcaggaaccttccatgggaagcttccaggctgtttggattctgcctggaacatctgggctggagccaaactacagccattcctaagggttctgccaactcaaggaggaacgtcacacctgtctctcaaagaccaatgatgttttcccatctctgaatgctagggggtcagtggtgggtacctggttacccctggggcatcttcactgatatctctgctcagtgccagtctcaacaccctcagccactagggcacatccagaattttagagacatctccaggtaggcggggggcagcaccaatgtgggcaggcctgtctggactcaagctacaggcccctgctgtgcatgatgtgggaacctggtcattcccatgccccatccagagcccagggctgtggctccaccactgagcatcccttgtcccactgtcctcccctgcctcgggcactgcccagccctccactcctgcatcacagcagttttaaggtcccattattgtactgatttatccttgtaataaatgtttctgtaacacctggt

SEQ ID NO: 21072 - DNA, 7378 bp, Homo sapiens
  ENST00000355585
gcggggagctgtcgcgggcagcgcgccctcgggaggacgtggccccggcccccgcccgcagtgggcccgaccctcatggccctgagcaaagggctgcggctgctggggcgcctgggggccgagggggactgtagcgtgctgctggaggcgcgcggccgcgacgactgcctgctgttcgaggccggcacggtggccacgctggctccagaagaaaaggaagtcattaaaggacagtatggcaagctcacggacgcgtacggctgcctgggggagctgaggctgaaatctggtggcacgtctctgagcttcctggtgttggtgacaggctgcacatctgtgggcagaattccagatgctgaaatctacaaaatcactgccactgacttttaccctcttcaggaagaggccaaggaggaggaacgcctcatagctttgaagaaaatcctcagctcgggggtgttctatttctcatggccaaacgatgggtctcgctttgacctgactgtccgcacgcagaagcagggggatgacagctctgaatgggggaactccttcttctggaaccagctgttgcacgtgcccttgaggcagcaccaggtgagctgctgtgactggctgctgaagatcatctgcggggtggtcaccatccgcaccgtgtatgcctcccacaagcaggccaaggcctgcctcgtctctcgcgttagctgtgagcgcacaggcactcgcttccacacccgtggcgtgaacgacgacggccatgtgtccaacttcgtggagacagagcagatgatttacatggacgatggagtgtcatcttttgtccagatcagaggctccgttccgctgttctgggaacagccagggcttcaggttggctcccatcatctgagactccacagaggcctggaagccaatgcccctgctttcgacaggcacatggtgcttctgaaggagcagtacgggcagcaggtggtcgtgaaccttctgggaagcagaggcggagaggaggtgctcaacagagccttcaagaagctgctctgggcttcttgccacgcgggcgacacgcctatgatcaattttgacttccatcagtttgccaaaggtgggaagctagagaaattggagaccctcttgaggccacagttaaagctgcactgggaagacttcgatgtgttcacaaagggggagaacgtcagtccacgttttcagaaaggcactttgcggatgaactgtcttgactgcctggaccgaaccaacactgtgcagagcttcatcgcgctcgaggtcctgcatctgcagctcaagaccctggggctgagttcaaaacccatcgttgaccgctttgtggagtccttcaaagccatgtggtctctgaatggccacagcctgagcaaggtgttcacaggcagcagagccctggaagggaaggccaaggtggggaagctgaaggatggagcccggtccatgtctcgaaccatccagtccaacttcttcgacggggtgaagcaggaggccatcaagctgctgctggttggggacgtctacggcgaggaggtggcagacaaagggggcatgctgctggacagcacggcgctcctggtgactcccaggatcctgaaagctatgactgagcgtcagtccgaattcacaaatttcaagcggatccggattgctatggggacctggaacgtgaacggaggaaagcagttccggagcaacgtgctcaggacggcggagctgacagactggctgctcgactcgccccagctctcgggagctaccgactcccaggatgacagcagcccagctgacatatttgctgtggggtttgaagagatggtggaattgagcgcagggaatattgtcaatgccagtactaccaacaagaagatgtggggtgaacagcttcagaaagccatctcacgctctcatagatacattctgttgacttcggcacagctggtgggcgtctgtctttatatctttgtacgtccataccatgtcccgttcatcagggacgtagccatcgacacagtgaagacgggcatggggggcaaggcggggaacaagggcgccgtcggcatccgcttccagttccacagcaccagcttctgcttcatatgtagtcacctgacggccgggcagtcccaggtgaaggagcggaatgaagactacaaggagatcacccagaaactctgcttcccaatggggagaaatgttttttctcatgattatgtattttggtgtggcgatttcaactaccgcattgatcttacttatgaagaagtcttctattttgttaaacgccaagactggaagaaacttctggaatttgatcaactacagctacagaaatcaagtggaaaaatttttaaggactttcacgaaggagccattaactttggacccacctacaagtatgacgttggctcagccgcctacgatacaagcgacaaatgccgcacccccgcctggacagacagggtgctgtggtggaggaagaaacatccctttgataaaacagctggagaactcaaccttctagacagtgatctagatgttgacaccaaagtcagacacacctggtctcctggtgccctgcagtattatggtcgtgcggagctacaagcgtctgatcacagacctgtgctggcgatcgtggaggtggaagttcaggaagtcgatgtgggtgctcgggagagggttttccaggaagtgtcctccttccagggccccctggatgccactgttgtagtaaaccttcaatcaccgaccttagaagagaaaaacgagtttccagaggacctgcgtactgagctcatgcagaccttggggagttatgggacaattgttcttgtcaggatcaaccaagggcagatgctggtaacttttgcagacagtcactcggctctcagtgtcctggacgtggacggtatgaaggtgaaaggcagagcagtgaagattagaccgaagaccaaggactggctgaaaggtttgcgagaggagatcattcggaaacgagacagcatggcccccgtgtctcccactgccaactcctgtttgctggaggaaaactttgacttcacaagtttggactatgagtcagaaggggatattcttgaagacgatgaagactacttggtggatgaattcaatcagcctggagtctcggacagtgaactcgggggagacgacctctctgatgtccccggccccacagcactggctcctcccagcaagtcacctgctctcaccaaaaagaagcagcatccaacgtacaaagatgacgcggacctggtggagctcaagcgggagctggaagccgtcggggagttccgccaccgttctccgagcaggtctctgtcggtccccaaccggcctcggccacctcaacccccgcagagacccccccctccaaccggtttaatggtgaaaaagtcggcttcagatgcgtccatctcctccggcacccatggacagtattcaattttgcagacggcaagacttctaccaggagcacctcagcaacctcccaaggctcggactggaataagtaaaccttataatgtcaagcagatcaaaaccaccaatgcccaggaggcagaagcagcaatccggtgtctcctggaagccagaggaggtgcctccgaagaagccctaagtgccgtggccccaagggaccttgaagcatcctctgaaccagagcccacaccgggggcagccaaaccagagaccccacaggcgcccccactccttccccgtcggcccccacccagagttcctgccatcaagaagccaaccttgagaaggacaggaaagcccctgtcaccggaagaacagtttgagcaacagactgtccattttacaatcgggcccccggagacaagcgttgaggcccctcctgtcgtgacagcccctcgagtccctcctgttcccaaaccaagaacatttcagcctgggaaagctgcagagaggccaagccacaggaagccagcatcagacgaagcccctcctggggcaggagcctctgtgccaccacctctggaggcgccgcctcttgtgcccaaggtacccccgaggaggaagaagtcagcccccgcagccttccacctgcaggtcctgcagagcaacagccagcttctccagggcctcacttacaatagcagtgacagcccctctgggcacccacctgccgcgggcaccgtcttcccacaaggggactttctcagcacttcatctgctacaagccccgacagcgatggcaccaaagcgatgaagccagaggcagccccacttcttggtgattatcaggaccccttctggaaccttcttcaccaccctaaactgttgaataacacttggctttctaagagctcagaccctttggactcaggaaccaggagccccaaaagagatcccatagacccagtgtcagctggcgcttcagctgccaaggcagagctgccaccagatcatgaacacaaaaccttaggtcactgggtgacaatcagtgaccaagaaaagaggacagcactgcaggtgtttgacccactggcaaaaacatgactgagcagctttgaaggctgcagtcctatagaatgcataccttcctccctctagacatccctccaccagaagagacatctatttaaaggcacactggccaaaacgtttgtgcatctgtcactctcgtgtagtttacaaaaatcgtgtctcttattcagtaagatggttactcagccaccaaaatatatttcactcaaggcttgtacatctgaagtttgctcttcaaggaatgggaaccttcctgttaaattcggtgtatggattttaagaaaggaatctagccaatgaggtccaagaagttctcacccattgaatttttaaatggctgttcagttcatgttgtacgtgatggagatttgtcttttgttttatttgcattttacagatttggtataacattttggggagccacctgaaggttgatgtataaagtaaggattagagaaagaggtcgttgtgaccattagtagctgtcctggcccacttaaacaaggttacaaaaaatcagagtcggaagcagccaaataggtcaacctaatgactagactgtacattcccatgagccttcatgtttaagtgtgtacatgtgcgttaaccttgatgatgcgtgaatcccgagggagccggtggcatacaccgttagcttaaccttagcttaaactagctgaaggctcctgtgccatgtcttagacattgcatgccctatcaattactataatcctgagccatggtgtgctactgaaaccaatttttatccaccatctagtccttattaaatgaaacctcacggatcctttgttccgcttatattccatgcataccacataaaagcacacagtgcgaaaactcttgctgatacgcgatattgattctcattgttagaatatggagagtgtttcagcctcgtctgtccggctggagcttcgggatggaaagtgctatgtgtccctgcatataagaatcaccaggccagtgtttctgggtttgcttgtctatatgtttgtctatattttttgcctatacatttttcccacgtttccaacagcacttctcacctattcaataactgaaaaagacattaccatagtgctttacatttttaaagtaatgttacaaggtctggaatccatttggagcagataccgtgttttcgctatttaataagaagttcagtagtgaaatcttactgtaccgcctgttgtatctgggagcctcgtacagaggctcgcacagcagtgatcaagtgtcatcccttacgtgactgggggatgtctgtcctaaaagctgactgctaggatagtaaggatcatcttgcctgggctatgccactgtcttgttaccaattagacatctggaatttcataattagttttcattgtcactgtcaagatatattgcagattacttaaatatggccatcaaaacaaaagttacaacacgtatctcttttcatctgaaaactaatacctggaaaaggataaaaaaaaaaaggaatccgtgacccacagagctagacagataagatgcatagttgaccagtcataaaaggcggtgtttaggtgatcaggatgccgttggtggcatttacgtgctttatatgatttttacctctgtaacaaacacaagaaataaacagaatggtccttaacagagtttgggggagagagcaagatgggttccttggagaagctgatttgccaagatgcacatcgctattaacagccagagtcataaatgaaatgaaattgaagaattcattcaaatgctcttttccctataacctcttttctcaccaaaaaggagataaatttgaaaacagataaatgtaacaaccagtcaaagaagcaggggaaaagtaagctcctccaaagttgcttgcagtgctggaaatagatctcatttttaggttttctcttcgttccagataccaaataaatgggacagagaataaaatttttgttaaaatatgtgctcatctcctaagtagctcttcagagtctgaccgtaagtaaaaacacacagaattgtgttgactgggggaggtgaatcacaaaaaagttacgaggagtttaagagttaaatattatttgatcgtggctgtcaaatttagtgaacaacatagattggatttggagttggtagtaggtatggttctcataccagaattctcttaaaaaaaaaaaaaaggacaattggaattgccttatttatttttaaaatcaatgcttactagttggtaggattcccaggtcagcagcagggttgattaaataatcttgacaatgagcagctgccatcttgggggatttcattctgtggttttttaaatgtttcgtctttgatgctaccatccagggcttcttattgtgaccttgtagcctattttgttcctgctgttctctaacatggtgcagttcacgcagactggtttaggtacttcacaactcaccattgtctctctgaccccaagcctagtcccttttacatcaccatcttctcagacttcttgcctattcttaaaatatgttttggttaatgattgaattaggacatcagcttaagcaattcctgtaacggtttaacgttgttgaagttcaaggcacataataaaattctccctgatgtgtgtgtaagtataaacaaagtaatgtatcaaagcgttcactttataatgaagtcatttcattgggaaggaaagctgcaaagattattgggggactagtgattaataaaatcctgtaatatttttgaagtgaaaatttgtactgaaattgtacatgatacctattaaatgtttttgtctttttttaaa

SEQ ID NO: 21073 - DNA, 3959 bp, Homo sapiens
  ENST00000640338
cgaccctcatggccctgagcaaagggctgcggctgctggggcgcctgggggccgagggggactgtagcgtgctgctggaggcgcgcggccgcgacgactgcctgctgttcgaggccggcacggtggccacgctggctccagaagaaaaggaagtcattaaaggacagtatggcaagctcacggacgcgtacggctgcctgggggagctgaggctgaaatctggtggcacgtctctgagcttcctggtgttggtgacaggctgcacatctgtgggcagaattccagatgctgaaatctacaaaatcactgccactgacttttaccctcttcaggaagaggccaaggaggaggaacgcctcatagctttgaagaaaatcctcagctcgggggtgttctatttctcatggccaaacgatgggtctcgctttgacctgactgtccgcacgcagaagcagggggatgacagctctgaatgggggaactccttcttctggaaccagctgttgcacgtgcccttgaggcagcaccaggtgagctgctgtgactggctgctgaagatcatctgcggggtggtcaccatccgcaccgtgtatgcctcccacaagcaggccaaggcctgcctcgtctctcgcgttagctgtgagcgcacaggcactcgcttccacacccgtggcgtgaacgacgacggccatgtgtccaacttcgtggagacagagcagatgatttacatggacgatggagtgtcatcttttgtccagatcagaggctccgttccgctgttctgggaacagccagggcttcaggttggctcccatcatctgagactccacagaggcctggaagccaatgcccctgctttcgacaggcacatggtgcttctgaaggagcagtacgggcagcaggtggtcgtgaaccttctgggaagcagaggcggagaggaggtgctcaacagagccttcaagaagctgctctgggcttcttgccacgcgggcgacacgcctatgatcaattttgacttccatcagtttgccaaaggtgggaagctagagaaattggagaccctcttgaggccacagttaaagctgcactgggaagacttcgatgtgttcacaaagggggagaacgtcagtccacgttttcagaaaggcactttgcggatgaactgtcttgactgcctggaccgaaccaacactgtgcagagcttcatcgcgctcgaggtcctgcatctgcagctcaagaccctggggctgagttcaaaacccatcgttgaccgctttgtggagtccttcaaagccatgtggtctctgaatggccacagcctgagcaaggtgttcacaggcagcagagccctggaagggaaggccaaggtggggaagctgaaggatggagcccggtccatgtctcgaaccatccagtccaacttcttcgacggggtgaagcaggaggccatcaagctgctgctggttggggacgtctacggcgaggaggtggcagacaaagggggcatgctgctggacagcacggcgctcctggtgactcccaggatcctgaaagctatgactgagcgtcagtccgaattcacaaatttcaagcggatccggattgctatggggacctggaacgtgaacggaggaaagcagttccggagcaacgtgctcaggacggcggagctgacagactggctgctcgactcgccccagctctcgggagctaccgactcccaggatgacagcagcccagctgacatatttgctgtggggtttgaagagatggtggaattgagcgcagggaatattgtcaatgccagtactaccaacaagaagatgtggggtgaacagcttcagaaagccatctcacgctctcatagatacattctgttgacttcggcacagctggtgggcgtctgtctttatatctttgtacgtccataccatgtcccgttcatcagggacgtagccatcgacacagtgaagacgggcatggggggcaaggcggggaacaagggcgccgtcggcatccgcttccagttccacagcaccagcttctgcttcatatgtagtcacctgacggccgggcagtcccaggtgaaggagcggaatgaagactacaaggagatcacccagaaactctgcttcccaatggggagaaatgttttttctcatgattatgtattttggtgtggcgatttcaactaccgcattgatcttacttatgaagaagtcttctattttgttaaacgccaagactggaagaaacttctggaatttgatcaactacagctacagaaatcaagtggaaaaatttttaaggactttcacgaaggagccattaactttggacccacctacaagtatgacgttggctcagccgcctacgatacaagcgacaaatgccgcacccccgcctggacagacagggtgctgtggtggaggaagaaacatccctttgataaaacagctggagaactcaaccttctagacagtgatctagatgttgacaccaaagtcagacacacctggtctcctggtgccctgcagtattatggtcgtgcggagctacaagcgtctgatcacagacctgtgctggcgatcgtggaggtggaagttcaggaagtcgatgtgggtgctcgggagagggttttccaggaagtgtcctccttccagggccccctggatgccactgttgtagtaaaccttcaatcaccgaccttagaagagaaaaacgagtttccagaggacctgcgtactgagctcatgcagaccttggggagttatgggacaattgttcttgtcaggatcaaccaagggcagatgctggtaacttttgcagacagtcactcggctctcagtgtcctggacgtggacggtatgaaggtgaaaggcagagcagtgaagattagaccgaagaccaaggactggctgaaaggtttgcgagaggagatcattcggaaacgagacagcatggcccccgtgtctcccactgccaactcctgtttgctggaggaaaactttgacttcacaagtttggactatgagtcagaaggggatattcttgaagacgatgaagactacttggtggatgaattcaatcagcctggagtctcggacagtgaactcgggggagacgacctctctgatgtccccggccccacagcactggctcctcccagcaagtcacctgctctcaccaaaaagaagcagcatccaacgtacaaagatgacgcggacctggtggagctcaagcgggagctggaagccgtcggggagttccgccaccgttctccgagcaggtctctgtcggtccccaaccggcctcggccacctcaacccccgcagagacccccccctccaaccggtttaatggtgaaaaagtcggcttcagatgcgtccatctcctccggcacccatggacagtattcaattttgcagacggcaagacttctaccaggagcacctcagcaacctcccaaggctcggactggaataagtaaaccttataatgtcaagcagatcaaaaccaccaatgcccaggaggcagaagcagcaatccggtgtctcctggaagccagaggaggtgcctccgaagaagccctaagtgccgtggccccaagggaccttgaagcatcctctgaaccagagcccacaccgggggcagccaaaccagagaccccacaggcgcccccactccttccccgtcggcccccacccagagttcctgccatcaagaagccaaccttgagaaggacaggaaagattgttttttgctctcgctctcaagcttctcagccttgcttactgcttcaaagacatgagtttgtaaggacagtagcagcccaaagactggcatctgtagacacatctggatcttccgtttgatctcagtgttctagtaacggaccctcggtaatcccttcctggtcatcacagcacgatgctgcttcccccctagagagtgtgagg

SEQ ID NO: 21074 - DNA, 939 bp, Homo sapiens
  ENST00000367113
gcggccgcgacgactgcctgctgttcgaggccggcacggtggccacgctggctccagaagaaaaggaagtcattaaaggacagtatggcaagctcacggacgcgtacggctgcctgggggagctgaggctgaaatctggtggcacgtctctgagcttcctggtgttggtgacaggctgcacatctgtgggcagaattccagatgctgaaatctacaaaatcactgccactgacttttaccctcttcaggaagaggccaaggaggaggaacgcctcatagctttgaagaaaatcctcagctcgggggtgttctatttctcatggccaaacgatgggtctcgctttgacctgactgtccgcacgcagaagcagggggatgacagctctgaatgggggaactccttcttctgaggcagccacaggttttcatctggccttggtgctttggattccccagaagtgaattcctgatttctgccggaagaaggggaccctccccacatccctgtgtccatcccaacgctccccacccccacatcctctttggttctctggtattgtggatatttgggggcagtaatgtgcccagacttcaaaatgcacgtgaatcaaggctgggcatggtagctcacgcctgcaatcccagcactttgggaggccaaggcaggcggatcacctgaggtcagcagtttgagaccagcctggccaacatggtgaaaccctgtctctactaaagatacaaagaaaattagccaggtgtggtggcgcacacctgtaatcccagctacatgggaggctgaggcagaagaatcgtttgaacccaggaggctgagattgcagtgagccgagatcgcaccattgcactccagcctgggctacagggtgagactctgtctcaaaataaataaataaaataaaataaataaaatcgtgaatctca

SEQ ID NO: 21075 - DNA, 7332 bp, Homo sapiens
  ENST00000638626
ataaaacctccacacttggtgtttgtgggccgagctattgtctttgtgttttctttttggagtgggtgggaagccagcttggcaagccgggtgtgaatgaacaggaatgagcaggagacgctcgctgatgccttctgtgatgtgtttcttccccagctccagaagaaaaggaagtcattaaaggacagtatggcaagctcacggacgcgtacggctgcctgggggagctgaggctgaaatctggtggcacgtctctgagcttcctggtgttggtgacaggctgcacatctgtgggcagaattccagatgctgaaatctacaaaatcactgccactgacttttaccctcttcaggaagaggccaaggaggaggaacgcctcatagctttgaagaaaatcctcagctcgggggtgttctatttctcatggccaaacgatgggtctcgctttgacctgactgtccgcacgcagaagcagggggatgacagctctgaatgggggaactccttcttctggaaccagctgttgcacgtgcccttgaggcagcaccaggtgagctgctgtgactggctgctgaagatcatctgcggggtggtcaccatccgcaccgtgtatgcctcccacaagcaggccaaggcctgcctcgtctctcgcgttagctgtgagcgcacaggcactcgcttccacacccgtggcgtgaacgacgacggccatgtgtccaacttcgtggagacagagcagatgatttacatggacgatggagtgtcatcttttgtccagatcagaggctccgttccgctgttctgggaacagccagggcttcaggttggctcccatcatctgagactccacagaggcctggaagccaatgcccctgctttcgacaggcacatggtgcttctgaaggagcagtacgggcagcaggtggtcgtgaaccttctgggaagcagaggcggagaggaggtgctcaacagagccttcaagaagctgctctgggcttcttgccacgcgggcgacacgcctatgatcaattttgacttccatcagtttgccaaaggtgggaagctagagaaattggagaccctcttgaggccacagttaaagctgcactgggaagacttcgatgtgttcacaaagggggagaacgtcagtccacgttttcagaaaggcactttgcggatgaactgtcttgactgcctggaccgaaccaacactgtgcagagcttcatcgcgctcgaggtcctgcatctgcagctcaagaccctggggctgagttcaaaacccatcgttgaccgctttgtggagtccttcaaagccatgtggtctctgaatggccacagcctgagcaaggtgttcacaggcagcagagccctggaagggaaggccaaggtggggaagctgaaggatggagcccggtccatgtctcgaaccatccagtccaacttcttcgacggggtgaagcaggaggccatcaagctgctgctggttggggacgtctacggcgaggaggtggcagacaaagggggcatgctgctggacagcacggcgctcctggtgactcccaggatcctgaaagctatgactgagcgtcagtccgaattcacaaatttcaagcggatccggattgctatggggacctggaacgtgaacggaggaaagcagttccggagcaacgtgctcaggacggcggagctgacagactggctgctcgactcgccccagctctcgggagctaccgactcccaggatgacagcagcccagctgacatatttgctgtggggtttgaagagatggtggaattgagcgcagggaatattgtcaatgccagtactaccaacaagaagatgtggggtgaacagcttcagaaagccatctcacgctctcatagatacattctgttgacttcggcacagctggtgggcgtctgtctttatatctttgtacgtccataccatgtcccgttcatcagggacgtagccatcgacacagtgaagacgggcatggggggcaaggcggggaacaagggcgccgtcggcatccgcttccagttccacagcaccagcttctgcttcatatgtagtcacctgacggccgggcagtcccaggtgaaggagcggaatgaagactacaaggagatcacccagaaactctgcttcccaatggggagaaatgttttttctcatgattatgtattttggtgtggcgatttcaactaccgcattgatcttacttatgaagaagtcttctattttgttaaacgccaagactggaagaaacttctggaatttgatcaactacagctacagaaatcaagtggaaaaatttttaaggactttcacgaaggagccattaactttggacccacctacaagtatgacgttggctcagccgcctacgatacaagcgacaaatgccgcacccccgcctggacagacagggtgctgtggtggaggaagaaacatccctttgataaaacagctggagaactcaaccttctagacagtgatctagatgttgacaccaaagtcagacacacctggtctcctggtgccctgcagtattatggtcgtgcggagctacaagcgtctgatcacagacctgtgctggcgatcgtggaggtggaagttcaggaagtcgatgtgggtgctcgggagagggttttccaggaagtgtcctccttccagggccccctggatgccactgttgtagtaaaccttcaatcaccgaccttagaagagaaaaacgagtttccagaggacctgcgtactgagctcatgcagaccttggggagttatgggacaattgttcttgtcaggatcaaccaagggcagatgctggtaacttttgcagacagtcactcggctctcagtgtcctggacgtggacggtatgaaggtgaaaggcagagcagtgaagattagaccgaagaccaaggactggctgaaaggtttgcgagaggagatcattcggaaacgagacagcatggcccccgtgtctcccactgccaactcctgtttgctggaggaaaactttgacttcacaagtttggactatgagtcagaaggggatattcttgaagacgatgaagactacttggtggatgaattcaatcagcctggagtctcggacagtgaactcgggggagacgacctctctgatgtccccggccccacagcactggctcctcccagcaagtcacctgctctcaccaaaaagaagcagcatccaacgtacaaagatgacgcggacctggtggagctcaagcgggagctggaagccgtcggggagttccgccaccgttctccgagcaggtctctgtcggtccccaaccggcctcggccacctcaacccccgcagagacccccccctccaaccggtttaatggtgaaaaagtcggcttcagatgcgtccatctcctccggcacccatggacagtattcaattttgcagacggcaagacttctaccaggagcacctcagcaacctcccaaggctcggactggaataagtaaaccttataatgtcaagcagatcaaaaccaccaatgcccaggaggcagaagcagcaatccggtgtctcctggaagccagaggaggtgcctccgaagaagccctaagtgccgtggccccaagggaccttgaagcatcctctgaaccagagcccacaccgggggcagccaaaccagagaccccacaggcgcccccactccttccccgtcggcccccacccagagttcctgccatcaagaagccaaccttgagaaggacaggaaagcccctgtcaccggaagaacagtttgagcaacagactgtccattttacaatcgggcccccggagacaagcgttgaggcccctcctgtcgtgacagcccctcgagtccctcctgttcccaaaccaagaacatttcagcctgggaaagctgcagagaggccaagccacaggaagccagcatcagacgaagcccctcctggggcaggagcctctgtgccaccacctctggaggcgccgcctcttgtgcccaaggtacccccgaggaggaagaagtcagcccccgcagccttccacctgcaggtcctgcagagcaacagccagcttctccagggcctcacttacaatagcagtgacagcccctctgggcacccacctgccgcgggcaccgtcttcccacaaggggactttctcagcacttcatctgctacaagccccgacagcgatggcaccaaagcgatgaagccagaggcagccccacttcttggtgattatcaggaccccttctggaaccttcttcaccaccctaaactgttgaataacacttggctttctaagagctcagaccctttggactcaggaaccaggagccccaaaagagatcccatagacccagtgtcagctggcgcttcagctgccaaggcagagctgccaccagatcatgaacacaaaaccttaggtcactgggtgacaatcagtgaccaagaaaagaggacagcactgcaggtgtttgacccactggcaaaaacatgactgagcagctttgaaggctgcagtcctatagaatgcataccttcctccctctagacatccctccaccagaagagacatctatttaaaggcacactggccaaaacgtttgtgcatctgtcactctcgtgtagtttacaaaaatcgtgtctcttattcagtaagatggttactcagccaccaaaatatatttcactcaaggcttgtacatctgaagtttgctcttcaaggaatgggaaccttcctgttaaattcggtgtatggattttaagaaaggaatctagccaatgaggtccaagaagttctcacccattgaatttttaaatggctgttcagttcatgttgtacgtgatggagatttgtcttttgttttatttgcattttacagatttggtataacattttggggagccacctgaaggttgatgtataaagtaaggattagagaaagaggtcgttgtgaccattagtagctgtcctggcccacttaaacaaggttacaaaaaatcagagtcggaagcagccaaataggtcaacctaatgactagactgtacattcccatgagccttcatgtttaagtgtgtacatgtgcgttaaccttgatgatgcgtgaatcccgagggagccggtggcatacaccgttagcttaaccttagcttaaactagctgaaggctcctgtgccatgtcttagacattgcatgccctatcaattactataatcctgagccatggtgtgctactgaaaccaatttttatccaccatctagtccttattaaatgaaacctcacggatcctttgttccgcttatattccatgcataccacataaaagcacacagtgcgaaaactcttgctgatacgcgatattgattctcattgttagaatatggagagtgtttcagcctcgtctgtccggctggagcttcgggatggaaagtgctatgtgtccctgcatataagaatcaccaggccagtgtttctgggtttgcttgtctatatgtttgtctatattttttgcctatacatttttcccacgtttccaacagcacttctcacctattcaataactgaaaaagacattaccatagtgctttacatttttaaagtaatgttacaaggtctggaatccatttggagcagataccgtgttttcgctatttaataagaagttcagtagtgaaatcttactgtaccgcctgttgtatctgggagcctcgtacagaggctcgcacagcagtgatcaagtgtcatcccttacgtgactgggggatgtctgtcctaaaagctgactgctaggatagtaaggatcatcttgcctgggctatgccactgtcttgttaccaattagacatctggaatttcataattagttttcattgtcactgtcaagatatattgcagattacttaaatatggccatcaaaacaaaagttacaacacgtatctcttttcatctgaaaactaatacctggaaaaggataaaaaaaaaaaggaatccgtgacccacagagctagacagataagatgcatagttgaccagtcataaaaggcggtgtttaggtgatcaggatgccgttggtggcatttacgtgctttatatgatttttacctctgtaacaaacacaagaaataaacagaatggtccttaacagagtttgggggagagagcaagatgggttccttggagaagctgatttgccaagatgcacatcgctattaacagccagagtcataaatgaaatgaaattgaagaattcattcaaatgctcttttccctataacctcttttctcaccaaaaaggagataaatttgaaaacagataaatgtaacaaccagtcaaagaagcaggggaaaagtaagctcctccaaagttgcttgcagtgctggaaatagatctcatttttaggttttctcttcgttccagataccaaataaatgggacagagaataaaatttttgttaaaatatgtgctcatctcctaagtagctcttcagagtctgaccgtaagtaaaaacacacagaattgtgttgactgggggaggtgaatcacaaaaaagttacgaggagtttaagagttaaatattatttgatcgtggctgtcaaatttagtgaacaacatagattggatttggagttggtagtaggtatggttctcataccagaattctcttaaaaaaaaaaaaaaggacaattggaattgccttatttatttttaaaatcaatgcttactagttggtaggattcccaggtcagcagcagggttgattaaataatcttgacaatgagcagctgccatcttgggggatttcattctgtggttttttaaatgtttcgtctttgatgctaccatccagggcttcttattgtgaccttgtagcctattttgttcctgctgttctctaacatggtgcagttcacgcagactggtttaggtacttcacaactcaccattgtctctctgaccccaagcctagtcccttttacatcaccatcttctcagacttcttgcctattcttaaaatatgttttggttaatgattgaattaggacatcagcttaagcaattcctgtaacggtttaacgttgttgaagttcaaggcacataataaaattctccctgatgtgtgtgtaagtataaacaaagtaatgtatcaaagcgttcactttataatgaagtcatttcattgggaaggaaagctgcaaagattattgggggactagtgattaataaaatcctgtaatatttttgaagtgaaaatttgtactgaaattgtacatgatacctattaaatgtttttgtctttttttaaa

SEQ ID NO: 21076 - DNA, 680 bp, Homo sapiens
  ENST00000449320
agtgcaatggcgcgatctcggctcaccacaacctctgcctcctgggttcaagcaattctcctgcctcagcctcctgaatagctgggactacaggcatgcgccaccatgcccaactaattttttgtatttttagtagagacggggtttttccatgttggtcaggctggtctgaaactccgacctcaggtggtccacctgcctcagcctcccaaagtgctgggattacagccatgagccgccgtgcctggccgacctctcttctcttttaagatgtttctttatgcctcgggacctgctcctcctgcaggaacctgcaggtggggaggtcaaggtggcacgtctctgagcttcctggtgttggtgacaggctgcacatctgtgggcagaattccagatgctgaaatctacaaaatcactgccactgacttttaccctcttcaggaagaggccaaggaggaggaacgcctcatagctttgaagaaaatcctcagctcgggggtgttctatttctcatggccaaacgatgggtctcgctttgacctgactgtccgcacgcagaagcagggggatgacagctctgaatgggggaactccttcttctggaaccagctgttgcacgtgcccttgaggcagcaccaggtgagctgctgtgactggctgctgaagatcatctgcggggt

SEQ ID NO: 21077 - DNA, 2040 bp, Homo sapiens
  ENST00000640569
aaaggccggtttctacccgatgatctcttgggccccgtcccgagagtgaggcacggcgccaccaggcacccccgatacgcagcgtgttgtgaagtgcccttgtgagcagcgggggatagggaacagaaaaccagctgtcagcgacagcgaggtggtgccccagagagggctgcctcattcgcctggctgcagggtccgaggtcgtcttggtagcatttggcaggaatttatttaggaagcattcagcaaaccgagtgtgtgtggtgctgggagatgacgacgaaatggccctgcccccaaggaagcccctcccctgggggcacaggtggggagggaggtcatgagctttgtgtgtgtgacaactgctgatgggaatgctattggcacgtacgaggggtgcctgtccgtgtcttgggagagcaaggaaggcttcccggaggagttgctgccaagttggcccagaaggatgaggaggagttcttctggtgaagtggggagggcagaggcaggatggtccctacggagcatgtggggacgctcgtgttcttccagaggatggaatgctgggcccgaagcctgaagtattgttagggtagagacaggcgggaggtgcgtggagaaggggtcatggaggtcttgttgggcagatggcggtgggacgtcccaggcagggggagcatcttgggcaagagcccagggtgcgaggtcatgcttatggcacattggaccagctggaggacagccagctcaggagagcagccggctggggtgtctgcccacgtgtggggcagggatgggctgcagcggggagggatttgggagcttctgtcgtagtcctgcagggagtgggagctgtgcaagaaggaagggcggagcggctgtgatccaatgactttgggaaggccactcctgtgatggagtgggggaagacagaccccaggccaggggtcctgagtcaaggcagtggctgaggaggcactggggaaggtgatttggagaggctttgggggtaggtcctgggggtctggaagggctctaggccaggaattttcagactcctgggggcatcagaatcacctggagggcttgttaaagcaaagcttgcccccagcctcaggcagctgggcggcaggaatctgcatgtctaacaggctcccaggggatgctgacttgctggccagggtcccacactttgagaagccccgcctgaagcttacaggacagggcaggttcttgagccattgagttgggcaatgccatgggaagttgcaggtgcacagacgttgccttcctggctgcggttgaacctgggctccatttgtccccttggagctccaggcggccgggccgacttcgaccctgagctctcctgtctgatttcctttccaggtggcacgtctctgagcttcctggtgttggtgacaggctgcacatctgtgggcagaattccagatgctgaaatctacaaaatcactgccactgacttttaccctcttcaggaagaggccaaggaggaggaacgcctcatagctttgaagaaaatcctcagctcgggggtgttctatttctcatggccaaacgatgggtctcgctttgacctgactgtccgcacgcagaagcagggggatgacagctctgaatgggggaactccttcttctggtgaggccctgggtcccctgcagagggtgggccctgggtctcctgcagagggtgggccctggttggcatctgaggccttgacctccacttgcaccacccccgggttatggggcacctctggagagttaggacccaggcctgctctcagcacaatgagaggaaaactaaccctgaactccctgccaccccccacccctggcccctggaatgtgttcagtgtagatttggaaaagaaacctgcgccaggcatggtgcctcatgcctgtaatcccagcactttgggaggctgaggcaggtggatcacttgagttaaggagtttgagacaagcctggccaacatggtgaaagcccatctctactaaaaatacaaaaaaaaaaaa

SEQ ID NO: 21078 - DNA, 810 bp, Homo sapiens
  ENST00000485863
aggtgagctgctgtgactggctgctgaagatcatctgcggggtggtcaccatccgcaccgtgtatgcctcccacaagcaggccaaggcctgcctcgtctctcgcgttagctgtgagcgcacaggcactcgcttccacacccgtggcgtgaacgacgacggccatgtgtccaacttcgtggagacagagcagatgatttacatggacgatggagtgtcatcttttgtccagatcagaggctccgttccgctgttctgggaacagccagggcttcaggttggctcccatcatctgagactccacagaggcctggaagccaatgcccctgctttcgacaggcacatggtgcttctgaaggagcagtacgggcagcaggtggtcgtgaaccttctgggaagcagaggcggagaggaggtgctcaacagagccttcaaggtaaggccaggctgtcctctccacagctgggctgggcggcaggtggccatggtggagcgttgagcctggaggtggctcctgcagggactggagctgacagcccagccctccttcgtttcctgaggcttccccagcattccgaccagtgaacacggcagtgctcagtgactcgggccctgatacatttgccaaaggtgggaagctagagaaattggagaccctcttgaggccacagttaaagctgcactgggaagacttcgatgtgttcacaaagggggagaacgtcagtccacgttttcagaaaggcactttgcggatgaactgtcttgactgcctggaccgaaccaacactgtgcagagcttcatcgcgctcgag

SEQ ID NO: 21079 - DNA, 5091 bp, Homo sapiens
  ENST00000367112
cctaattacacattttgggagagcatagccaggaaattgcatctgtgaaaagaaaatacaaattttcctctagatgagtttgtgaacgcctgtgtggccccagcgctctgagaggtggggcctagaatgagtccgagtgttctcagctcctgcagctcttaccataccaattgctgccaaccttctgggattcctgggtcctggaaacccggcagcaacactgtgtctcaagcctacagtgggcatgctggcgaggactgcaggcatggtcatgactgttttgaataattatatgcgaggaatgtttttaaccaaaggccccaaagcatccgaagcctggcttcaaggtggaggagtaaggaggatgagtctgggacgtggggtggttcgtggcgcagacctctattgtggaagtgtcatgatcgcattcttggatattgactcgattctatatgggtctctcgaatggaacccctgcgagtagctggagaactcaaccttctagacagtgatctagatgttgacaccaaagtcagacacacctggtctcctggtgccctgcagtattatggtcgtgcggagctacaagcgtctgatcacaggtgaggtcctgacttccatggcgttttctcctgtgctgggcaaggcagcgtctccctctccgcaggaaaatgcatgctgtccccataaggatgtgtgtgcgcatgggggtgcattttgtgtgcatacaatacaccaaagaacaaagaatgatggaacaaatatctgtggacccaccaccaagaactaattaatcttagcattttgtcattgctccatatcataaatgacatcattgatgaaaatttcaaagatgcaacctacgtattttgcggcttttatattttcttaaatgatgtcgttgtgcaacttgcttttttgttactatttttgagatacagtcgtgttgatgttatagctctggtgcattcatttgtaactgctgtctagtatcccactaaatatatccatggaacttacaacttatccattcacctcttgatgaatattttctccaggattttatgattacaaacaccatagggtttttaaatctgggatgcacaaccttttttttttttttttttttgagagagagtcttgctctattgcccaggctggatggagtacagtggtgtgatctcagctcactgcaacctccgcttcccagattcaagcaattctcctgcctcagcctcccaagtagctgggattacaggtgcacaccaccatgcctggctaatttttgtgtttttagtagagacggggtttcaccatgttggccaggctggtcccaaactcctgacctcaggtgatccacccaccttggcctctcaaagtgttgggattacaggcgtgagccaccgcacctggccctaggatgcagggctttttaaatgctctgtgcatcatgcattgaggatagagtggaggcagcagagggagcaccgtgggcaccagcacctgtgccctgggattgctgcagaggaagactcaccctgcagaatgtctttaaagacagaggagaggatggcatttgagggtgtgaagaaggaagagtttgatcttcccaaggctgctgcctaaactctcatgtcagtttcaacttttacaaggaaagaaattaagaaaaagaagacctgtgctggcgatcgtggaggtggaagttcaggaagtcgatgtgggtgctcgggagagggttttccaggaagtgtcctccttccagggccccctggatgccactgttgtagtaaaccttcaatcaccgaccttagaagagaaaaacgagtttccagaggacctgcgtactgagctcatgcagaccttggggagttatgggacaattgttcttgtcaggatcaaccaagggcagatgctggtaacttttgcagacagtcactcggctctcagtgtcctggacgtggacggtatgaaggtgaaaggcagagcagtgaagattagaccgaagaccaaggactggctgaaaggtttgcgagaggagatcattcggaaacgagacagcatggcccccgtgtctcccactgccaactcctgtttgctggaggaaaactttgacttcacaagtttggactatgagtcagaaggggatattcttgaagacgatgaagactacttggtggatgaattcaatcagcctggagtctcggacagtgaactcgggggagacgacctctctgatgtccccggccccacagcactggctcctcccagcaagtcacctgctctcaccaaaaagaagcagcatccaacgtacaaagatgacgcggacctggtggagctcaagcgggagctggaagccgtcggggagttccgccaccgttctccgagcaggtctctgtcggtccccaaccggcctcggccacctcaacccccgcagagacccccccctccaaccggtttaatggtgaaaaagtcggcttcagatgcgtccatctcctccggcacccatggacagtattcaattttgcagacggcaagacttctaccaggagcacctcagcaacctcccaaggctcggactggaataagtaaaccttataatgtcaagcagatcaaaaccaccaatgcccaggaggcagaagcagcaatccggtgtctcctggaagccagaggaggtgcctccgaagaagccctaagtgccgtggccccaagggaccttgaagcatcctctgaaccagagcccacaccgggggcagccaaaccagagaccccacaggcgcccccactccttccccgtcggcccccacccagagttcctgccatcaagaagccaaccttgagaaggacaggaaagcccctgtcaccggaagaacagtttgagcaacagactgtccattttacaatcgggcccccggagacaagcgttgaggcccctcctgtcgtgacagcccctcgagtccctcctgttcccaaaccaagaacatttcagcctgggaaagctgcagagaggccaagccacaggaagccagcatcagacgaagcccctcctggggcaggagcctctgtgccaccacctctggaggcgccgcctcttgtgcccaaggtacccccgaggaggaagaagtcagcccccgcagccttccacctgcaggtcctgcagagcaacagccagcttctccagggcctcacttacaatagcagtgacagcccctctgggcacccacctgccgcgggcaccgtcttcccacaaggggactttctcagcacttcatctgctacaagccccgacagcgatggcaccaaagcgatgaagccagaggcagccccacttcttggtgattatcaggaccccttctggaaccttcttcaccaccctaaactgttgaataacacttggctttctaagagctcagaccctttggactcaggaaccaggagccccaaaagagatcccatagacccagtgtcagctggcgcttcagctgccaaggcagagctgccaccagatcatgaacacaaaaccttaggtcactgggtgacaatcagtgaccaagaaaagaggacagcactgcaggtgtttgacccactggcaaaaacatgactgagcagctttgaaggctgcagtcctatagaatgcataccttcctccctctagacatccctccaccagaagagacatctatttaaaggcacactggccaaaacgtttgtgcatctgtcactctcgtgtagtttacaaaaatcgtgtctcttattcagtaagatggttactcagccaccaaaatatatttcactcaaggcttgtacatctgaagtttgctcttcaaggaatgggaaccttcctgttaaattcggtgtatggattttaagaaaggaatctagccaatgaggtccaagaagttctcacccattgaatttttaaatggctgttcagttcatgttgtacgtgatggagatttgtcttttgttttatttgcattttacagatttggtataacattttggggagccacctgaaggttgatgtataaagtaaggattagagaaagaggtcgttgtgaccattagtagctgtcctggcccacttaaacaaggttacaaaaaatcagagtcggaagcagccaaataggtcaacctaatgactagactgtacattcccatgagccttcatgtttaagtgtgtacatgtgcgttaaccttgatgatgcgtgaatcccgagggagccggtggcatacaccgttagcttaaccttagcttaaactagctgaaggctcctgtgccatgtcttagacattgcatgccctatcaattactataatcctgagccatggtgtgctactgaaaccaatttttatccaccatctagtccttattaaatgaaacctcacggatcctttgttccgcttatattccatgcataccacataaaagcacacagtgcgaaaactcttgctgatacgcgatattgattctcattgttagaatatggagagtgtttcagcctcgtctgtccggctggagcttcgggatggaaagtgctatgtgtccctgcatataagaatcaccaggccagtgtttctgggtttgcttgtctatatgtttgtctatattttttgcctatacatttttcccacgtttccaacagcacttctcacctattcaataactgaaaaagacattaccatagtgctttacatttttaaagtaatgttacaaggtctggaatccatttggagcagataccgtgttttcgctatttaataagaagttcagtagtgaaatcttactgtaccgcctgttgtatctgggagcctcgtacagaggctcgcacagcagtgatcaagtgtcatcccttacgtgactgggggatgtctgtcctaaaagctgactgctaggatagtaaggatcatcttgcctgggctatgccactgtcttgttaccaattagacatctggaatttcataattagttttcattgtcactgtcaagatatattgcagattacttaaatatggccatcaaaacaaaagttacaacacgtatctcttttcatctgaaaactaatacctggaaaaggataaaaaaaaaaa

SEQ ID NO: 21080 - DNA, 3029 bp, Homo sapiens
  ENST00000367122
atcagaaagggggcgagcttaggggcggcattcctcttggggtgtgggtgtgggtgtttggatgctggaggaactcatcttttccccagcttgtggttggcctcatcttaccacctgggcctacccatggcttttgaatttccaccagcctttcggcgagctggcagcaggcgttgaactgacctccccactgagcccctgggtcccgggaagggcctgtgcctgccaagagcaccacgggtacacccctgcagcacctggagactaagactatgctgcccataatcctcttctctgactttcagaagatgtttaggtccctgtccctctgcttgtgttatttgggcagcttggcagtgtcctaggttagcaggtgaagggacgtagccatcgacacagtgaagacgggcatggggggcaaggcggggaacaagggcgccgtcggcatccgcttccagttccacagcaccagcttctgcttcatatgtagtcacctgacggccgggcagtcccaggtgaaggagcggaatgaagactacaaggagatcacccagaaactctgcttcccaatggggagaaatgttttttctcatgattatgtattttggtgtggcgatttcaactaccgcattgatcttacttatgaagaagtcttctattttgttaaacgccaagactggaagaaacttctggaatttgatcaactacagctacagaaatcaagtggaaaaatttttaaggactttcacgaaggagccattaactttggacccacctacaagtatgacgttggctcagccgcctacgatacaagcgacaaatgccgcacccccgcctggacagacagggtgctgtggtggaggaagaaacatccctttgataaaacagctggagaactcaaccttctagacagtgatctagatgttgacaccaaagtcagacacacctggtctcctggtgccctgcagtattatggtcgtgcggagctacaagcgtctgatcacagacctgtgctggcgatcgtggaggtggaagttcaggaagtcgatgtgggtgctcgggagagggttttccaggaagtgtcctccttccagggccccctggatgccactgttgtagtaaaccttcaatcaccgaccttagaagagaaaaacgagtttccagaggacctgcgtactgagctcatgcagaccttggggagttatgggacaattgttcttgtcaggatcaaccaagggcagatgctggtaacttttgcagacagtcactcggctctcagtgtcctggacgtggacggtatgaaggtgaaaggcagagcagtgaagattagaccgaagaccaaggactggctgaaaggtttgcgagaggagatcattcggaaacgagacagcatggcccccgtgtctcccactgccaactcctgtttgctggaggaaaactttgacttcacaagtttggactatgagtcagaaggggatattcttgaagacgatgaagactacttggtggatgaattcaatcagcctggagtctcggacagtgaactcgggggagacgacctctctgatgtccccggccccacagcactggctcctcccagcaagtcacctgctctcaccaaaaagaagcagcatccaacgtacaaagatgacgcggacctggtggagctcaagcgggagctggaagccgtcggggagttccgccaccgttctccgagcaggtctctgtcggtccccaaccggcctcggccacctcaacccccgcagagacccccccctccaaccggtttaatggtgaaaaagtcggcttcagatgcgtccatctcctccggcacccatggacagtattcaattttgcagacggcaagacttctaccaggagcacctcagcaacctcccaaggctcggactggaataagtaaaccttataatgtcaagcagatcaaaaccaccaatgcccaggaggcagaagcagcaatccggtgtctcctggaagccagaggaggtgcctccgaagaagccctaagtgccgtggccccaagggaccttgaagcatcctctgaaccagagcccacaccgggggcagccaaaccagagaccccacaggcgcccccactccttccccgtcggcccccacccagagttcctgccatcaagaagccaaccttgagaaggacaggaaagcccctgtcaccggaagaacagtttgagcaacagactgtccattttacaatcgggcccccggagacaagcgttgaggcccctcctgtcgtgacagcccctcgagtccctcctgttcccaaaccaagaacatttcagcctgggaaagctgcagagaggccaagccacaggaagccagcatcagacgaagcccctcctggggcaggagcctctgtgccaccacctctggaggcgccgcctcttgtgcccaaggtacccccgaggaggaagaagtcagcccccgcagccttccacctgcaggtcctgcagagcaacagccagcttctccagggcctcacttacaatagcagtgacagcccctctgggcacccacctgccgcgggcaccgtcttcccacaaggggactttctcagcacttcatctgctacaagccccgacagcgatggcaccaaagcgatgaagccagaggcagccccacttcttggtgattatcaggaccccttctggaaccttcttcaccaccctaaactgttgaataacacttggctttctaagagctcagaccctttggactcaggaaccaggagccccaaaagagatcccatagacccagtgtcagctggcgcttcagctgccaaggcagagctgccaccagatcatgaacacaaaaccttaggtcactgggtgacaatcagtgaccaagaaaagaggacagcactgcaggtgtttgacccactggcaaaaacatgactgagcagctttgaaggctgcagtcctatagaatgcataccttcctccctctagacatccctccaccagaagagacatctatttaaaggcacactggcc

SEQ ID NO: 21081 - DNA, 566 bp, Homo sapiens
  ENST00000478456
aaacagattcagtggccttggagaaggaagctagtctaaatgatcatgtcattcttactcaggcagttacaaagagtgttacactgcgcctttaaggaaaactttccttcatcattcctgtaagcgtggacatgcaacttctctcaccacaaaggttctgccttaaagggctttcctggagtgtcaataggacctcaaaagaagagaacctgaggggacttccagctgcagaaggagtaagtgaaccgtgaagcagaataacctttgctgaagtcaaagaggggcagctttttgcaatctttgcatttgcaacatgcggtggctattctggaggcctgcggctgagtgtggactgcgtcaacaagacagaaagtaacctcagcatcgacatagcgtttgcctacccattcaggttgcaccaggtgacgtttgaggtgcccacctgcgagggaaaggaacggcagaagctggcattgattggtgactcctcgtcttcagcagagttcttcgtcactgttgctgtcttcgccttcctctactctttggctgccactgtcgtttacatt

SEQ ID NO: 21082 - DNA, 2709 bp, Homo sapiens
  ENST00000478300
aagtttccccggagccagagggcaccgggcgcacggctgagcctgcaccaatgtctgtgggccctgcctcgcccacctcctcgccctcccctctggagcgcggctggccaatgacagccttcccctggctccatgggtttccccctcccctgttgtatctaccctgccccagctcttccctgcccacccctcgctgactcgcttcgcttccccgacgcgctgggttcccggagcgcagagcccagcgttagcgggtgggctccccgaggccccctgccctcgccgggctgctccagggtgtcgctcctctggctgctcccgaaggggcttctggccctgaggacggtggtgccaagcgaacttcatttttaaaaagaactggtggatgagaagagcgagcgagggcgagctatggaccctgtgagtcagctggcctctgcgggcaccttccgggtgctgaaggagccccttgccttcctgcgagccctggaattgctttttgcaatctttgcatttgcaacatgcggtggctattctggaggcctgcggctgagtgtggactgcgtcaacaagacagaaagtaacctcagcatcgacatagcgtttgcctacccattcaggttgcaccaggtgacgtttgaggtgcccacctgcgagggaaaggaacggcagaagctggcattgattggtgactcctcgtcttcagcagagttcttcgtcactgttgctgtcttcgccttcctctactctttggctgccactgtcgtttacattttcttccagaacaaataccgggaaaacaaccggggcccactcattgacttcattgtcactgtagtcttttcgttcttgtggttggtgggttcatcagcttgggcaaaaggactgtctgacgtcaaagttgcaacggatcccaaggaagtattgctactaatgtcagcttgcaaacagccatccaacaaatgcatggctatccacagccctgttatgtcaagcttaaacacttctgtggtctttggattcttgaactttattctctgggctggaaacatatggtttgttttcaaggagaccggctggcattcttcgggacagagatatctttcagatccaatggagaagcactccagcagctataatcaaggtggttacaaccaagacagctatggatcaagcagtgggtacagtcagcaggcgagtttggggccaacctcagatgagtttggccaacagcctactggccccacttcctttaccaatcagatttaacagagtagcatttgcattcttctgcagtcgcctcaccatcttccatttcagtggcagaagaattttttaagggtttcaatcaattattaatgcagagagtattgaatgtaaatcagagctctctagtcttcattaaggcagcaagtcctgggttgtgaaaaatgatacttagagatgaggcgacatgaggagatatattattcatcatagatggctaattggagagtaccttgttatatatacagatactttcatggtcattttgtatgtatgttaaagtagtagaagtattttgtagcttaaagtctctagtatgtaatatgcataaagtaaatcaaatagcgttgagttttcttatgcattttgatgtgaaagatgttataataatttctagaagacaatttggtgtatcacaacatgcatgtcttatttttttttagttttaagtcctataggactatgagtctctaagttatttgtttcagaaaattattctttttttatgtgataaatcatatgatttaagtgcatgaataagcattttcccacacaatgaacatttgaactgtgtttatgaaaattttctggtttgcaccatgaatttgtcaaatggatatttataggaatatattcactactttgtatactttgcaaatttgtctctctggctttacccaagttctgaatgcattgtaattaaaatttaagtttttcttttcccccattagtaaacatttagtgctacatatgataactgcccaatatttattctatttacttagctaaatatttgcattcttgtaaccttctatggtgttttgtggctcttatcttgtggaccataaataacacggcccaataactctttgtgtttatggagtgttgttttcttagaataatggagatgcagatatagataccatagtcaaggtaccgccttgctgaagtatttatttataaagaatattctgtagaacctctactaccagctatatttttaaatcctgtttatttgtaaagctaatatgctcctcaatgtaattattaaaaattctcaagtcacagctaaacttactaattctgattttagtgtagcccctaaattaaaaatggcttccatatgccactctgtaccccaaagagagttctcatgaaatattctccagaatgtattcattatcaagaaaatgtcaatcgtcacttcctcgttttaactcagctgaaacaccaggacccaatagagagggcaagctgagcatctgtatttccagataaaagttgttattgatgtataaactcgttgcgtgattagtgatgttggaagcattttagcacaaaacagccttgtgtcttagatgatatctgtaaccagtttctgaatcccgttggataaaactgtattgtgatatctatttgatgttaataaagttattgcataca

SEQ ID NO: 21083 - DNA, 1004 bp, Homo sapiens
  ENST00000450542
gactcgcttcgcttccccgacgcgctgggttcccggagcgcagagcccagcgttagcgggtgggctccccgaggccccctgccctcgccgggctgctccagggtgtcgctcctctggctgctcccgaaggggcttctggccctgaggacggtggtgccaagcgaacttcatttttaaaaagaactggtggatgagaagagcgagcgagggcgagctatggaccctgtgagtcagctggcctctgcgggcaccttccgggtgctgaaggagccccttgccttcctgcgagccctggaattggttgcaccaggtgacgtttgaggtgcccacctgcgagggaaaggaacggcagaagctggcattgattggtgactcctcgtcttcagcagagttcttcgtcactgttgctgtcttcgccttcctctactctttggctgccactgtcgtttacattttcttccagaacaaataccgggaaaacaaccggggcccactcattgacttcattgtcactgtagtcttttcgttcttgtggttggtgggttcatcagcttgggcaaaaggactgtctgacgtcaaagttgcaacggatcccaaggaagtattgctactaatgtcagcttgcaaacagccatccaacaaatgcatggctatccacagccctgttatgtcaagcttaaacacttctgtggtctttggattcttgaactttattctctgggctggaaacatatggtttgttttcaaggagaccggctggcattcttcgggacagagatatctttcagatccaatggagaagcactccagcagctataatcaaggtggttacaaccaagacagctatggatcaagcagtgggtacagtcagcaggcgagtttggggccaacctcagatgagtttggccaacagcctactggccccacttcctttaccaatcagatttaacagagtagcatttgcattcttctgcagtcgcctcaccatcttccatttcagtggc

SEQ ID NO: 21084 - DNA, 1304 bp, Homo sapiens
  ENST00000468110
gcttccccgacgcgctgggttcccggagcgcagagcccagcgttagcgggtgggctccccgaggccccctgccctcgccgggctgctccagggtgtcgctcctctggctgctcccgaaggggcttctggccctgaggacggtggtgccaagcgaacttcatttttaaaaagaactggtggatgagaagagcgagcgagggcgagctatggaccctgtgagtcagctggcctctgcgggcaccttccgggtgctgaaggagccccttgccttcctgcgagccctggaattgctttttgcaatctttgcatttgcaacatgcggtggctattctggaggcctgcggctgagtgtggactgcgtcaacaagacagaaagtaacctcagcatcgacatagcgtttgcctacccattcaggacttcattgtcactgtagtcttttcgttcttgtggttggtgggttcatcagcttgggcaaaaggactgtctgacgtcaaagttgcaacggatcccaaggaagtattgctactaatgtcagcttgcaaacagccatccaacaaatgcatggctatccacagccctgttatgtcaagcttaaacacttctgtggtctttggattcttgaactttattctctgggctggaaacatatggtttgttttcaaggagaccggctggcattcttcgggacagagatatctttcagatccaatggagaagcactccagcagctataatcaaggtggttacaaccaagacagctatggatcaagcagtgggtacagtcagcaggcgagtttggggccaacctcagatgagtttggccaacagcctactggccccacttcctttaccaatcagatttaacagagtagcatttgcattcttctgcagtcgcctcaccatcttccatttcagtggcagaagaattttttaagggtttcaatcaattattaatgcagagagtattgaatgtaaatcagagctctctagtcttcattaaggcagcaagtcctgggttgtgaaaaatgatacttagagatgaggcgacatgaggagatatattattcatcatagatggctaattggagagtaccttgttatatatacagatactttcatggtcattttgtatgtatgttaaagtagtagaagtattttgtagcttaaagtctctagtatgtaatatgcataaagtaaatcaaatagcgttgagttttcttatgcattttgatgtgaaagatgttataataatttctagaagacaatttggtgtatcacaacatgcatgtcttattttttttta

SEQ ID NO: 21085 - DNA, 553 bp, Homo sapiens
  ENST00000496889
ctctctctcgcctcattcccccaaagctggcctctgcgggcaccttccgggtgctgaaggagccccttgccttcctgcgagccctggaattggctcacctgtgcctggtgtcaagaagctcagtgactctttctggactcagaagtgcctctcagccctcaggagccttttctccagcaaatgtaccctatggaaaagtagtccttgatccaatcagttatttgttgactggactgggtcagtttcctctaggttctactggtgcattcttctggaatacatgacttcaaggacagacctctacatgtgagttttctaattctttttgcaatctttgcatttgcaacatgcggtggctattctggaggcctgcggctgagtgtggactgcgtcaacaagacagaaagtaacctcagcatcgacatagcgtttgcctacccattcaggttgcaccaggtgacgtttgaggtgcccacctgcgagggaaaggaacggcagaagctggcattgattggtgactcctcgtcttcagcagagttcttcgtcactgttg

SEQ ID NO: 21086 - DNA, 526 bp, Homo sapiens
  ENST00000460142
ttcccccaaagctggcctctgcgggcaccttccgggtgctgaaggagccccttgccttcctgcgagccctggaattggctgtagaagaaacctggtgtcactatccacttctggtgaaggcctcaggctgcttccactcatggcagaaggcagagaggagctggtgtgtgcagagatcacatggtgagaaaggaagcaaaagctttttgcaatctttgcatttgcaacatgcggtggctattctggaggcctgcggctgagtgtggactgcgtcaacaagacagaaagtaacctcagcatcgacatagcgtttgcctacccattcaggttgcaccaggtgacgtttgaggtgcccacctgcgagggaaaggaacggcagaagctggcattgattggtgactcctcgtcttcagcagagttcttcgtcactgttgctgtcttcgccttcctctactctttggctgccactgtcgtttacattttcttccagaacaaataccgggaaaacaaccggggcccactcatt

SEQ ID NO: 21087 - DNA, 703 bp, Homo sapiens
  ENST00000493532
cgtttccaagaagcaaagattcttggttctttgttgctttaagaaaatttaggccaggttttccttagacaaggaaattgaaattaaaacagtagctctttttagtttttcaggcaatagagatcaaatttgggagcagtgggtgataacactgaggaatgttatctgagatgacaaattcctgaagctttttgcaatctttgcatttgcaacatgcggtggctattctggaggcctgcggctgagtgtggactgcgtcaacaagacagaaagtaacctcagcatcgacatagcgtttgcctacccattcaggttgcaccaggtgacgtttgaggtgcccacctgcgagggaaaggaacggcagaagctggcattgattggtgactcctcgtcttcagcagagttcttcgtcactgttgctgtcttcgccttcctctactctttggctgccactgtcgtttacattttcttccagaacaaataccgggaaaacaaccggggcccactcattgacttcattgtcactgtagtcttttcgttcttgtggttggtgggttcatcagcttgggcaaaaggactgtctgacgtcaaagttgcaacggatcccaaggaagtattgctactaatgtcagcttgcaaacagccatccaacaaatgcatggctatccacagccctgttatgtcaagcttaaacacttctgtg

SEQ ID NO: 21088 - DNA, 506 bp, Homo sapiens
  ENST00000467934
aaagcagtcctgcacttccagttgtgagccaagagccaagtgtgggagctcaccatggtggcagccacctccccaccaagcaggcagcgttcaccagaggggagtatcaggttcctgtactcagctgtgggttgtcactgtctaataatatgaccgttttgccatctctctgcaaatgaggctgaagctgctatctgattgctttttgcaatctttgcatttgcaacatgcggtggctattctggaggcctgcggctgagtgtggactgcgtcaacaagacagaaagtaacctcagcatcgacatagcgtttgcctacccattcaggttgcaccaggtgacgtttgaggtgcccacctgcgagggaaaggaacggcagaagctggcattgattggtgactcctcgtcttcagcagagttcttcgtcactgttgctgtcttcgccttcctctactctttggctgccactgtcgtttacattttcttccagaacaaataccgggaaaa

SEQ ID NO: 21089 - DNA, 2607 bp, Homo sapiens
  ENST00000295894
aaagcagtcctgcacttccagttgtgagccaagagccaagtgtgggagctcaccatggtggcagccacctccccaccaagcaggcagcgttcaccagaggggagtatcaggttcctgtactcagctgtgggttgtcactgtctaataatatgaccgttttgccatctctctgcaaatgaggctgaagctgctatctgattggtataacatctcactttccctctgcattgattttcttcttctcctcctttgcttcataaaaagagggacaagtggctggtgctgtggacagagaagctttatttttagtatgagacaacctctattttctttcaggagagggaagttggattatcaattcttttgtaaatgtgtatggtgatatttgctccgctttttgcaatctttgcatttgcaacatgcggtggctattctggaggcctgcggctgagtgtggactgcgtcaacaagacagaaagtaacctcagcatcgacatagcgtttgcctacccattcaggttgcaccaggtgacgtttgaggtgcccacctgcgagggaaaggaacggcagaagctggcattgattggtgactcctcgtcttcagcagagttcttcgtcactgttgctgtcttcgccttcctctactctttggctgccactgtcgtttacattttcttccagaacaaataccgggaaaacaaccggggcccactcattgacttcattgtcactgtagtcttttcgttcttgtggttggtgggttcatcagcttgggcaaaaggactgtctgacgtcaaagttgcaacggatcccaaggaagtattgctactaatgtcagcttgcaaacagccatccaacaaatgcatggctatccacagccctgttatgtcaagcttaaacacttctgtggtctttggattcttgaactttattctctgggctggaaacatatggtttgttttcaaggagaccggctggcattcttcgggacagagatatctttcagatccaatggagaagcactccagcagctataatcaaggtggttacaaccaagacagctatggatcaagcagtgggtacagtcagcaggcgagtttggggccaacctcagatgagtttggccaacagcctactggccccacttcctttaccaatcagatttaacagagtagcatttgcattcttctgcagtcgcctcaccatcttccatttcagtggcagaagaattttttaagggtttcaatcaattattaatgcagagagtattgaatgtaaatcagagctctctagtcttcattaaggcagcaagtcctgggttgtgaaaaatgatacttagagatgaggcgacatgaggagatatattattcatcatagatggctaattggagagtaccttgttatatatacagatactttcatggtcattttgtatgtatgttaaagtagtagaagtattttgtagcttaaagtctctagtatgtaatatgcataaagtaaatcaaatagcgttgagttttcttatgcattttgatgtgaaagatgttataataatttctagaagacaatttggtgtatcacaacatgcatgtcttatttttttttagttttaagtcctataggactatgagtctctaagttatttgtttcagaaaattattctttttttatgtgataaatcatatgatttaagtgcatgaataagcattttcccacacaatgaacatttgaactgtgtttatgaaaattttctggtttgcaccatgaatttgtcaaatggatatttataggaatatattcactactttgtatactttgcaaatttgtctctctggctttacccaagttctgaatgcattgtaattaaaatttaagtttttcttttcccccattagtaaacatttagtgctacatatgataactgcccaatatttattctatttacttagctaaatatttgcattcttgtaaccttctatggtgttttgtggctcttatcttgtggaccataaataacacggcccaataactctttgtgtttatggagtgttgttttcttagaataatggagatgcagatatagataccatagtcaaggtaccgccttgctgaagtatttatttataaagaatattctgtagaacctctactaccagctatatttttaaatcctgtttatttgtaaagctaatatgctcctcaatgtaattattaaaaattctcaagtcacagctaaacttactaattctgattttagtgtagcccctaaattaaaaatggcttccatatgccactctgtaccccaaagagagttctcatgaaatattctccagaatgtattcattatcaagaaaatgtcaatcgtcacttcctcgttttaactcagctgaaacaccaggacccaatagagagggcaagctgagcatctgtatttccagataaaagttgttattgatgtataaactcgttgcgtgattagtgatgttggaagcattttagcacaaaacagccttgtgtcttagatgatatctgtaaccagtttctgaatcccgttggataaaactgtattgtgatatctatttgatgttaataaagttattgcataca

SEQ ID NO: 21090 - DNA, 1296 bp, Homo sapiens
  ENST00000498449
aagtgtgggagctcaccatggtggcagccacctccccaccaagcaggcagcgttcaccagaggggagtatcaggttcctgtactcagctgtgggttgtcactgtctaataatatgaccgttttgccatctctctgcaaatgaggctgaagctgctatctgattggtataacatctcactttccctctgcattgattttcttcttctcctcctttgcttcataaaaagagggacaagtggctggtgctgtggacagagaagctttatttttagtatgagacaacctctattttctttcaggagagggaagttggattatcaattcttttgtaaatgtgtatggtgatatttgctccgctttttgcaatctttgcatttgcaacatgcggtggctattctggaggcctgcggctgagtgtggactgcgtcaacaagacagaaagtaacctcagcatcgacatagcgtttgcctacccattcaggacttcattgtcactgtagtcttttcgttcttgtggttggtgggttcatcagcttgggcaaaaggactgtctgacgtcaaagttgcaacggatcccaaggaagtattgctactaatgtcagcttgcaaacagccatccaacaaatgcatggctatccacagccctgttatgtcaagcttaaacacttctgtggtctttggattcttgaactttattctctgggctggaaacatatggtttgttttcaaggagaccggctggcattcttcgggacagagatatctttcagatccaatggagaagcactccagcagctataatcaaggtggttacaaccaagacagctatggatcaagcagtgggtacagtcagcaggcgagtttggggccaacctcagatgagtttggccaacagcctactggccccacttcctttaccaatcagatttaacagagtagcatttgcattcttctgcagtcgcctcaccatcttccatttcagtggcagaagaattttttaagggtttcaatcaattattaatgcagagagtattgaatgtaaatcagagctctctagtcttcattaaggcagcaagtcctgggttgtgaaaaatgatacttagagatgaggcgacatgaggagatatattattcatcatagatggctaattggagagtaccttgttatatatacagatactttcatggtcattttgtatgtatgttaaagtagtagaagtattttgtagcttaaagtctctagtatgtaatatgcataaagtaaatcaaatagcgttgagttttcttatgcatttt

SEQ ID NO: 21091 - DNA, 527 bp, Homo sapiens
  ENST00000472899
ttcttcttctcctcctttgcttcataaaaagagggacaagtggctggtgctgtggacagagaagctttatttttagtatgagacaacctctattttctttcaggagagggaagttggattatcaattcttttgtaaatgtgtatggtgatatttgctccgaaagggtttctcaaacgttttttctctggatctcttcaaaaagctttttgcaatctttgcatttgcaacatgcggtggctattctggaggcctgcggctgagtgtggactgcgtcaacaagacagaaagtaacctcagcatcgacatagcgtttgcctacccattcaggttgcaccaggtgacgtttgaggtgcccacctgcgagggaaaggaacggcagaagctggcattgattggtgactcctcgtcttcagcagagttcttcgtcactgttgctgtcttcgccttcctctactctttggctgccactgtcgtttacattttcttccagaacaaataccgggaaaacaaccggggcccactcatt

SEQ ID NO: 21092 - DNA, 2436 bp, Homo sapiens
  ENST00000479198
gcttcataaaaagagggacaagtggctggtgctgtggacagagaagctttatttttagtatgagacaacctctattttctttcaggagagggaagttggattatcaattcttttgtaaatgtgtatggtgatatttgctccgctttttgcaatctttgcatttgcaacatgcggtggctattctggaggcctgcggctgagtgtggactgcgtcaacaagacagaaagtaacctcagcatcgacatagcgtttgcctacccattcaggttgcaccaggtgacgtttgaggtgcccacctgcgagggaaaggaacggcagaagctggcattgattggtgactcctcgtcttcagcagagttcttcgtcactgttgctgtcttcgccttcctctactctttggctgccactgtcgtttacattttcttccagaacaaataccgggaaaacaaccggggcccactcattgacttcattgtcactgtagtcttttcgttcttgtggttggtgggttcatcagcttgggcaaaaggactgtctgacgtcaaagttgcaacggatcccaaggaagtattgctactaatgtcagcttgcaaacagccatccaacaaatgcatggctatccacagccctgttatgtcaagcttaaacacttctgtgctttctgaaattcaatctgcgaaggcacttaagaagagagaaagggttgctactctgactggactgtgatttctgctttggtctttggattcttgaactttattctctgggctggaaacatatggtttgttttcaaggagaccggctggcattcttcgggacagagatatctttcagatccaatggagaagcactccagcagctataatcaaggtggttacaaccaagacagctatggatcaagcagtgggtacagtcagcaggcgagtttggggccaacctcagatgagtttggccaacagcctactggccccacttcctttaccaatcagatttaacagagtagcatttgcattcttctgcagtcgcctcaccatcttccatttcagtggcagaagaattttttaagggtttcaatcaattattaatgcagagagtattgaatgtaaatcagagctctctagtcttcattaaggcagcaagtcctgggttgtgaaaaatgatacttagagatgaggcgacatgaggagatatattattcatcatagatggctaattggagagtaccttgttatatatacagatactttcatggtcattttgtatgtatgttaaagtagtagaagtattttgtagcttaaagtctctagtatgtaatatgcataaagtaaatcaaatagcgttgagttttcttatgcattttgatgtgaaagatgttataataatttctagaagacaatttggtgtatcacaacatgcatgtcttatttttttttagttttaagtcctataggactatgagtctctaagttatttgtttcagaaaattattctttttttatgtgataaatcatatgatttaagtgcatgaataagcattttcccacacaatgaacatttgaactgtgtttatgaaaattttctggtttgcaccatgaatttgtcaaatggatatttataggaatatattcactactttgtatactttgcaaatttgtctctctggctttacccaagttctgaatgcattgtaattaaaatttaagtttttcttttcccccattagtaaacatttagtgctacatatgataactgcccaatatttattctatttacttagctaaatatttgcattcttgtaaccttctatggtgttttgtggctcttatcttgtggaccataaataacacggcccaataactctttgtgtttatggagtgttgttttcttagaataatggagatgcagatatagataccatagtcaaggtaccgccttgctgaagtatttatttataaagaatattctgtagaacctctactaccagctatatttttaaatcctgtttatttgtaaagctaatatgctcctcaatgtaattattaaaaattctcaagtcacagctaaacttactaattctgattttagtgtagcccctaaattaaaaatggcttccatatgccactctgtaccccaaagagagttctcatgaaatattctccagaatgtattcattatcaagaaaatgtcaatcgtcacttcctcgttttaactcagctgaaacaccaggacccaatagagagggcaagctgagcatctgtatttccagataaaagttgttattgatgtataaactcgttgcgtgattagtgatgttggaagcattttagcacaaaacagccttgtgtcttagatgatatctgtaaccagtttctgaatcccgttggataaaactgtattgtgatatctatttgatgttaataaagttattgcataca

SEQ ID NO: 21093 - DNA, 805 bp, Homo sapiens
  ENST00000478744
ataaaaagagggacaagtggctggtgctgtggacagagaagctttatttttagtatgagacaacctctattttctttcaggagagggaagttggattatcaattcttttgtaaatgtgtatggtgatatttgctccgctttttgcaatctttgcatttgcaacatgcggtggctattctggaggcctgcggctgagtgtggactgcgtcaacaagacagaaagtaacctcagcatcgacatagcgtttgcctacccattcaggttgcaccaggtgacgtttgaggtgcccacctgcgagggaaaggaacggcagaagctggcattgattggtgactcctcgtcttcagcagagttcttcgtcactgttgctgtcttcgccttcctctactctttggctgccactgtcgtttacattttcttccagaacaaataccgggaaaacaaccggggcccactcattgcagaaggttcagagtgtgggttgaaatccagagctcaattcataatcaccatgcaagaggcccaagatcctgatagccaatgtgctacagaagttagagaggtggagataggacttcattgtcactgtagtcttttcgttcttgtggttggtgggttcatcagcttgggcaaaaggactgtctgacgtcaaagttgcaacggatcccaaggaagtattgctactaatgtcagcttgcaaacagccatccaacaaatgcatggctatccacagccctgttatgtcaagcttaaacacttctgtgctttctgaaattcaatctgcgaaggcacttaagaagagag

SEQ ID NO: 21094 - DNA, 2383 bp, Homo sapiens
  ENST00000460711
ataaaaagagggacaagtggctggtgctgtggacagagaagctttatttttagtatgagacaacctctattttctttcaggagagggaagttggattatcaattcttttgtaaatgtgtatggtgatatttgctccgcataatgaagaatgcaagagtcatttccatttactttttgcaatctttgcatttgcaacatgcggtggctattctggaggcctgcggctgagtgtggactgcgtcaacaagacagaaagtaacctcagcatcgacatagcgtttgcctacccattcaggttgcaccaggtgacgtttgaggtgcccacctgcgagggaaaggaacggcagaagctggcattgattggtgactcctcgtcttcagcagagttcttcgtcactgttgctgtcttcgccttcctctactctttggctgccactgtcgtttacattttcttccagaacaaataccgggaaaacaaccggggcccactcattgacttcattgtcactgtagtcttttcgttcttgtggttggtgggttcatcagcttgggcaaaaggactgtctgacgtcaaagttgcaacggatcccaaggaagtattgctactaatgtcagcttgcaaacagccatccaacaaatgcatggctatccacagccctgttatgtcaagcttaaacacttctgtggtctttggattcttgaactttattctctgggctggaaacatatggtttgttttcaaggagaccggctggcattcttcgggacagagatatctttcagatccaatggagaagcactccagcagctataatcaaggtggttacaaccaagacagctatggatcaagcagtgggtacagtcagcaggcgagtttggggccaacctcagatgagtttggccaacagcctactggccccacttcctttaccaatcagatttaacagagtagcatttgcattcttctgcagtcgcctcaccatcttccatttcagtggcagaagaattttttaagggtttcaatcaattattaatgcagagagtattgaatgtaaatcagagctctctagtcttcattaaggcagcaagtcctgggttgtgaaaaatgatacttagagatgaggcgacatgaggagatatattattcatcatagatggctaattggagagtaccttgttatatatacagatactttcatggtcattttgtatgtatgttaaagtagtagaagtattttgtagcttaaagtctctagtatgtaatatgcataaagtaaatcaaatagcgttgagttttcttatgcattttgatgtgaaagatgttataataatttctagaagacaatttggtgtatcacaacatgcatgtcttatttttttttagttttaagtcctataggactatgagtctctaagttatttgtttcagaaaattattctttttttatgtgataaatcatatgatttaagtgcatgaataagcattttcccacacaatgaacatttgaactgtgtttatgaaaattttctggtttgcaccatgaatttgtcaaatggatatttataggaatatattcactactttgtatactttgcaaatttgtctctctggctttacccaagttctgaatgcattgtaattaaaatttaagtttttcttttcccccattagtaaacatttagtgctacatatgataactgcccaatatttattctatttacttagctaaatatttgcattcttgtaaccttctatggtgttttgtggctcttatcttgtggaccataaataacacggcccaataactctttgtgtttatggagtgttgttttcttagaataatggagatgcagatatagataccatagtcaaggtaccgccttgctgaagtatttatttataaagaatattctgtagaacctctactaccagctatatttttaaatcctgtttatttgtaaagctaatatgctcctcaatgtaattattaaaaattctcaagtcacagctaaacttactaattctgattttagtgtagcccctaaattaaaaatggcttccatatgccactctgtaccccaaagagagttctcatgaaatattctccagaatgtattcattatcaagaaaatgtcaatcgtcacttcctcgttttaactcagctgaaacaccaggacccaatagagagggcaagctgagcatctgtatttccagataaaagttgttattgatgtataaactcgttgcgtgattagtgatgttggaagcattttagcacaaaacagccttgtgtcttagatgatatctgtaaccagtttctgaatcccgttggataaaactgtattgtgatatctatttgatgttaataaagttattgcatac

SEQ ID NO: 21095 - DNA, 829 bp, Homo sapiens
  ENST00000465156
aaagagggacaagtggctggtgctgtggacagagaagctttatttttagtatgagacaacctctattttctttcaggagagggaagttggattatcaattcttttgtaaatgtgtatggtgatatttgctccgctttttgcaatctttgcatttgcaacatgcggtggctattctggaggcctgcggctgagtgtggactgcgtcaacaagacagaaagtaacctcagcatcgacatagcgtttgcctacccattcaggttgcaccaggtgacgtttgaggtgcccacctgcgagggaaaggaacggcagaagctggcattgattggtgactcctcgtcttcagcagagttcttcgtcactgttgctgtcttcgccttcctctactctttggctgccactgtcgtttacattttcttccagaacaaataccgggaaaacaaccggggcccactcattgtctttggattcttgaactttattctctgggctggaaacatatggtttgttttcaaggagaccggctggcattcttcgggacagagatatctttcagatccaatggagaagcactccagcagctataatcaaggtggttacaaccaagacagctatggatcaagcagtgggtacagtcagcaggcgagtttggggccaacctcagatgagtttggccaacagcctactggccccacttcctttaccaatcagatttaacagagtagcatttgcattcttctgcagtcgcctcaccatcttccatttcagtggcagaagaattttttaagggtttcaatcaattattaatgcagagagtattgaatgtaaatc

SEQ ID NO: 21096 - DNA, 4461 bp, Homo sapiens
  ENST00000228567
actccatgccgggtctctagttccagcgcgcctcggctcgctcgcgcggcgggagagttggcgcaaacctcgcggcagccgcagcctcctcgcgcgcctctccttcccctacgccctccgctcccgccatggggccaacgtggggctcctaagagttgccggctctcagcggcgcaatctccagccaaagtcaccgcgggcggactatggcttagggcgccagaggggttagaggtacgggaagaggaaaagacggctaactgggaaaaaaagagaaaacgaaagaaaagccaaacgatgagtttccacaaggaggacggagtgaacagtctgtgccagaaggctctgcacatcgtcaccgagctgtgcttcgccggccaggtggagtgggagaagtgctcgggcatcttccctcgggacaggggcagccagggcggaagcagcacagatatttcagtcagcctgttagctgtcgttgtcagcttttgtggactggccttgttggttgtctcactttttgtcttctggaagctgtgttggccatgctggaaaagcaaacctgtgacttccaacatcactacgcttccacagagcatttcaagtgctcctactgaagtttttgagactgaagagaaaaaagaaattaaggaaaatgaaaagccagccgtaaaagctattgagcctgcaataaaaatcagccacacttcccctgacatcccagcagaagtccaaactgctttaaaagaacatttaattaaacatgcacgtgtgcaaagacaaattactgagcctacgtcatcaacccgccacagttccttccgaagacacctgccgaggcaaatgcaggtttccagtgttgattttagcatgggcacagaacctgttttacaacgaggagaaacaacaaccagcattgggaggataaagccagaactctacaaacagaaatcagttgactctgagggcaaccaaaacgaagatgtcaaaatctgtgggaaacttaactttaccctccagtatgattatgaaaatgaacttctagttgttaaaattatcaaagctttagatctccctgctaaagacttcacaggaacttctgacccttatgtgaagatgtatcttcttccagataggaaaaagaaatttcagacccgcgtgcacagaaagactttaaatcctctatttgatgaaacttttcaatttcctgtagcatatgatcaactaagcaaccgaaaactacatttcagtgtgtatgattttgacagattttctagacatgacatgattggggaagtgattcttgataatttgtttgaagtctctgatctctccagggaagccacagtatggaaagatattcactgtgctaccacagaaagtatagacctgggtgaaatcatgttttccctttgttacctaccgacggctgggcgtatgacattgacagtcattaagtgcagaaatctgaaggcgatggatattactggctcatcagatccttatgtcaaagtgtccctgatgtgtgaaggtcgaagattaaaaaagaggaaaacaactacaaagaaaaacactctaaaccctgtgtacaatgaggccattatttttgacatccctccagagaacgtggaccaggtcagcctctccattgcggtcatggattacgatagggtaggacacaatgaggtcataggagtgtgcagaacaggactggatgctgagggtcttgggcgagaccactggaatgaaatgctggcctatcatcgaaaaccaataacgcactggcacccattgctggagttacctggccgggcgaccagttttgatagtcaaggatcctgcccttctcctaaaccaccttccacaccataatgcctccaaaatgagaccatgatattaagcatctaggatcacgtgctcattgaatcagaaaaaaagtggaaggtttggtttcctcatttgaaatatatccgtactaatgaacaaacttgatgtgcacttttttatttgcttttattgttgattttttaactttgaacatcaatacattttacttgaatacatatagtccttagttgcataaggcattttatccttcgtatcaaatgcctgttagcacaaagagtgttttactatgttgtaattctttgcatatgaaatgtttttttaaacagttcatacttacctaaaattaaatatagtttatgctgctattgtataaagtagcacatgtcatatatgtatgggtttgattttgttatactgtgttcatttctagttgtgcaggtggttctgtataaacttaaaaggagattttgaacttaacttacacaacattaaatccttgcacaatcaaattaatgttacttatctgataatacttttctttcattctcagaaaattactttcttggtgaggtttggctctgctaaactcaaaacttgtctctcaagcttgttctttaaaatacatagacaaagctgtaaatttaaagaatcattttgaatataaatttaagaagtaatacttattggctgaaaaacggaggctgagccattgtggctaccattttacactgttttactgtaacattagctcaaatatctgttgcactgttcaactgatatttttaaaattctaataatcttcatctcaaatgtagcattagtatttctaagtgaacagaatcagaagttaatttttaagtgtttgtaaggttctcaagtactgtgacatgtatttttttgtgacgtgtattttttgtgacttgaagctatcatatagatcctgtatttctgatagaccatactaacagacaccaaaggaacaacaacactgtctgtgttcatcaccgtttagattgtacacagtaatggtgactcttaaacccagtcagaagctcatcattggaattcagtattttcttaaagaaaggatgatttattttcagcaacatatagaaatatactataaatattaataatacaacttcaatgcttaataataataaacaaattaattctaaaggcccaggcctccagtccttgcatgaaaggcatttgccttcataaggatcaaggttcaggccactacatgtaaaaactatgcaagtgtttttacaagacagaactttcttttaagtcaggtcaacatattttgtcccattttcaggccctgttggaaggtatctatactgaattaccccaaccttacttttaagatgtgtggtatagatagtatatatttcaagcttatttcaaaattggtggtttttttaaaaaaagaggcaagaaaataaaaacatatttacctggatgagaaaattttatcagcggttatgaaatttttatttttgtaaaatcccattatttctaaatattaaaaaaaagttttaaaagccttgaaattttgttgacatctcttatagtgatggcattactgttaattaagaggtaaatattttgcacattaccattttaaaggcaaacacagttctgcctcagatttttcaaaaatgcttataccaccctaaggaaaacaggtactcctagctaacattttctcattgaaaataatagaagaaagctgtttggaaacatttggctaccttgtcgagcctaaaagaattatttgctataggtaaaatgaaagatgacacttgcattttgaaattatttgttttattgggaaataaaacttttcaaataggaagacaaaaagttatactattaatagaatgacatttttggagacagttgttttattagtagatataactgcagcttaaagtaaattagcaattacgtttcctaagtgagtataattattttcacccaaaaacacatttttaaggactttttgttgattcttagaaactcgcttttctttactccctaaggagaaaaagccaatgcttgtgatgaaaaaatgtgaaccattggccaatcagaagactctaatatgggaattgtagattaaaataagttttaaaagaattttttaaatgtttccttgaagttagaataaactcatcatgcaaggatatgtgttaatcctgagaaagagatcagcgagaggaaattcaccacaactcatctttcatgtaattcaggaggtaggtttatgctcagattaataaggcatgattgttaaaaatgacagttcatattattaaaatgtaatcctaacaattttaatacaacacaccctcactctacacagcccacacattcatatacacataacttaccatctttctgcttgtaattgaagatgaaatattttcagtttcagtatttaaaataagatttgatattacaaatccccttatttgtgtgggacatcacattttaatgacagtactgacacattatgaagctgcagttcaggtatataatgaacatctaatttcagggacttcttcagggacttaccaaatatcagtctaggaaaaaaaagagtaa

SEQ ID NO: 21097 - DNA, 2433 bp, Homo sapiens
  ENST00000539102
gcaatctccagccaaagtcaccgcgggcggactatggcttagggcgccagaggggttagaggtacgggaagaggaaaagacggctaactgggaaaaaaagagaaaacgaaagaaaagccaaacgatgagtttccacaaggaggacggagtgaacagtctgtgccagaaggctctgcacatcgtcaccgagctgtgcttcgccggccaggtggagtgggagaagtgctcgggcatcttccctcgggacaggggcagccagggcggaagcagcacagatatttcagtcagcctgttagctgtcgttgtcagcttttgtggactggccttgttggttgtctcactttttgtcttctggaagctgtgttggccatgctggaaaagcaaacctgtgacttccaacatcactacgcttccacagagcatttcaagtgctcctactgaagtttttgagactgaagagaaaaaagaaattaaggaaaatgaaaagccagccgtaaaagctattgagcctgcaataaaaatcagccacacttcccctgacatcccagcagaagtccaaactgctttaaaagaacatttaattaaacatgcacgtgtgcaaagacaaattactgagcctacgtcatcaacccgtggttggggaaagaagaagaagaaaagaattttgagcacttgcaattttgtcactatgccaaggcacccttcctgataatccttcaccaacctgcatgaaagtttctgaagaccacagcatgttgaaaaaaagaaaatgtactcatttttggctgccacaactatatattctttttaaaaccacagttccttccgaagacacctgccgaggcaaatgcaggtttccagtgttgattttagcatgggcacagaacctgttttacaacgaggagaaacaacaaccagcattgggaggataaagccagaactctacaaacagaaatcagttgactctgagggcaaccaaaacgaagatgtcaaaatctgtgggaaacttaactttaccctccagtatgattatgaaaatgaacttctagttgttaaaattatcaaagctttagatctccctgctaaagacttcacaggaacttctgacccttatgtgaagatgtatcttcttccagataggaaaaagaaatttcagacccgcgtgcacagaaagactttaaatcctctatttgatgaaacttttcaatttcctgtagcatatgatcaactaagcaaccgaaaactacatttcagtgtgtatgattttgacagattttctagacatgacatgattggggaagtgattcttgataatttgtttgaagtctctgatctctccagggaagccacagtatggaaagatattcactgtgctaccacagaaagtatagacctgggtgaaatcatgttttccctttgttacctaccgacggctgggcgtatgacattgacagtcattaagtgcagaaatctgaaggcgatggatattactggctcatcagatccttatgtcaaagtgtccctgatgtgtgaaggtcgaagattaaaaaagaggaaaacaactacaaagaaaaacactctaaaccctgtgtacaatgaggccattatttttgacatccctccagagaacgtggaccaggtcagcctctccattgcggtcatggattacgatagggtaggacacaatgaggtcataggagtgtgcagaacaggactggatgctgagggtcttgggcgagaccactggaatgaaatgctggcctatcatcgaaaaccaataacgcactggcacccattgctggagttacctggccgggcgaccagttttgatagtcaaggatcctgcccttctcctaaaccaccttccacaccataatgcctccaaaatgagaccatgatattaagcatctaggatcacgtgctcattgaatcagaaaaaaagtggaaggtttggtttcctcatttgaaatatatccgtactaatgaacaaacttgatgtgcacttttttatttgcttttattgttgattttttaactttgaacatcaatacattttacttgaatacatatagtccttagttgcataaggcattttatccttcgtatcaaatgcctgttagcacaaagagtgttttactatgttgtaattctttgcatatgaaatgtttttttaaacagttcatacttacctaaaattaaatatagtttatgctgctattgtataaagtagcacatgtcatatatgtatgggtttgattttgttatactgtgttcatttctagttgtgcaggtggttctgtataaacttaaaaggagattttgaacttaacttacacaacattaaatccttgcacaatcaaattaatgttacttatctgataatacttttctttcattctcagaaaattactttcttggtgaggtttggctctg

SEQ ID NO: 21098 - DNA, 544 bp, Homo sapiens
  ENST00000567656
actgagcctacgtcatcaacccgagtttctgaagaccacagcatgttgaaaaaaagaaaatgtactcatttttggctgccacaactatatattctttttaaaagtaaatatgtatttagttagattaagaattagaaacaactcattataagaaaatgtggacctataacatgtttttaattttaatactatagtcactaaaatgtgaaattcatgagactcaaatatccaggtgaaaagaaaccagccatctgaatgattttgtctgtataatacttacatctagatagacccagatgactgataacattcacaattttctgtggaatattgaatttttttgctaatcatgtttctttagaattgtttttaattatgtgcttatgattgagagtacaaaatttcaaaagcatatgaaaattaacattggccagccacgtgttgtggctcacttgtgttatctcggcactttgggagactgaggtgagaggattgcgtgagcccagaagttcaagaccagcctgggcaacatagcaagactctg

SEQ ID NO: 21099 - DNA, 4534 bp, Homo sapiens
  ENST00000393946
gaagttctagaaaatgttaattgggggagctgtggctggcagagaaggaaaaaggaagctgaagggcacttgggctcataatggtctctccaaccctgatcctgtcctttatggacatttggcagcgctgctgccttgaggtgccttgcaatgctttatctttttgttaaagccacctctgttgcttcagccagcttgagcggttttctgttacttgctagtggttgggaaggcttagccgacgaagggaaaatgagtcaggtcctgaaggatgagcaagttacgggagtgggccgcatggtgagggagtggacttcctgatggggttaagggcgcctgaacacctgggaggcaagttgaggccaagacctggggtgatggagaggcagggtaggctacccagtgagtaggaggccgaaggaaccacagcagggctccagatctcctggcccagaggggctggtacgggaagcccagaagacactcatccctaaggggagcctgagactgaggaactctcatgccctgcgtcgggctcgtgggcgaagggccttcccagggactgcaccatggcctgtccccagccttacccaggggcctccctctcaggttctgaaggacccaggggtcacagctgtgtggggtgctccactgaacacttccttcaaactccttcaggctggagtgcagtggcgcgatctcagctccatgggagagagtttgaaaggatgaagagtttacatcctctggaaagaagcaaatagaaggcattccaggcaaaaggaactgcatcgagtaaaagcatggaggcaagaaagggcttggtgtgtttgagaaacagtgagtagggcatggtggtggcagaagcttaaagtgtatggcccgtggacagtgacagccggacaagaagctgaagtgacagaacaagttgaaccaaaggaattccagacctgggaaagtggagaaagaattttggggtcagagccgtttaagactttgcctagggcctgggtcttctttctcctaaaggcctcaacccacagcacgccacacaaatatgtcacataacacacaaacaaacatcatatttcacagtccaggaaatgaaatgaagacaaaagcgccccctgtgggtgaagtcacagtcactgcagcagacatcatggctgtggatgtggcagaataccatctgagcgtcatcaagagcccccctggctgggaggtgggtgtctatgctgcaggggccctggccctgctgggaatcgcagctgtgagcctgtggaagctctggacgtcggggagcttccccagcccctctccgttccccaattacgactacaggtaccttcagcagaagtacggcgagagctgcgcagaggccagggagaagagagtgcctgcctggaatgcccagcgggccagcacgcggggaccacccagccgcaaaggcagtctcagcattgaggacacctttgagagcatcagtgaactggggcctctggagctgatgggccgggagttggacctggccccctatgggaccctccggaagtcccagtcggccgactccctgaactccatctcctccgtgagcaacacctttgggcaggacttcacactgggccaggtggaggtgagcatggagtacgacactgcctcccacacgctgaacgtggcggtgatgcagggcaaggacctcctggagcgggaggaggccagcttcgagtcctgcttcatgcgcgtcagcctgctgccggacgagcagatcgtgggcatttctcggatccagagaaatgcctactccatcttctttgatgagaagttctccatccccctggatcccacagccctggaggagaagagcctgcggttttctgtatttggcatcgatgaggatgagcgcaacgtcagcacgggggtggtggagctgaagctttctgtgcttgacctcccgctgcagcccttcagtggctggctctatttacaggaccagaacaaggccgccgatgctgtgggggagatcctgctctccctcagctacctccccacagccgagcgcctcaccgtggtcgtggttaaggccaagaacctcatctggaccaacgacaagaccacagcggaccccttcgtcaaggtgtacctgctgcaggatgggaggaagatgagcaaaaagaagacagccgtgaagagggatgaccccaacccggtgttcaacgaagccatgatcttctcggtgccagccattgtgctccaggacctgtctctccgcgtgacggtggctgagagcagcagcgacggccgtggggacaacgtgggccatgtcatcattgggccgtcagccagtggcatgggaaccacacattggaaccagatgttggccacgctgcgcaggcccgtgtccatgtggcacgctgtccggcgaaactagcaaccagggcgggccagttgggcaatggagctgctggagcccggtacccactcagctctgtctgatgccctctccatagcccagctggagccgtgaacactggggtcccctggcagagtcctcatgacccatcctggtctctctgtccagattgcagcagaggagtgggcgtggctctgtgtccagggccccagggtctgctcctgctgaggaccagctgtggctgggccaggacagaggactcaaccctgctcctcccggtaggccagctgccgagctgggctatgttctggaacccagtgaatcttgggggccaggcactgtgctaggcaccagcaggggtaacacgaagaagacccggcccttagggcatcaggaagactagctcccctgccccggaggatctgctcagtgctgatggcagcccagctgtgtggactcagggggctctgagggctagggaaacaggaagggcctctttgacaaggtaggagctgtgcttggaggggcaggaaaagaactgagcatgtcgcaggcagcgggcccagcctgagcaatggcaggatgtgaacttccccatcgcaaatgcagttctcagcccactgcagtggatacaaggaagggcctttctcggggccggagaagagaccaagagaccaggcccgggcagcagcctaccggccacgtggaacactggctccggagttattctctgtcaaatctactccccggacctcaaccatggcaagaaccagaggtccaaagaggcccagacccaggtccttgtgctcagtcctgcgcaaaccaggcccagaccctgcaagcatttgttgatgcccttgcaggcccactgggagaaagatgcctcaggcaggtctcagcctgggggtggcaggggtggggcagagagaatactgacagcagaggtcttggtgggctgcacgtgcctgcgaagatgtggtggacaaggaggctctcgggctgggccttggaggggtggcagcggaaggacagcccaggtggctgaggcctgatgggaagccggggaaggccagggtggaagggcggcttgagggacgccaggagaagactgaatgccaggctaggaaggaggcggctctcgatcacggggtgggtgcccccgacaccgggtctcctagcttgagttccctagaagcgaaatctgagagggggattctggggcaagtagtttcttgcgggtgagtgttctcagagaaacttaccagatcaagaaagggagctcaggctggatggaggaagccacgcaagtgtggcttcaagatccatcgccttggcctgatcgctgtgggggcaggggcctggagtacgaggggcaccctgggggctcccacccagaagcagaggggctgggctgttgcacctctactggcatcagtctttggttaccccccagccccagtaggaggagagcaggcagagcttgtcatccccagcctggtgtcccgcagtcccaggaagccgcttcttgccttcatggctgagtgctgggaagggctgagctcacccaggccagcaggtggggtatcatctgctcggtggggccacccacaggtgacagcatggaccctcaggctggctgcccctgttccttggtccataactggtgagctatggagacccaggccaacaaattatccccagtgatatggggggaggaggggctagaacaagggcccaggggactggaggcaggatggtggctttccctacctgacacagccatggcccagccccaaggccaggctgtctaccctatggccacagcaggaggtcagcccagggccaggagacacatggctggacaaggctttgcagcctgggagaccccgactttctctaacccagtggctgtgcggtgcaggccactgactccccccctgccctctcccctctctccctccccctaactgcatgacatgttaactgtgtgcccaggacagccgtggtggggaccgggtatgccaactggaatgattctagaaccaaaataaagttggggcaggaagagggggcttccagggagccctgctcggccctgaatcaccttcgtctcttctctaggaa

SEQ ID NO: 21100 - DNA, 1678 bp, Homo sapiens
  ENST00000525457
atgtaaaaaatggagtcaccacgaccagattaggccacggtgaggactgagatgatgttgtaaggcaccagcacagagctgacctacagctcaatcgtggtgggagggagtaattatccattcagaaaaggggaaactttccgctgcgcctcctgtcgctgttttccttggctcccggaggtgcgcagtatcgggtccgtttttaagtcacagtcactgcagcagacatcatggctgtggatgtggcagaataccatctgagcgtcatcaagagcccccctggctgggaggtgggtgtctatgctgcaggggccctggccctgctgggaatcgcagctgtgagcctgtggaagctctggacgtcggggagcttccccagcccctctccgttccccaattacgactacaggtaccttcagcagaagtacggcgagagctgcgcagaggccagggagaagagagtgcctgcctggaatgcccagcgggccagcacgcggggaccacccagccgcaaaggcagtctcagcattgaggacacctttgagagcatcagtgaactggggcctctggagctgatgggccgggagttggacctggccccctatgggaccctccggaagtcccagtcggccgactccctgaactccatctcctccgtgagcaacacctttgggcaggacttcacactgggccaggtggaggtgagcatggagtacgacactgcctcccacacgctgaacgtggcggtgatgcagggcaaggacctcctggagcgggaggaggccagcttcgagtcctgcttcatgcgcgtcagcctgctgccggacgagcagatcgtgggcatttctcggatccagagaaatgcctactccatcttctttgatgagaagttctccatccccctggatcccacagccctggaggagaagagcctgcggttttctgtatttggcatcgatgaggatgagcgcaacgtcagcacgggggtggtggagctgaagctttctgtgcttgacctcccgctgcagcccttcagtggctggctctatttacaggaccagaacaaggccgccgatgctgtgggggagatcctgctctccctcagctacctccccacagccgagcgcctcaccgtggtcgtggttaaggccaagaacctcatctggaccaacgacaagaccacagcggaccccttcgtcaaggtgtacctgctgcaggatgggaggaagatgagcaaaaagaagacagccgtgaagagggatgaccccaacccggtgttcaacgaagccatgatcttctcggtgccagccattgtgctccaggacctgtctctccgcgtgacggtggctgagagcagcagcgacggccgtggggacaacgtgggccatgtcatcattgggccgtcagccagtggcatgggaaccacacattggaaccagatgttggccacgctgcgcaggcccgtgtccatgtggcacgctgtccggcgaaactagcaaccagggcgggccagttgggcaatggagctgctggagcccggtacccactcagctctgtctgatgccctctccatagcccagctggagccgtgaacactggggtcccctggcagagtcctcatgacccatcctggtctctctgtccagattgcagcagaggagtgggcgtggctctgtgt

SEQ ID NO: 21101 - DNA, 1661 bp, Homo sapiens
  ENST00000527043
actgcaggggtggcgttgccgccggcggccgggctaggcgcaggtgcgtgcgcgctgcgggaggcgggccggcagctggagcccagccggagcggcggcccctccgcggagcccggtcacagtcactgcagcagacatcatggctgtggatgtggcagaataccatctgagcgtcatcaagagcccccctggctgggaggtgggtgtctatgctgcaggggccctggccctgctgggaatcgcagctgtgagcctgtggaagctctggacgtcggggagcttccccagcccctctccgttccccaattacgactacaggtaccttcagcagaagtacggcgagagctgcgcagaggccagggagaagagagtgcctgcctggaatgcccagcgggccagcacgcggggaccacccagccgcaaaggcagtctcagcattgaggacacctttgagagcatcagtgaactggggcctctggagctgatgggccgggagttggacctggccccctatgggaccctccggaagtcccagtcggccgactccctgaactccatctcctccgtgagcaacacctttgggcaggacttcacactgggccaggtggaggtgagcatggagtacgacactgcctcccacacgctgaacgtggcggtgatgcagggcaaggacctcctggagcgggaggaggccagcttcgagtcctgcttcatgcgcgtcagcctgctgccggacgagcagatcgtgggcatttctcggatccagagaaatgcctactccatcttctttgatgagaagttctccatccccctggatcccacagccctggaggagaagagcctgcggttttctgtatttggcatcgatgaggatgagcgcaacgtcagcacgggggtggtggagctgaagctttctgtgcttgacctcccgctgcagcccttcagtggctggctctatttacaggaccagaacaaggccgccgatgctgtgggggagatcctgctctccctcagctacctccccacagccgagcgcctcaccgtggtcgtggttaaggccaagaacctcatctggaccaacgacaagaccacagcggaccccttcgtcaaggtgtacctgctgcaggatgggaggaagatgagcaaaaagaagacagccgtgaagagggatgaccccaacccggtgttcaacgaagccatgatcttctcggtgccagccattgtgctccaggacctgtctctccgcgtgacggtggctgagagcagcagcgacggccgtggggacaacgtgggccatgtcatcattgggccgtcagccagtggcatgggaaccacacattggaaccagatgttggccacgctgcgcaggcccgtgtccatgtggcacgctgtccggcgaaactagcaaccagggcgggccagttgggcaatggagctgctggagcccggtacccactcagctctgtctgatgccctctccatagcccagctggagccgtgaacactggggtcccctggcagagtcctcatgacccatcctggtctctctgtccagattgcagcagaggagtgggcgtggctctgtgtccagggccccagggtctgctcctgctgaggaccagctgtggctgggccaggacagaggactcaaccctgctcct

SEQ ID NO: 21102 - DNA, 527 bp, Homo sapiens
  ENST00000526281
aggtgcgtgcgcgctgcgggaggcgggccggcagctggagcccagccggagcggcggcccctccgcggagcccggtcacagtcactgcagcagacatcatggctgtggatgtggcagaataccatctgagcgagagtgcctgcctggaatgcccagcgggccagcacgcggggaccacccagccgcaaaggcagtctcagcattgaggacacctttgagagcatcagtgaactggggcctctggagctgatgggccgggagttggacctggccccctatgggaccctccggaagtcccagtcggccgactccctgaactccatctcctccgtgagcaacacctttgggcaggacttcacactgggccaggtggaggtgagcatggagtacgacactgcctcccacacgctgaacgtggcggtgatgcagggcaaggacctcctggagcgggaggaggccagcttcgagtcctgcttcatgcgcgtcagcctgctgccggacgagcagatcgtgggcatttctcgggt

SEQ ID NO: 21103 - DNA, 6028 bp, Homo sapiens
  ENST00000531392
tttaatgggaaactctccccgcacacacacacactttttttttgaggcacagtctcactatgttgtccagactggttttgaactcctgggctcaagagatcctcccacaccagcctccccagtagctgggactacaggcatgacccactgcacccagctaaatttttcaattttaaaatgttggcaactcacttaaatgtaagacaaataaacacatctgtaggctggcagtgctgcccacactgcccagactaggggttagggggtctgtatgggccatcaccaggctgctaaccacagcaaccaatatgtgccaagcctgactacacgtaccttctcattccaccctcctggcagcctcacatctgctttacaggtggggaactgaggctctaagagactaagaaaattacccaaggccactgcagctagccaggggcaggtatgggagtcagagctgggtgcagctgactacaaaccctgtgctcaggatgacaccctctaggagcctcgacctctctcccagttctcttctccctccactcaggcaaatgagctctgccttcacagggcaccaggctggaacatatgtctggaggccaggggcggtggctcacgcctgtaatcctagcactttgggaggccaagatgggaggatcattgaggtcaggagttcaagaccatcctggccaacatgatgaaaccccgtctctactgaaaatacaaaaactagctgggcatggtggctcatgcctgtaatcccagctacttgggaggctgaggcaggagaatcacttgaacccaggaggcagaggttgcagtgagctgagatcgcgccattgcattcaagcctgggtgacacagtgaggctctgtctcaaaaaaaaaaaaaaaaaaaaaaaaaagaaggaacttctgtctggggtgtgcctagcagtcattcacaccctcactgaaatctcagctccctgggaaaggatgtcgtgttaaagggagaggaaagaacagacagcgtgggagtctggggtctgagctgggccagccatggaggtgatggggcccccgacagccagaggccagatgcagcttgaggctttgtcccgtaccacgcctgttgtgctgtggggtgtactttgccatgcataccttgctcgcgtgctgcgggcattggctgtcccagcttggccccactcttgcaaagtcagcttgtgccaggtaagcaggaaaaagccgatggcttatctgattcccggcaaggcagaagcaggctgggaggtgcgtgtgtgtacattagcatgtgtttcagcgtatccagaccagcttccgccaggagctaggaccaccttgggcaggtacatggtgacccatttgacctgcagattcttaggaaactttttggaaaccatatgcccacttgcagtgagacacagtggttaggagcatggagccagttggcctgggttgaacagtttattagctgtgtggcctggggcaaattacgccctgggactctcacccgcaaaccagagataataatagtacctacctcatggggctgttaggcaaattaaatgaggtcagataaatgcaaagtgcttagaatggcgcttgatgtgtaagaagggctcgacaaggttctctattactatcattatctccagcccaggcccaggaatgagcttccactctagtcaggatgggtgaagcccttcctggcttagcaccacccttccatcaccatgacaacgcacatctccttgtgggagtgggggcagcatcaggagaactggaagccaggagctggctgtgcaccttatctgacctgcttctagaggctcctgggcacctccaggacttaagggggtagactaggacttatggcaccccaaatgtgctggataaccctgactggagcatggcaccgaagcttcttgactccaaagccacagactggggagaaccccggaattcctgaaaatgtggagggccttagctttaccctctgattcgaccccagtcccaaagggaacctacaggatgctccgaggggttgggaattggtgggtcacactccccaaggactttttatactgcgtctgaatggtgtttgcatttttttgcaaattggttgctacctttaaaactcaggaaatggcacataaaaaattcaggtatctggcttttctttaaagtgccagaagatcaagccacggtggttggcattcctgctggggcaaaaatgcagctgcccttgggccaggccatcactctgcagttcttacctccccttccccttgccctaccaccctgcaccaggcctgcaggcttaccatgtgtaaccacctctctgaactacaagggaatccagaaattggggtgggcattatcctggccctcggtgcccttgacctgagatcagtgcagcccatcccaaattcctttttccaggactcccacatacacccacttagaacacatctgtgagccagatttacttcttagcacactaataaaacaatgagcagtcacctaggttcaggtaatgggttgtacgagctcccagacctttctagaacaacttaagcctcagtcattcctaaaagctgggggtggaggatggggtggggaagaaaccatgccaagcagtgaaaggactgataatagaatattgcagacacgcagcctttccttcccaatcaaaatggaagcatttgaaggaaggctctggctcaagccaggggggccttgctctaatgagtcacctactgcgtcgccgctggtcagcctgatgttgttaggatggaaatgagctggggttgccagatttggcaaatacaaaaacaggacacccaggagcattgatgttttggatgaacaatggaaaagattttggcgtaaatatgtcctgtggaatatttgggacacacatattaaaaacgtatttgaaatttggccaggcgctgtggctcacacctgtaatctcagcactttgggagaccaaggctggtggatcacctgaggccaggagttcgatatcagcctggccaacatggtgaaaccgcatctctacaaaaaatacaaaaattagccgggtggggtggcacatgcctgtcatcccagctacttgggaggctgaggcaggagatcacttgaacccaggggcagaggctgcagtgagccgagatcgcgccactgcactctagcctgggcaacaaagagagactccatctgaaaaaacaaaacaaaacaaaacaaaatctgaaattcacatgccactgggcatcctgtgttttatctggcaatcctgagaagagtcttagaatgcttgaaaagagctttaaacatcatttcttaaaatgccaagcctccctttggtggcactccccttatagctgagtgtaagctctggatgacaggcacgtgggtgccaggaggccaggacctaggagcgggacgctgactctctgcagccctctcctctcactctcttttcccttccagtcacagtcactgcagcagacatcatggctgtggatgtggcagaataccatctgagcgggtccccggggagaccctcatcctgctgcaccctggggatgagcctgtgactcggaatccactcaccgaggccttctgtggagactgtcaagtagccaagggaaaataagcccaggaaggtcaaggttagattcatggggcgttaaactcagagaccacccagtccagaggcagaggttatagtgagctgagatcacaccactgcactccagctttccagcctgggcaacagagtgagactccgtctcatcagaaaaaaaaagaggccacccagtccagggccatggctcccaccttgtcaccctttgcctcagcagggagatgggagctggctgggagatgcctcgagactccagacatactcctgcagccctccccatggacagcggatggggtcagagaagaaacataccagccgtcttttctccctttgttcctctcctcattcacagatgggagaagtgaggcttagagagtaacggggtcaggatgtgcactcaggtctcctgactcccagccccgtgctccccatcactctagcccctaccctaacgcagcccctggggagcccagggctgatctgaagggtgtgcccgggaatcacctttcccatcactttttcccaaaagtgagccagggagccgcacttttcaccctcaggctcacaggtcttgcccccctgcccccaccctgccccctacccgtatggccttgggcaagtggtgaaaccggaacttctacttacttatctgtaaaatgcaaaagatgaggcttgcctcagggctgttgggaagatttagagagctgatggttgtgcagcgcccagcatggtgcaaacgccactcttccagtggcagcgctttgcacacgctgttcccctgtcctggagtccttccctgcctctgccactgcctgcctgagtcctggcacctggtggtggggttataggtgcagatctggacccagtctgtctggaggcagatctctcctccgtccctcagcttcctcatctgtaaaatggggaaaacaatagaaccaacctcacaggattgccttgactccatgggttaatatacgtgacgtgcttagaacagggcctggcaaatcataaatagtaagtgcttcataaggggagctattcctcctcctcctcatcccactcgtttctggtcttcgcctagaccccacttccaatatcaccccaagactggtattccataaaatcaataaatgaatgcgaattgtcatttcatgtcaccttcctggggcttttccttctgtgcccccagccctgcccccttttctgccaccccgggcatgggctccacccttcagctcccaaagagcctcaggcacaggggagcctgaacctgctttgccacctggctgtgcccacagcctgcttagagaccttgggcctctggtcctgccctctagccaacccccggctactacccagccctgctgtgaccctgttcccaggactcccagaatacaccaagccttagcagggcggggcccgggagcctccatggatctctttgtcatgggcatacgtagcccacaggtgacattctgtcaacagcggcaggaggaaggagggtttcttcacagcccttccaccgtcgttacccattccttctgtttttccctggtctgcccagcccgtgactatgtgctgcgtgacttttgcgcacgtcacacgattgcgtgattagaccatgttggggattcatttttttcctctcttaacaatgccagaaatgtgtctctgcattgccacagtgccatcctaatgacctcaattgtcattctcgaaggccagtgacatttcctcccaagacagagccaccagccctcactggccccctcggtgggaccttcaggctgtctccagatttctgctgttataaatacagcctcgatgactcatcccagacacaaaacctgttgggattttccctttagaataaattcaccagagtgggaccgctggatgggggatgttcttgtcatccgcattttccaaacggagtatgaagcccagaggtgctgggtgacttgcctggaagccaaggtaccggtgcccggctctgccgtttctcaccgctggccttgagtggagaaacagatgtgctcattacccttccttggtctcagttttcctcttttagaaagtagggccttggccaggggcggtggctcacgcctgtaatcccagcactttgggaggccaaggcgagtggatcacctgaggtcaggagtttgagaccagcctggccaatatggtggaaccccatctctactagaaatacaaaaaattagctgggcatggtggtggacgcctgtaattccagctactcgggaggctgaggcaggagaatcgcttgaaccggggaggcagaggttgcagtgagccgaaatcgtgccattgcactccagcctgggcaacaagagtgaaactccatctc

SEQ ID NO: 21104 - DNA, 593 bp, Homo sapiens
  ENST00000533427
attcacaccctcactgaaatctcagctccctgggaaaggatgtcgtgttaaagggagaggaaagaacagacagcgtgggagtctggggtctgagctgggccagccatggaggtgatggggcccccgacagccagaggccagatgcagcttgaggctttgtcccgtaccacgcctgttgtgctgtggggtgtactttgccatgcataccttgctcgcgtgctgcgggcattggctgtcccagcttggccccactcttgcaaagtcagcttgtgccagtcacagtcactgcagcagacatcatggctgtggatgtggcagaataccatctgagcgtcatcaagagcccccctggctgggaggtgggtgtctatgctgcaggggccctggccctgctgggaatcgcagctgtgagcctgtggaagctctggacgtcggggagcttccccagcccctctccgttccccaattacgactacaggtaccttcagcagaagtacggcgagagctgcgcagaggccagggagaagagagtgcctgcctggaatgcccagcgggccagcacgcggggaccacccagccgcaaaggcagtctc

SEQ ID NO: 21105 - DNA, 519 bp, Homo sapiens
  ENST00000525149
ctcactctcttttcccttccagtcacagtcactgcagcagacatcatggctgtggatgtggcagaataccatctgagcgggtccccggggagaccctcatcctgctgcaccctggggatgagcctgtgactcggaatccactcaccgaggccttctgtggagactgtcaagtagccaagggaaaataagcccaggaaggtcaagtcatcaagagcccccctggctgggaggtgggtgtctatgctgcaggggccctggccctgctgggaatcgcagctgtgagcctgtggaagctctggacgtcggggagcttccccagcccctctccgttccccaattacgactacaggtaccttcagcagaagtacggcgagagctgcgcagaggccagggagaagagagtgcctgcctggaatgcccagcgggccagcacgcggggaccacccagccgcaaaggcagtctcagcattgaggacacctttgagagcatcagtgaactggggcctctggagctgatgg

SEQ ID NO: 21106 - DNA, 2997 bp, Homo sapiens
  ENST00000367019
ccctctcgctggcggactcagcgcgtcctccgccagccctcgcgtctgctgcccccgccatccagttggtgcggtccatggcgagcgcatcatggcgattgaaggtggagagagaacctgtggagtacatgaacttatctgtattagaaaagtatctccagaggcagttggatttttgtcagctgttggggtgtttattatcttgatgctgctcctttttctctatattaataagaagttctgttttgaaaatgttggcgggtttccagatcttggttcagaatacagtacaaggaagaattcacaagataaaatttataattcctacatggacaaagatgagcatggttcatcctctgaaagtgaagatgaagcgctgggtaaatatcatgaggccttatccagaacacacaattccagactaccactggcagattctagacaaaggaactatgcttgggaaacaaggcagaaatacagtcctctatcggcagagtatgatggatacagtagtgaagcatcaatagatgaaggaaactgcattcagagaatgagaagaacacccccgctggatgaattgcagccaccaccatatcaggatgacagtggttctccccatctgtcatgtacaccctcagaaattggggacagtaaatgtgaattttcccactgcagcaacagtccaagatgctcatataacaagtgcccaagtgaaggaagcacaggtcatgaaatagaaagttttcataataaaggatatgaagaagatgttccaagtgacagcactgcagtcctgagccctgaagatatgtcagctcaaggatcatcttcgcagcttcctaaaccttttgatcctgagccagaagctaaatatggcacactggatgtgacttttgactatgactcacaagaacagaagcttctggtaacagtgacagctgtcacagacatcccaacatataacaggacaggtggcaactcatggcaagtacaccttgttcttctacctataaagaaacagagagcaaaaaccagcatccagagaggaccatgccctgtcttcacagaaacatttaaatttaatcatgttgaatctgagatgattggaaattatgcagttcggtttagactgtatggtgtacatcgcatgaaaaaagaaaagattgtgggggaaaagattttttatttaacaaaattgaatcttcaagggaaaatgtcattgcctgtgatattggaaccttcttacaatcattctggctgtgactcccaaatgagcgtgtcagaaatgtcgtgtagtgaaagtacatcctcatgtcagtctcttgaacatggctcagttccagaaattcttattggcctgctttataatgccacaactggaagactatcagcagaagtgataaaaggcagccacttcaaaaatttggcagcaaacagaccacccaatggactgttctgttgtctaaaacacttgataggtggacaggtttatataatccgagatacatatgttaagttaactctactgaattccatgggtcaagagatgtccaaatgcaagacatccatccgcagagggcagccaaatccagtatataaggaaacttttgtctttcaagtggccctatttcagctttctgatgtgacactcatactgtctgtgtataacaaacgcagcatgaaaagaaaagagatgataggctggatttctttaggtctcaacagctctggagaagaagaactcaatcactggactgaaatgaaagagtcaaaaggacagcaagtatgtagatggcatgcgttgctagagtcatgatgaatagaataagcaagcagttaccatcaaaggcagcatatttccaattccaacattactgtttctaccaagtcccattagaagagctgttctttgaagaatcatattcaaccttctaccaaaatgctttaagttctatggaaagaacgtctcatactgacataaatgaagaaaatatgtgtatctagtagagcttgtttaggaaactgagaaacgtacactatcattgctaaactaacagtcctccagaaatttaataagatgtttttgatttgaagttaattttaatttagcaaaagagccagtcattttatgaaaaatcaaaattataagtgattttaaaaaccagaattttagttgcaatacaattttaatatcaccctacatattatttataaaacatagtttgactggccagtccctggtgtttgtaatgttctttaatatgaaaaagtagttctccaactctatcataagtcatatctaatggtgaagggtttcagtcacattgaaaattgttttatttcaggcatgttccctttgtgcacttaggttcattgtgcctcagttcctctcaaaagcactaaatctaagtgcaaacaagtattcattttcatacaggaatttttttaatatgttatttttttaaaagttcatttttcatttgcctccgctttcgcctgatccaaagagaccaagtcactgtactggtcccttgcaagtcttctagacaggttgtactgtagaactacgtaactttctgttgaaagcacttcctgtattcttgtattccaatgtaggaagctaatagagcaggactttactttcaaatttctttcagtgattgactcttcaaaattgcagtagtgtgaaaatacattttttacaaactgaaaatacagtagataagctgtcgaaaatggaaaacaattcaattttaattttctgctctgagtatttagtaaccaacactgcgtaaagcaggtagcattcaaaataagaaactgttctctctctaaatcttcactcttacttcaatttatatttgtgatatgaagactatccagttctcagtttgaattggaacatcatgttaaaaacagttatgagattccttatgaagtttctagtaacttgtaactagactttatgaaattaacagataaagttcttcaacgtga

SEQ ID NO: 21107 - DNA, 13567 bp, Homo sapiens
  ENST00000637265
cggactcagcgcgtcctccgccagccctcgcgtctgctgcccccgccatccagttggtgcggtccatggcgagcgcatcatggcgattgaaggtggagagagaacctgtggagtacatgaacttatctgtattagaaaagtatctccagaggcagttggatttttgtcagctgttggggtgtttattatcttgatgctgctcctttttctctatattaataagaagttctgttttgaaaatgttggcgggtttccagatcttggttcagaatacagtacaaggaagaattcacaagataaaatttgtgtagaataaaaaaccaatagtatttgagggaaaaatattgtcttgctgctgttataatagctgtggagtgagaaaaaatgtcataacgtttaaaccaagtggtttgattttttttttccggaagaatctttacttcaacatatttctttcaatgcataatgtatttacagaaagattaaaagctacaatgtgaattgctaatattgagctgacgaatagcaacatttaagtaaatgttaaattcaagttccaaagtggttgatattttcagaagagaaaattccattattgcaccttttaggaacaaggaattagaaaatggcatttttcagaaatttccaacagaatctgccttcagtgtcctctctagtagacacaatcagtagtgctgtagaggatttgaccactgctgttggggaggtcagctatgctttaactgactcagttgctgagcaggtaacaagtatgatgagtggctttcgcccagaagaggaaagctctgtagcagaagaagctgtagacacttctaaacaaaaaaatgccgggttaacagaagtctccaaaaacactaattgtcagaaaacacaagccaatttagagcatagagcaaagcaaataaatacttgtaaaacttcactaaagcaagatcaaggaatacatgaagaaagagtatttaaacatgttaatgataggcaacaaactctatcagaatatcaagacactggtaatactggtgattcttctttgaaaggctacatgaataatggtgggatatcagttatcagacagaatacaagggctggatctatttgtcaagaacttgaaagtactgacagatgtaaaacaattggagtaggaatttccaataatggtaagaatgatttaaaggaggtaggatatcaagaaatgaaaggaaatcagaagaatgccaacggaataaacaaattgtatgagcaaaagaaatatgttggtacagataattgtaaaaaggaggaatattctaaatctcgacatgtatatttgggaagagatcaagagaatatggggcatttcaataaatgtaaacatcttcccgatttagggcattcagatcatttaaagaaagctgaaaaatgtgttaaaagtaaagcatccaaagggaatgagtgttcaggaaatgaatgttctttaaaagatattttgacaagcaataggcatatgacacagaaatctattataaaagaagacatacatccagcaccatcaactaattctaaagataagttatctgggaaaattgaagaacaaataaattcaacgaaatactgtaaagtgaacgaagacataaaaccaaagaaaactgaggccatttctgccaagaaaggaacagcaaagagtaaagatgaaaaatattctaagataataccagaaaaagataattcctacatggacaaagatgagcatggttcatcctctgaaagtgaagatgaagcgctgggtaaatatcatgaggccttatccagaacacacaattccagactaccactggcagattctagacaaaggaactatgcttgggaaacaaggcagaaatacagtcctctatcggcagagtatgatggatacagtagtgaagcatcaatagatgaaggaaactgcattcagagaatgagaagaacacccccgctggatgaattgcagccaccaccatatcaggatgacagtggttctccccatctgtcatgtacaccctcagaaattggggacagtaaatgtgaattttcccactgcagcaacagtccaagatgctcatataacaagtgcccaagtgaaggaagcacaggtcatgaaatagaaagttttcataataaaggatatgaagaagatgttccaagtgacagcactgcagtcctgagccctgaagatatgtcagctcaaggatcatcttcgcagcttcctaaaccttttgatcctgagccagaagctaaatatggcacactggatgtgacttttgactatgactcacaagaacagaagcttctggtaacagtgacagctgtcacagacatcccaacatataacaggacaggtggcaactcatggcaagtacaccttgttcttctacctataaagaaacagagagcaaaaaccagcatccagagaggaccatgccctgtcttcacagaaacatttaaatttaatcatgttgaatctgagatgattggaaattatgcagttcggtttagactgtatggtgtacatcgcatgaaaaaagaaaagattgtgggggaaaagattttttatttaacaaaattgaatcttcaagggaaaatgtcattgcctgtgatattggaaccttcttacaatcattctggctgtgactcccaaatgagcgtgtcagaaatgtcgtgtagtgaaagtacatcctcatgtcagtctcttgaacatggctcagttccagaaattcttattggcctgctttataatgccacaactggaagactatcagcagaagtgataaaaggcagccacttcaaaaatttggcagcaaacagaccacccaatggactgttctgttgtctaaaacacttgataggtggacaggtttatataatccgagatacatatgttaagttaactctactgaattccatgggtcaagagatgtccaaatgcaagacatccatccgcagagggcagccaaatccagtatataaggaaacttttgtctttcaagtggccctatttcagctttctgatgtgacactcatactgtctgtgtataacaaacgcagcatgaaaagaaaagagatgataggctggatttctttaggtctcaacagctctggagaagaagaactcaatcactggactgaaatgaaagagtcaaaaggacagcaagtatgtagatggcatgcgttgctagagtcatgatgaatagaataagcaagcagttaccatcaaaggcagcatatttccaattccaacattactgtttctaccaagtcccattagaagagctgttctttgaagaatcatattcaaccttctaccaaaatgctttaagttctatggaaagaacgtctcatactgacataaatgaagaaaatatgtgtatctagtagagcttgtttaggaaactgagaaacgtacactatcattgctaaactaacagtcctccagaaatttaataagatgtttttgatttgaagttaattttaatttagcaaaagagccagtcattttatgaaaaatcaaaattataagtgattttaaaaaccagaattttagttgcaatacaattttaatatcaccctacatattatttataaaacatagtttgactggccagtccctggtgtttgtaatgttctttaatatgaaaaagtagttctccaactctatcataagtcatatctaatggtgaagggtttcagtcacattgaaaattgttttatttcaggcatgttccctttgtgcacttaggttcattgtgcctcagttcctctcaaaagcactaaatctaagtgcaaacaagtattcattttcatacaggaatttttttaatatgttatttttttaaaagttcatttttcatttgcctccgctttcgcctgatccaaagagaccaagtcactgtactggtcccttgcaagtcttctagacaggttgtactgtagaactacgtaactttctgttgaaagcacttcctgtattcttgtattccaatgtaggaagctaatagagcaggactttactttcaaatttctttcagtgattgactcttcaaaattgcagtagtgtgaaaatacattttttacaaactgaaaatacagtagataagctgtcgaaaatggaaaacaattcaattttaattttctgctctgagtatttagtaaccaacactgcgtaaagcaggtagcattcaaaataagaaactgttctctctctaaatcttcactcttacttcaatttatatttgtgatatgaagactatccagttctcagtttgaattggaacatcatgttaaaaacagttatgagattccttatgaagtttctagtaacttgtaactagactttatgaaattaacagataaagttcttcaacgtgatgtcatcttgtgcctttcatgtaagttaaatttgctcatacagcttgaacgttgtatttgcaaaattaagccttcgatttttataaatgtaaagattcctcagaacagtgtcgcaagatctttatttcctctgaagtatgtaaaagttgtataatgtgctaactttttaatggcaaggcactttcatttgtttttatatttaggaactctaatcaggaatattataagctgttttctttttaattttgcttcttacctaatatatcattttatgcatatactttatcagagtatgttttatatatattaaaaatagtttcttttttctccttctcatttctagttaaaatagacaaaaacatactatttaccagttactaaaaagcagtatatcattgcttctagtcccaactaagtactatatattattgtaaactagaacttgttattaccataataacaaaacaatgcgtagatattacttcagcttggctgtactgaaaggccttaaaagaaacccaaaaagaccgtgaacttctgtatttttttagtttaaaaaatggcagctctatgcattcatacacatgaattataagaaaaaatacaaatgctatattggatgacatgaggtttgagaatgtgtgttacagggctgcattaaagggaaaaatccatcttttattgttacatcaatgagctttttccaggatttttcaaataaacaagtaagagttagaacctgaatcaaatggcaaaatatctcatttaagtgttttcagcaacagtatgaaaaaagacttgaagaggggatgtagattttactgagaaattggacttaggcatttgaagctataatgaactttttagactttgaaacaactgactgcattgctaacaactgttatcttcctaataaaaagagttatcagtcttatctgtaactgtaacagagcttagtgaaacacattagtaagaccagcttggtgctttcactcttagtgagaaaaagacctaactaattgttatttgttaaatctaccttttttcagactattcccagaattgtgtgtgtgatttgatacatccctagggatttatctggcataagtatcaaatccttcatggcttaaaaattaataaacagttttttaatatttctggaaagaccctacctccaccccagctgccaagtcctcaaagattataaattatctatatgagtgtatgtatctgtatacacacatgcaccattacacatacaacataaatatgtatatgtatattcatttgtaaaggcaaaggtgccctggctttttcagataactgaatagaaaaacatttcatacatttaggattatttttctcctctatgtatttactagatattatatttggtttgggttgctttctgctgctgttctccttcacacacagcaaaatatacatttgtttctgtagattgacacaacttataataattactcccaaaaagttgtctgttcttttagaaaaggattaaataaggctcaggggacccacttcactctactgaatctaatgtacgagacagtactactgcttctttgtgtgcttgaatttgcatgaaagcttaatagcaaaatcttctatctcagtaattatagcaaatagggacctactggtagggagcaggtgttggctcagaaacctgaaaaagacaacccactttcatacagttctattaaaatcccctaagttttctaataaaatgatatagtccaaatatggcaatcgactggcatttatgggagcctctaaacctggaattatggggtttatttttctcccaaatgagctgcaaaagataattattgctgcccagtaaacaaaatgtatgtcaaatcagtaaagaatttgtttagcataatattgccttatctttcagaagctttcttctatattcttgtgtcttcagtacaatccacttttgtttgaaatccatttgcatattatcttactgtgcatttagtgaattctcaataatgttgtatttgctgacaagaataataaattggaccacaattaaaaaaaaagaaaacccaatgagaaaataactacctgattaatatacacatgtttaaatgtaggacctggtaaagcagtttcatccaacctagcgaaaatgcccagggctgtttgttaaatcatttgcttgataccatcatcattttcatttcacttatcaagtgaatcagaagcataatcaataactgcaaagtaagatagtaccaataggagaaagaggtaaaagaattgagagtgtttgtcaatatgaagatgtgtggggatactgaatgatatcatagtctttccagtgaaagaaaaaataggctatgggaagatgtaaatttttgatggagtaagaacagtggtcaccaccaagtatttttcaagatccctctccagctatgaatagaaaggacacaaattcatttgcgtaaaattgccatttgcctacatagactagacaattcacagatttttcacaaagacagttattatatatatagttatttgagttatcactatattatttcacattgatagtttttatttctaattttgtttccattcactgtcctcagttcctctgtggcctacattgaaggtagctgtcagtattattattgtcaaccatatttaatattgaatacaagtttaagcatgctgcaaagcattttctaacgttaattttaaaacattgtctctgccctccaaagtgatggttaacagctataatttactaagatctagcacaataatttattacttgcttgattctcaaaacaatactgtgaggtaagtaatgttatcaacattttattgataaagaaactgcagcatgaagaggttaagcagactttcccaaggtcattcggtaagtaagtagtagaactgggattggaacccaggtgtaaattactctaaaacccatgctatgcatgttgcatttgcctccctgtttgaaaaaaaaactacttaggacattatatttatcaataatcccactcaccttgattgaatggcagaactaagggggaaaaaacagctggggaaagagaaaagactagaaaagaagatcagaaattttttttcttctcaggacacaagtggtggtacttttgtgtcattttgtagatgactttgatttgcaaagatttggaattgatttattctaccagtttagcctatacttatattccaaaagcatattaatcagttctgctccttgaccacttttaggaatccaaggtgttttaattgttacatgacccccttactactctatgaagggcataacctgtgtctagcccatatctcactcatatcagtggtgagacaaaagatttgtcttcctctgtcctctcattgcaatttatttatgttttattctcaattttattaagatttgtcaggaattacagctagtttattacatatgtctctcttccccctaggtaagtagtcaatgccttgttagtatctttctgtacccctttgcttatagtaggcagacagtaaatattgaattgaactaaattccctgtggaagaagccagtcacactattacatgagtcttagtttttatgaatcttgtgttatgtatggatttatttattccttcagttaatatatatttaagagtactagatatgtgccatgtgttgttgttccaagtgctacagatgcagagataataaattggtcgaagtctttgccctcatggggcctacattctaaggtaggaagatggccacagaatgggataatttcaggctagtataatgaagcattaagataggggcatgcatagagtaccgtgggatttagtagaagagtgcaacatggaattcaaaaaaatcttcctggaaaagataatccctgagttgggtcttaaagaacaaatacatgttagactcccatcaaacttgaggacacacgttctttccaagaacaaaatgtaaaataatggtttctaaactgtagtatccttaagaattattttgaaaatttaacttgggccaggcgtggtggcttacgcctgtaatcccaacactttgggaggctgaggtaggcagattacttgagctcaggagtttaagaccagcctgggcaacatagcaaaaccccatctctaccaaaaatttaaaaattagctgagcacggtggtgcatgcctgtggtcccagctactcaggaggcttaggtgggagaatcgctggagcctggcaagtcaaggctgcagtgagccaagatagcgccactgcacttcagcctgggtgacacagaagaccttgtagaaagggaggaagaaaggagggagagagagaggaagggaggaggagaagggaaggaaggaggagacgggaaagaatgaaggagaagggaaagaagggagggaaatttaacttgtattccaaaactccacctccagagattctacttcatttggcctggaagggagcccaataatctacattttattaagctctccaggaaattctgtctgagatctattgatatagaatattaagtgtattacatagtagtattcatgaaatgtttcagtgcctgtagatcagacctttaagtgtgatagtgatagtaatacagagattaagactaggattaatgttattcatctttttcttgtgcttccttaaaaaggaagatatttaatgaaaaaaattaatatttaataatgaatttctgtacattcacattcaacatacatttttcaaagtgtttcttggtataataaatatgttgattttatggcttccaaaaattcctttctatcactgttcaaatatttccttctaagttatctttacaatgatggatataaagtgaagaatggggaggtatttatcaagtaatttctttatcagtatcctaaatgaaataagactgacctttgagcaaatgtgtagtagcagccataggtgctggcatgtttgcattcttgcatacagtaagatttcttgcttccctttatcatcatctaaatggcttcattgtcatcacactcatcagatgaaatgcagtactggattcttctctaaaagcagtgattctgtgactgctgctctaaactctagttccttgattgttttgttcttaggatcctttgtttcaaatagcaagttaatacagcagcctcaggaccttctctttctctcagaataaatgctgtggataaggtacatctgagtttccatttcccctcatttcacatatagccatattttcttctctgatgtaatattttgtattaacacattttacattttgaagttttcttttcccccacaaagatatgtggttatcccacttaaaaatgagcttatttgaatatgtgaaataatgttgtcattgaattaagctgttttgtgactgctgatgtatcactgtgtttgatttggtgacagcttgaggtctggttaatataatcttaaggtaatcagcttgatagactggaattactagtttattatcaaaaaatgaatgtaaaaatattgctcttttctctccctgtttagactagtatgtgcctttttaaaaatactccctttcttcttccctgccttttttccccactcttattcatatacactcaaactagataccagagttagttcatcaaagctgaataatacctatcaaaaagtgataccctgacttttttctcttaatcacctgtactggaccatagggaggaccaaataggctttcttggggactacagaaagagcaaagcgtaatactctttaatcatagcatgtttgttgttgctgtttcggtggtggtggtggtggtggtggtggttgtgtacttaccttgaatagtgtgaagtatcctaaaattatgttgtgtgggctgggagcaggaaggaaactgattattcgtctaacaaaggtttggcataattttattgtaaaatttcaactgtttatgacatgaaaatttctaattaattataagaacaaagtcactgtggtggcaatagttgtacaagatgtttgacattatttctatgtcagtttgatagtctgtgttataaattgtcttattaggacccttcttcaccctcttctttattattctgattatcagtaaatccagtttgtactgttagacatttgagtttgtcttttaaatattgaagactattttaaaaagaaaaaccataacatctttctgtttattacattaacatgtgatctctcacctgacgatgtgtttaaaatgaattaatagataaaatataatactccgttatatactgaaaaaaattttcaaactttgtctatatattcagatattgctagcagttcatattaaatatgactattttgtttaatgagaaaataggaatttttccttatctctgagacttactgcttctctttgccattcacatctggttgaaggtggatggttttgaacctcgtaacgtcacttcactcgtcagtttctgagtgtgccaacctccttctgacggtttaattttcagtaacaatcaaaccatttattcctcaggggttggtcctcctagtgattcctgtccttaacccccattagtgttgatggaagtaatccataagcaccaataggagaaaaggcccataaaggatcagtatcccagaaccctgaaataggacggccgcttcagtacccaaatgtcattgcaattctaatggagtagaagccagcttcttggaagtgaagatttgagatcattatgtcatattctctccttttggtgtcctcccttctccctctagcttgcacattctttttattttaaattttacaggaagccttcttttaaaaacctggtttttaaaatttcacatgttgctgtaaccaggtgatttcaaaacccagaaaactgaagtacataccatacagtcataagaagtttgggggcttttttggtttttatgtttttggtgttttttttttttttttttttttttttttttgtagtgtggggagtggggaggaggaaaagggagaaatcgtgcttgttttggttttgggaagtctttttggataaatattgagaatatttatagtattctgtaattatgtgacatttgttgtgtgaggggagaccagagtagctgttgcacatacatcgactctcttaatattgaagcatatttaaacagttgtttgaagcagagctagaaattaatggtgatacttctaacagcattttgatgttataaatattactttaagtttatcaagagaaaaattccagtagtagcttgcgttataaaattaattgatttattatgtttctgtataattttattgaaattgcttttttgtggtgaatataatatagtggcaacgattttgaggaatctttaaagctgtttggaagagatggccagcctttggctagatttttactagaattttgaaataagaaagtgtataaatatgttttcagttaaattagccttgaggaagaatagttattatatgagttttaagggtcttgataaatgttgggacctactctaaaactcatgaggttcctcactgatcaatactcttgcattgtattttatttctcaaaataatgaaatttttatggaaaagctcaattagtggaatcttttattcaatattcccttactcttctttcttccttccttctttctttcctttcttccttccctccctccttccttcctagttctttcattttttcaggcaagaagcttccttaataatatagtttctacagagctttcttacttatttttctaataatggatataacagtgtgataaagtttaaatgctccgtgagcaaaactcttatcaaacaactgaagaaatacactgctgattaaccttttccttggtcttgaattgtctccagcatatttgctagtgactaaaccattaatggatcttattagtataaacacatgtctgtgtggttatcaacagtgttgtattattgtcacatttatttacatttttggtcaaaaatataaacatgcgtgtgtgaagcagtctgttttatagagtgagcatatatgtaatcgttttcatataattgaaaatgtgctgtgtgttgcattttattctcatgtcgacttttctactatgtatacaccgattgtctcggtgcctttttccttttgtataattgtattacatacagaaattgctgacctctgtgaaaacagtgtaaaaaaagttaaaattattattccgatgagattttaatggcagtttaattttccagagaataaattttgtgtgggttaaaagttatttttcttcacctttatgtaaaaaatctgtttacgttttagtactcacatggaatgggtaaacatctgacttcattgatgatgatacataaacatcagtcctaattcttgtcattgacaaataaatgttaatatgactgttacacaaaataaaataatgtcaattacataaggaaatatcaaatggatatatgtacatgttatttagatcttgggtttgaaaggaatctcatctaaatgtgctataaaatattactctcaaaaggtttgggtcatattattttctttaattgtaagtcaaatctggcttccaaagaaaatagacttacaaatgcaaacatttaaaaatattctcctttaaagttcatataaatcacaaattaaactaaatagctttaaaatgatctcagtatcttcagctggaatatgaactgttacctagtttgttctttcacttaatgtgaatttgttgtcattcatatcagtattgctatcctgtttaacaaaataattttctctttgccaatagtagtttgttgatttttaattctttttcattagctagttgtattgtttccctaagacctggagtttagatatttttcatatttcattaccttgtccattttacttccagcaacaaagatttataacaacagacttaacaagtactattttgcatatgaaaaagaatttaaacgtttggtgctctaaaactgaaagaaattaaagttgctgcatcatctaatctctgattgtctttgaatccttagttccataaattatccagagccttttttagttaacatttttaaagagggg

SEQ ID NO: 21108 - DNA, 2549 bp, Homo sapiens
  ENST00000637945
atggcgagcgcatcatggcgattgaaggtggagagagaacctgtggagtacatgaacttatctgtattagaaaagatagggtatttctctgtggccaggctggagtacagtggcaccatcttggctcactgcaacttccgcctcctgggttcaaacgattcttctgcctcagcatcccaagtaactgggactacagtatctccagaggcagttggatttttgtcagctgttggggtgtttattatcttgatgctgctcctttttctctatattaataagaagttctgttttgaaaatgttggcgggtttccagatcttggttcagaatacagtacaaggaagaattcacaagataaaatttataattcctacatggacaaagatgagcatggttcatcctctgaaagtgaagatgaagcgctgggtaaatatcatgaggccttatccagaacacacaattccagactaccactggcagattctagacaaaggaactatgcttgggaaacaaggcagaaatacagtcctctatcggcagagtatgatggatacagtagtgaagcatcaatagatgaaggaaactgcattcagagaatgagaagaacacccccgctggatgaattgcagccaccaccatatcaggatgacagtggttctccccatctgtcatgtacaccctcagaaattggggacagtaaatgtgaattttcccactgcagcaacagtccaagatgctcatataacaagtgcccaagtgaaggaagcacaggtcatgaaatagaaagttttcataataaaggatatgaagaagatgttccaagtgacagcactgcagtcctgagccctgaagatatgtcagctcaaggatcatcttcgcagcttcctaaaccttttgatcctgagccagaagctaaatatggcacactggatgtgacttttgactatgactcacaagaacagaagcttctggtaacagtgacagctgtcacagacatcccaacatataacaggacaggtggcaactcatggcaagtacaccttgttcttctacctataaagaaacagagagcaaaaaccagcatccagagaggaccatgccctgtcttcacagaaacatttaaatttaatcatgttgaatctgagatgattggaaattatgcagttcggtttagactgtatggtgtacatcgcatgaaaaaagaaaagattgtgggggaaaagattttttatttaacaaaattgaatcttcaagggaaaatgtcattgcctgtgatattggaaccttcttacaatcattctggctgtgactcccaaatgagcgtgtcagaaatgtcgtgtagtgaaagtacatcctcatgtcagtctcttgaacatggctcagttccagaaattcttattggcctgctttataatgccacaactggaagactatcagcagaagtgataaaaggcagccacttcaaaaatttggcagcaaacagaccacccaatggactgttctgttgtctaaaacacttgataggtggacaggtttatataatccgagatacatatgttaagttaactctactgaattccatgggtcaagagatgtccaaatgcaagacatccatccgcagagggcagccaaatccagtatataaggaaacttttgtctttcaagtggccctatttcagctttctgatgtgacactcatactgtctgtgtataacaaacgcagcatgaaaagaaaagagatgataggctggatttctttaggtctcaacagctctggagaagaagaactcaatcactggactgaaatgaaagagtcaaaaggacagcaagtatgtagatggcatgcgttgctagagtcatgatgaatagaataagcaagcagttaccatcaaaggcagcatatttccaattccaacattactgtttctaccaagtcccattagaagagctgttctttgaagaatcatattcaaccttctaccaaaatgctttaagttctatggaaagaacgtctcatactgacataaatgaagaaaatatgtgtatctagtagagcttgtttaggaaactgagaaacgtacactatcattgctaaactaacagtcctccagaaatttaataagatgtttttgatttgaagttaattttaatttagcaaaagagccagtcattttatgaaaaatcaaaattataagtgattttaaaaaccagaattttagttgcaatacaattttaatatcaccctacatattatttataaaacatagtttgactggccagtccctggtgtttgtaatgttctttaatatgaaaaagtagttctccaactctatcataagtcatatctaatggtgaagggtttcagtcacattgaaaattgttttatttcaggcatgttccctttgtgcacttaggttcattgtgcctcagttcctctcaaaagcactaaatctaagtgcaaacaagtattcattttcatacaggaatttttttaatatgttatttttttaaaagttcatttttcatttgcctccgctttcgcctgatccaa

SEQ ID NO: 21109 - DNA, 2966 bp, Homo sapiens
  ENST00000472886
atggcgagcgcatcatggcgattgaaggtggagagagaacctgtggagtacatgaacttatctgtattagaaaagtatctccagaggcagttggatttttgtcagctgttggggtgtttattatcttgatgctgctcctttttctctatattaataagaagttctgttttgaaaatgttggcgggtttccagatcttggttcagaatacagtacaaggaagaattcacaagataaaatttataattcctacatggacaaagatgagcatggttcatcctctgaaagtgaagatgaagcgctgggtaaatatcatgaggccttatccagaacacacaattccagactaccactggcagattctagacaaaggaactatgcttgggaaacaaggcagaaatacagtcctctatcggcagagtatgatggatacagtagtgaagcatcaatagatgaaggaaactgcattcagagaatgagaagaacacccccgctggatgaattgcagccaccaccatatcaggatgacagtggttctccccatctgtcatgtacaccctcagaaattggggacagtaaatgtgaattttcccactgcagcaacagtccaagatgctcatataacaagtgcccaagtgaaggaagcacaggtcatgaaatagaaagttttcataataaaggatatgaagaagatgttccaagtgacagcactgcagtcctgagccctgaagatatgtcagctcaaggatcatcttcgcagcttcctaaaccttttgatcctgagccagaagctaaatatggcacactggatgtgacttttgactatgactcacaagaacagaagcttctggtaacagtgacagctgtcacagacatcccaacatataacaggacaggtggcaactcatggcaagtacaccttgttcttctacctataaagaaacagagagcaaaaaccagcatccagagaggaccatgccctgtcttcacagaaacatttaaatttaatcatgttgaatctgagatgattggaaattatgcagttcggtttagactgtatggtgtacatcgcatgaaaaaagaaaagattgtgggggaaaagattttttatttaacaaaattgaatcttcaagggaaaatgtcattgcctgtgatattggaaccttcttacaatcattctggctgtgactcccaaatgagcgtgtcagaaatgtcgtgtagtgaaagtacatcctcatgtcagtctcttgaacatggctcagttccagaaattcttattggcctgctttataatgccacaactggaagactatcagcagaagtgataaaaggcagccacttcaaaaatttggcagcaaacagaccacccaatacatatgttaagttaactctactgaattccatgggtcaagagatgtccaaatgcaagacatccatccgcagagggcagccaaatccagtatataaggaaacttttgtctttcaagtggccctatttcagctttctgatgtgacactcatactgtctgtgtataacaaacgcagcatgaaaagaaaagagatgataggctggatttctttaggtctcaacagctctggagaagaagaactcaatcactggactgaaatgaaagagtcaaaaggacagcaagtatgtagatggcatgcgttgctagagtcatgatgaatagaataagcaagcagttaccatcaaaggcagcatatttccaattccaacattactgtttctaccaagtcccattagaagagctgttctttgaagaatcatattcaaccttctaccaaaatgctttaagttctatggaaagaacgtctcatactgacataaatgaagaaaatatgtgtatctagtagagcttgtttaggaaactgagaaacgtacactatcattgctaaactaacagtcctccagaaatttaataagatgtttttgatttgaagttaattttaatttagcaaaagagccagtcattttatgaaaaatcaaaattataagtgattttaaaaaccagaattttagttgcaatacaattttaatatcaccctacatattatttataaaacatagtttgactggccagtccctggtgtttgtaatgttctttaatatgaaaaagtagttctccaactctatcataagtcatatctaatggtgaagggtttcagtcacattgaaaattgttttatttcaggcatgttccctttgtgcacttaggttcattgtgcctcagttcctctcaaaagcactaaatctaagtgcaaacaagtattcattttcatacaggaatttttttaatatgttatttttttaaaagttcatttttcatttgcctccgctttcgcctgatccaaagagaccaagtcactgtactggtcccttgcaagtcttctagacaggttgtactgtagaactacgtaactttctgttgaaagcacttcctgtattcttgtattccaatgtaggaagctaatagagcaggactttactttcaaatttctttcagtgattgactcttcaaaattgcagtagtgtgaaaatacattttttacaaactgaaaatacagtagataagctgtcgaaaatggaaaacaattcaattttaattttctgctctgagtatttagtaaccaacactgcgtaaagcaggtagcattcaaaataagaaactgttctctctctaaatcttcactcttacttcaatttatatttgtgatatgaagactatccagttctcagtttgaattggaacatcatgttaaaaacagttatgagattccttatgaagtttctagtaacttgtaactagactttatgaaattaacagataaagttcttcaacgtgatgtcatcttgtgcctttcatgtaagttaaatttgctcatacagcttgaacgttgtatttgcaaaattaagccttcgatttttataaatgtaaagattcctcag

SEQ ID NO: 21110 - DNA, 11880 bp, Homo sapiens
  ENST00000399639
gcatcatggcgattgaaggtggagagagaacctgtggagtacatgaacttatctgtattagaaaagaatctggaatctgagtgcatgctgatctcccattgacttctgttctattactgtaccccatcagagagatgtgaggagttggttgaaattcaaatcgggaacatatccaaagaccacaacatcctttgacaccaacaactgtctatgcttccttagaaggagccacctgacaactgggtggttcaacaaagtggccccaggaaagtatctccagaggcagttggatttttgtcagctgttggggtgtttattatcttgatgctgctcctttttctctatattaataagaagttctgttttgaaaatgttggcgggtttccagatcttggttcagaatacagtacaaggaagaattcacaagataaaatttataattcctacatggacaaagatgagcatggttcatcctctgaaagtgaagatgaagcgctgggtaaatatcatgaggccttatccagaacacacaattccagactaccactggcagattctagacaaaggaactatgcttgggaaacaaggcagaaatacagtcctctatcggcagagtatgatggatacagtagtgaagcatcaatagatgaaggaaactgcattcagagaatgagaagaacacccccgctggatgaattgcagccaccaccatatcaggatgacagtggttctccccatctgtcatgtacaccctcagaaattggggacagtaaatgtgaattttcccactgcagcaacagtccaagatgctcatataacaagtgcccaagtgaaggaagcacaggtcatgaaatagaaagttttcataataaaggatatgaagaagatgttccaagtgacagcactgcagtcctgagccctgaagatatgtcagctcaaggatcatcttcgcagcttcctaaaccttttgatcctgagccagaagctaaatatggcacactggatgtgacttttgactatgactcacaagaacagaagcttctggtaacagtgacagctgtcacagacatcccaacatataacaggacaggtggcaactcatgggctgtgactcccaaatgagcgtgtcagaaatgtcgtgtagtgaaagtacatcctcatgtcagtctcttgaacatggctcagttccagaaattcttattggcctgctttataatgccacaactggaagactatcagcagaagtgataaaaggcagccacttcaaaaatttggcagcaaacagaccacccaatacatatgttaagttaactctactgaattccatgggtcaagagatgtccaaatgcaagacatccatccgcagagggcagccaaatccagtatataaggaaacttttgtctttcaagtggccctatttcagctttctgatgtgacactcatactgtctgtgtataacaaacgcagcatgaaaagaaaagagatgataggctggatttctttaggtctcaacagctctggagaagaagaactcaatcactggactgaaatgaaagagtcaaaaggacagcaagtatgtagatggcatgcgttgctagagtcatgatgaatagaataagcaagcagttaccatcaaaggcagcatatttccaattccaacattactgtttctaccaagtcccattagaagagctgttctttgaagaatcatattcaaccttctaccaaaatgctttaagttctatggaaagaacgtctcatactgacataaatgaagaaaatatgtgtatctagtagagcttgtttaggaaactgagaaacgtacactatcattgctaaactaacagtcctccagaaatttaataagatgtttttgatttgaagttaattttaatttagcaaaagagccagtcattttatgaaaaatcaaaattataagtgattttaaaaaccagaattttagttgcaatacaattttaatatcaccctacatattatttataaaacatagtttgactggccagtccctggtgtttgtaatgttctttaatatgaaaaagtagttctccaactctatcataagtcatatctaatggtgaagggtttcagtcacattgaaaattgttttatttcaggcatgttccctttgtgcacttaggttcattgtgcctcagttcctctcaaaagcactaaatctaagtgcaaacaagtattcattttcatacaggaatttttttaatatgttatttttttaaaagttcatttttcatttgcctccgctttcgcctgatccaaagagaccaagtcactgtactggtcccttgcaagtcttctagacaggttgtactgtagaactacgtaactttctgttgaaagcacttcctgtattcttgtattccaatgtaggaagctaatagagcaggactttactttcaaatttctttcagtgattgactcttcaaaattgcagtagtgtgaaaatacattttttacaaactgaaaatacagtagataagctgtcgaaaatggaaaacaattcaattttaattttctgctctgagtatttagtaaccaacactgcgtaaagcaggtagcattcaaaataagaaactgttctctctctaaatcttcactcttacttcaatttatatttgtgatatgaagactatccagttctcagtttgaattggaacatcatgttaaaaacagttatgagattccttatgaagtttctagtaacttgtaactagactttatgaaattaacagataaagttcttcaacgtgatgtcatcttgtgcctttcatgtaagttaaatttgctcatacagcttgaacgttgtatttgcaaaattaagccttcgatttttataaatgtaaagattcctcagaacagtgtcgcaagatctttatttcctctgaagtatgtaaaagttgtataatgtgctaactttttaatggcaaggcactttcatttgtttttatatttaggaactctaatcaggaatattataagctgttttctttttaattttgcttcttacctaatatatcattttatgcatatactttatcagagtatgttttatatatattaaaaatagtttcttttttctccttctcatttctagttaaaatagacaaaaacatactatttaccagttactaaaaagcagtatatcattgcttctagtcccaactaagtactatatattattgtaaactagaacttgttattaccataataacaaaacaatgcgtagatattacttcagcttggctgtactgaaaggccttaaaagaaacccaaaaagaccgtgaacttctgtatttttttagtttaaaaaatggcagctctatgcattcatacacatgaattataagaaaaaatacaaatgctatattggatgacatgaggtttgagaatgtgtgttacagggctgcattaaagggaaaaatccatcttttattgttacatcaatgagctttttccaggatttttcaaataaacaagtaagagttagaacctgaatcaaatggcaaaatatctcatttaagtgttttcagcaacagtatgaaaaaagacttgaagaggggatgtagattttactgagaaattggacttaggcatttgaagctataatgaactttttagactttgaaacaactgactgcattgctaacaactgttatcttcctaataaaaagagttatcagtcttatctgtaactgtaacagagcttagtgaaacacattagtaagaccagcttggtgctttcactcttagtgagaaaaagacctaactaattgttatttgttaaatctaccttttttcagactattcccagaattgtgtgtgtgatttgatacatccctagggatttatctggcataagtatcaaatccttcatggcttaaaaattaataaacagttttttaatatttctggaaagaccctacctccaccccagctgccaagtcctcaaagattataaattatctatatgagtgtatgtatctgtatacacacatgcaccattacacatacaacataaatatgtatatgtatattcatttgtaaaggcaaaggtgccctggctttttcagataactgaatagaaaaacatttcatacatttaggattatttttctcctctatgtatttactagatattatatttggtttgggttgctttctgctgctgttctccttcacacacagcaaaatatacatttgtttctgtagattgacacaacttataataattactcccaaaaagttgtctgttcttttagaaaaggattaaataaggctcaggggacccacttcactctactgaatctaatgtacgagacagtactactgcttctttgtgtgcttgaatttgcatgaaagcttaatagcaaaatcttctatctcagtaattatagcaaatagggacctactggtagggagcaggtgttggctcagaaacctgaaaaagacaacccactttcatacagttctattaaaatcccctaagttttctaataaaatgatatagtccaaatatggcaatcgactggcatttatgggagcctctaaacctggaattatggggtttatttttctcccaaatgagctgcaaaagataattattgctgcccagtaaacaaaatgtatgtcaaatcagtaaagaatttgtttagcataatattgccttatctttcagaagctttcttctatattcttgtgtcttcagtacaatccacttttgtttgaaatccatttgcatattatcttactgtgcatttagtgaattctcaataatgttgtatttgctgacaagaataataaattggaccacaattaaaaaaaaagaaaacccaatgagaaaataactacctgattaatatacacatgtttaaatgtaggacctggtaaagcagtttcatccaacctagcgaaaatgcccagggctgtttgttaaatcatttgcttgataccatcatcattttcatttcacttatcaagtgaatcagaagcataatcaataactgcaaagtaagatagtaccaataggagaaagaggtaaaagaattgagagtgtttgtcaatatgaagatgtgtggggatactgaatgatatcatagtctttccagtgaaagaaaaaataggctatgggaagatgtaaatttttgatggagtaagaacagtggtcaccaccaagtatttttcaagatccctctccagctatgaatagaaaggacacaaattcatttgcgtaaaattgccatttgcctacatagactagacaattcacagatttttcacaaagacagttattatatatatagttatttgagttatcactatattatttcacattgatagtttttatttctaattttgtttccattcactgtcctcagttcctctgtggcctacattgaaggtagctgtcagtattattattgtcaaccatatttaatattgaatacaagtttaagcatgctgcaaagcattttctaacgttaattttaaaacattgtctctgccctccaaagtgatggttaacagctataatttactaagatctagcacaataatttattacttgcttgattctcaaaacaatactgtgaggtaagtaatgttatcaacattttattgataaagaaactgcagcatgaagaggttaagcagactttcccaaggtcattcggtaagtaagtagtagaactgggattggaacccaggtgtaaattactctaaaacccatgctatgcatgttgcatttgcctccctgtttgaaaaaaaaactacttaggacattatatttatcaataatcccactcaccttgattgaatggcagaactaagggggaaaaaacagctggggaaagagaaaagactagaaaagaagatcagaaattttttttcttctcaggacacaagtggtggtacttttgtgtcattttgtagatgactttgatttgcaaagatttggaattgatttattctaccagtttagcctatacttatattccaaaagcatattaatcagttctgctccttgaccacttttaggaatccaaggtgttttaattgttacatgacccccttactactctatgaagggcataacctgtgtctagcccatatctcactcatatcagtggtgagacaaaagatttgtcttcctctgtcctctcattgcaatttatttatgttttattctcaattttattaagatttgtcaggaattacagctagtttattacatatgtctctcttccccctaggtaagtagtcaatgccttgttagtatctttctgtacccctttgcttatagtaggcagacagtaaatattgaattgaactaaattccctgtggaagaagccagtcacactattacatgagtcttagtttttatgaatcttgtgttatgtatggatttatttattccttcagttaatatatatttaagagtactagatatgtgccatgtgttgttgttccaagtgctacagatgcagagataataaattggtcgaagtctttgccctcatggggcctacattctaaggtaggaagatggccacagaatgggataatttcaggctagtataatgaagcattaagataggggcatgcatagagtaccgtgggatttagtagaagagtgcaacatggaattcaaaaaaatcttcctggaaaagataatccctgagttgggtcttaaagaacaaatacatgttagactcccatcaaacttgaggacacacgttctttccaagaacaaaatgtaaaataatggtttctaaactgtagtatccttaagaattattttgaaaatttaacttgggccaggcgtggtggcttacgcctgtaatcccaacactttgggaggctgaggtaggcagattacttgagctcaggagtttaagaccagcctgggcaacatagcaaaaccccatctctaccaaaaatttaaaaattagctgagcacggtggtgcatgcctgtggtcccagctactcaggaggcttaggtgggagaatcgctggagcctggcaagtcaaggctgcagtgagccaagatagcgccactgcacttcagcctgggtgacacagaagaccttgtagaaagggaggaagaaaggagggagagagagaggaagggaggaggagaagggaaggaaggaggagacgggaaagaatgaaggagaagggaaagaagggagggaaatttaacttgtattccaaaactccacctccagagattctacttcatttggcctggaagggagcccaataatctacattttattaagctctccaggaaattctgtctgagatctattgatatagaatattaagtgtattacatagtagtattcatgaaatgtttcagtgcctgtagatcagacctttaagtgtgatagtgatagtaatacagagattaagactaggattaatgttattcatctttttcttgtgcttccttaaaaaggaagatatttaatgaaaaaaattaatatttaataatgaatttctgtacattcacattcaacatacatttttcaaagtgtttcttggtataataaatatgttgattttatggcttccaaaaattcctttctatcactgttcaaatatttccttctaagttatctttacaatgatggatataaagtgaagaatggggaggtatttatcaagtaatttctttatcagtatcctaaatgaaataagactgacctttgagcaaatgtgtagtagcagccataggtgctggcatgtttgcattcttgcatacagtaagatttcttgcttccctttatcatcatctaaatggcttcattgtcatcacactcatcagatgaaatgcagtactggattcttctctaaaagcagtgattctgtgactgctgctctaaactctagttccttgattgttttgttcttaggatcctttgtttcaaatagcaagttaatacagcagcctcaggaccttctctttctctcagaataaatgctgtggataaggtacatctgagtttccatttcccctcatttcacatatagccatattttcttctctgatgtaatattttgtattaacacattttacattttgaagttttcttttcccccacaaagatatgtggttatcccacttaaaaatgagcttatttgaatatgtgaaataatgttgtcattgaattaagctgttttgtgactgctgatgtatcactgtgtttgatttggtgacagcttgaggtctggttaatataatcttaaggtaatcagcttgatagactggaattactagtttattatcaaaaaatgaatgtaaaaatattgctcttttctctccctgtttagactagtatgtgcctttttaaaaatactccctttcttcttccctgccttttttccccactcttattcatatacactcaaactagataccagagttagttcatcaaagctgaataatacctatcaaaaagtgataccctgacttttttctcttaatcacctgtactggaccatagggaggaccaaataggctttcttggggactacagaaagagcaaagcgtaatactctttaatcatagcatgtttgttgttgctgtttcggtggtggtggtggtggtggtggtggttgtgtacttaccttgaatagtgtgaagtatcctaaaattatgttgtgtgggctgggagcaggaaggaaactgattattcgtctaacaaaggtttggcataattttattgtaaaatttcaactgtttatgacatgaaaatttctaattaattataagaacaaagtcactgtggtggcaatagttgtacaagatgtttgacattatttctatgtcagtttgatagtctgtgttataaattgtcttattaggacccttcttcaccctcttctttattattctgattatcagtaaatccagtttgtactgttagacatttgagtttgtcttttaaatattgaagactattttaaaaagaaaaaccataacatctttctgtttattacattaacatgtgatctctcacctgacgatgtgtttaaaatgaattaatagataaaatataatactccgttatatactgaaaaaaattttcaaactttgtctatatattcagatattgctagcagttcatattaaatatgactattttgtttaatgagaaaataggaatttttccttatctctgagacttactgcttctctttgccattcacatctggttgaaggtggatggttttgaacctcgtaacgtcacttcactcgtcagtttctgagtgtgccaacctccttctgacggtttaattttcagtaacaatcaaaccatttattcctcaggggttggtcctcctagtgattcctgtccttaacccccattagtgttgatggaagtaatccataagcaccaataggagaaaaggcccataaaggatcagtatcccagaaccctgaaataggacggccgcttcagtacccaaatgtcattgcaattctaatggagtagaagccagcttcttggaagtgaagatttgagatcattatgtcatattctctccttttggtgtcctcccttctccctctagcttgcacattctttttattttaaattttacaggaagccttcttttaaaaacctggtttttaaaatttcacatgttgctgtaaccaggtgatttcaaaacccagaaaactgaagtacataccatacagtcataagaagtttgggggcttttttggtttttatgtttttggtgttttttttttttttttttttttttttttttgtagtgtggggagtggggaggaggaaaagggagaaatcgtgcttgttttggttttgggaagtctttttggataaatattgagaatatttatagtattctgtaattatgtgacatttgttgtgtgaggggagaccagagtagctgttgcacatacatcgactctcttaatattgaagcatatttaaacagttgtttgaagcagagctagaaattaatggtgatacttctaacagcattttgatgttataaatattactttaagtttatcaagagaaaaattccagtagtagcttgcgttataaaattaattgatttattatgtttctgtataattttattgaaattgcttttttgtggtgaatataatatagtggcaacgattttgaggaatctttaaagctgtttggaagagatggccagcctttggctagatttttactagaattttgaaataagaaagtgtataaatatgttttcagttaaattagccttgaggaagaatagttattatatgagttttaagggtcttgataaatgttgggacctactctaaaactcatgaggttcctcactgatcaatactcttgcattgtattttatttctcaaaataatgaaatttttatggaaaagctcaattagtggaatcttttattcaatattcccttactcttctttcttccttccttctttctttcctttcttccttccctccctccttccttcctagttctttcattttttcaggcaagaagcttccttaataatatagtttctacagagctttcttacttatttttctaataatggatataacagtgtgataaagtttaaatgctccgtgagcaaaactcttatcaaacaactgaagaaatacactgctgattaaccttttccttggtcttgaattgtctccagcatatttgctagtgactaaaccattaatggatcttattagtataaacacatgtctgtgtggttatcaacagtgttgtattattgtcacatttatttacatttttggtcaaaaatataaacatgcgtgtgtgaagcagtctgttttatagagtgagcatatatgtaatcgttttcatataattgaaaatgtgctgtgtgttgcattttattctcatgtcgacttttctactatgtatacaccgattgtctcggtgcctttttccttttgtataattgtattacatacagaaattgctgacctctgtgaaaacagtgtaaaaaaagttaaaattattattccgatgagattttaatggcagtttaattttccagagaataaattttgtgtgggttaaaagttatttttcttcacctttatgtaaaaaatctgtttacgttttagtactcacatggaatgggtaaacatctgacttcattgatgatgatacataaacatcagtcctaattcttgtcattgacaaataaatgttaatatgactgttacacaaaataaaataatgtcaattacataaggaaatatcaaatggatatatgtacatgttatttagatcttgggtttgaaaggaatctcatctaaatgtgctataaaatattactctcaaaaggtttgggtcatattattttctttaattgtaagtcaaatctggcttccaaagaaaatagacttacaaatgcaaacatttaaaaatattctcctttaaagttcatataaatcacaaattaaactaaatagctttaaaatgatctcagtatcttcagctggaatatgaactgttacctagtttgttctttcacttaatgtgaatttgttgtcattcatatcagtattgctatcctgtttaacaaaataattttctctttgccaatagtagtttgttgatttttaattctttttcattagctagttgtattgtttccctaagacctggagtttagatatttttcatatttcattaccttgtccattttacttccagcaacaaagatttataacaacagacttaacaagtactattttgcatatgaaaaagaatttaaacgtttggtgctctaaaactgaaagaaattaaagttgctgcatcatctaa

SEQ ID NO: 21111 - DNA, 5094 bp, Homo sapiens
  ENST00000367015
gtggagtacatgaacttatctgtattagaaaagaatctggaatctgagtgcatgctgatctcccattgacttctgttctattactgtaccccatcagagagatgtgaggagttggttgaaattcaaatcgggaacatatccaaagaccacaacatcctttgacaccaacaactgtctatgcttccttagaaggagccacctgacaactgggtggttcaacaaagtggccccaggaaagtatctccagaggcagttggatttttgtcagctgttggggtgtttattatcttgatgctgctcctttttctctatattaataagaagttctgttttgaaaatgttggcgggtttccagatcttggttcagaatacagtacaaggaagaattcacaagataaaatttataattcctacatggacaaagatgagcatggttcatcctctgaaagtgaagatgaagcgctgggtaaatatcatgaggccttatccagaacacacaattccagactaccactggcagattctagacaaaggaactatgcttgggaaacaaggcagaaatacagtcctctatcggcagagtatgatggatacagtagtgaagcatcaatagatgaaggaaactgcattcagagaatgagaagaacacccccgctggatgaattgcagccaccaccatatcaggatgacagtggttctccccatctgtcatgtacaccctcagaaattggggacagtaaatgtgaattttcccactgcagcaacagtccaagatgctcatataacaagtgcccaagtgaaggaagcacaggtcatgaaatagaaagttttcataataaaggatatgaagaagatgttccaagtgacagcactgcagtcctgagccctgaagatatgtcagctcaaggatcatcttcgcagcttcctaaaccttttgatcctgagccagaagctaaatatggcacactggatgtgacttttgactatgactcacaagaacagaagcttctggtaacagtgacagctgtcacagacatcccaacatataacaggacaggtggcaactcatggcaagtacaccttgttcttctacctataaagaaacagagagcaaaaaccagcatccagagaggaccatgccctgtcttcacagaaacatttaaatttaatcatgttgaatctgagatgattggaaattatgcagttcggtttagactgtatggtgtacatcgcatgaaaaaagaaaagattgtgggggaaaagattttttatttaacaaaattgaatcttcaagggaaaatgtcattgcctgtgatattggaaccttcttacaatcattctggctgtgactcccaaatgagcgtgtcagaaatgtcgtgtagtgaaagtacatcctcatgtcagtctcttgaacatggctcagttccagaaattcttattggcctgctttataatgccacaactggaagactatcagcagaagtgataaaaggcagccacttcaaaaatttggcagcaaacagaccacccaatacatatgttaagttaactctactgaattccatgggtcaagagatgtccaaatgcaagacatccatccgcagagggcagccaaatccagtatataaggaaacttttgtctttcaagtggccctatttcagctttctgatgtgacactcatactgtctgtgtataacaaacgcagcatgaaaagaaaagagatgataggctggatttctttaggtctcaacagctctggagaagaagaactcaatcactggactgaaatgaaagagtcaaaaggacagcaagtatgtagatggcatgcgttgctagagtcatgatgaatagaataagcaagcagttaccatcaaaggcagcatatttccaattccaacattactgtttctaccaagtcccattagaagagctgttctttgaagaatcatattcaaccttctaccaaaatgctttaagttctatggaaagaacgtctcatactgacataaatgaagaaaatatgtgtatctagtagagcttgtttaggaaactgagaaacgtacactatcattgctaaactaacagtcctccagaaatttaataagatgtttttgatttgaagttaattttaatttagcaaaagagccagtcattttatgaaaaatcaaaattataagtgattttaaaaaccagaattttagttgcaatacaattttaatatcaccctacatattatttataaaacatagtttgactggccagtccctggtgtttgtaatgttctttaatatgaaaaagtagttctccaactctatcataagtcatatctaatggtgaagggtttcagtcacattgaaaattgttttatttcaggcatgttccctttgtgcacttaggttcattgtgcctcagttcctctcaaaagcactaaatctaagtgcaaacaagtattcattttcatacaggaatttttttaatatgttatttttttaaaagttcatttttcatttgcctccgctttcgcctgatccaaagagaccaagtcactgtactggtcccttgcaagtcttctagacaggttgtactgtagaactacgtaactttctgttgaaagcacttcctgtattcttgtattccaatgtaggaagctaatagagcaggactttactttcaaatttctttcagtgattgactcttcaaaattgcagtagtgtgaaaatacattttttacaaactgaaaatacagtagataagctgtcgaaaatggaaaacaattcaattttaattttctgctctgagtatttagtaaccaacactgcgtaaagcaggtagcattcaaaataagaaactgttctctctctaaatcttcactcttacttcaatttatatttgtgatatgaagactatccagttctcagtttgaattggaacatcatgttaaaaacagttatgagattccttatgaagtttctagtaacttgtaactagactttatgaaattaacagataaagttcttcaacgtgatgtcatcttgtgcctttcatgtaagttaaatttgctcatacagcttgaacgttgtatttgcaaaattaagccttcgatttttataaatgtaaagattcctcagaacagtgtcgcaagatctttatttcctctgaagtatgtaaaagttgtataatgtgctaactttttaatggcaaggcactttcatttgtttttatatttaggaactctaatcaggaatattataagctgttttctttttaattttgcttcttacctaatatatcattttatgcatatactttatcagagtatgttttatatatattaaaaatagtttcttttttctccttctcatttctagttaaaatagacaaaaacatactatttaccagttactaaaaagcagtatatcattgcttctagtcccaactaagtactatatattattgtaaactagaacttgttattaccataataacaaaacaatgcgtagatattacttcagcttggctgtactgaaaggccttaaaagaaacccaaaaagaccgtgaacttctgtatttttttagtttaaaaaatggcagctctatgcattcatacacatgaattataagaaaaaatacaaatgctatattggatgacatgaggtttgagaatgtgtgttacagggctgcattaaagggaaaaatccatcttttattgttacatcaatgagctttttccaggatttttcaaataaacaagtaagagttagaacctgaatcaaatggcaaaatatctcatttaagtgttttcagcaacagtatgaaaaaagacttgaagaggggatgtagattttactgagaaattggacttaggcatttgaagctataatgaactttttagactttgaaacaactgactgcattgctaacaactgttatcttcctaataaaaagagttatcagtcttatctgtaactgtaacagagcttagtgaaacacattagtaagaccagcttggtgctttcactcttagtgagaaaaagacctaactaattgttatttgttaaatctaccttttttcagactattcccagaattgtgtgtgtgatttgatacatccctagggatttatctggcataagtatcaaatccttcatggcttaaaaattaataaacagttttttaatatttctggaaagaccctacctccaccccagctgccaagtcctcaaagattataaattatctatatgagtgtatgtatctgtatacacacatgcaccattacacatacaacataaatatgtatatgtatattcatttgtaaaggcaaaggtgccctggctttttcagataactgaatagaaaaacatttcatacatttaggattatttttctcctctatgtatttactagatattatatttggtttgggttgctttctgctgctgttctccttcacacacagcaaaatatacatttgtttctgtagattgacacaacttataataattactcccaaaaagttgtctgttcttttagaaaaggattaaataaggctcaggggacccacttcactctactgaatctaatgtacgagacagtactactgcttctttgtgtgcttgaatttgcatgaaagcttaatagcaaaatcttctatctcagtaattatagcaaatagggacctactggtagggagcaggtgttggctcagaaacctgaaaaagacaacccactttcatacagttctattaaaatcccctaagttttctaataaaatgatatagtccaaatatggcaatcgactggcatttatgggagcctctaaacctggaattatggggtttatttttctcccaaatgagctgcaaaagataattattgctgcccagtaaacaaaatgtatgtcaaatcagtaaagaatttgtttagcataatattgccttatctttcagaagctttcttctatattcttgtgtcttcagtacaatccacttttgtttgaaatccatttgcatattatcttactgtgcatttagtgaattctcaataatgttgtatttgctgacaagaataataaattggaccacaattaaaaa

SEQ ID NO: 21112 - DNA, 3438 bp, Homo sapiens
  ENST00000534859
ctacatggacaaagatgagcatggttcatcctctgaaagtgaagatgaagcgctgggtaaatatcatgaggccttatccagaacacacaattccagactaccactggcagattctagacaaaggaactatgcttgggaaacaaggcagaaatacagtcctctatcggcagagtatgatggatacagtagtgaagcatcaatagatgaaggaaactgcattcagagaatgagaagaacacccccgctggatgaattgcagccaccaccatatcaggatgacagtggttctccccatctgtcatgtacaccctcagaaattggggacagtaaatgtgaattttcccactgcagcaacagtccaagatgctcatataacaagtgcccaagtgaaggaagcacaggtcatgaaatagaaagttttcataataaaggatatgaagaagatgttccaagtgacagcactgcagtcctgagccctgaagatatgtcagctcaaggatcatcttcgcagcttcctaaaccttttgatcctgagccagaagctaaatatggcacactggatgtgacttttgactatgactcacaagaacagaagcttctggtaacagtgacagctgtcacagacatcccaacatataacaggacaggtggcaactcatggcaagtacaccttgttcttctacctataaagaaacagagagcaaaaaccagcatccagagaggaccatgccctgtcttcacagaaacatttaaatttaatcatgttgaatctgagatgattggaaattatgcagttcggtttagactgtatggtgtacatcgcatgaaaaaagaaaagattgtgggggaaaagattttttatttaacaaaattgaatcttcaagggaaaatgtcattgcctgtgatattggaaccttcttacaatcattctggctgtgactcccaaatgagcgtgtcagaaatgtcgtgtagtgaaagtacatcctcatgtcagtctcttgaacatggctcagttccagaaattcttattggcctgctttataatgccacaactggaagactatcagcagaagtgataaaaggcagccacttcaaaaatttggcagcaaacagaccacccactttccaccccctgttgtcagatggactgttctgttgtctaaaacacttgataggtggacaggtttatataatccgagatacatatgttaagttaactctactgaattccatgggtcaagagatgtccaaatgcaagacatccatccgcagagggcagccaaatccagtatataaggaaacttttgtctttcaagtggccctatttcagctttctgatgtgacactcatactgtctgtgtataacaaacgcagcatgaaaagaaaagagatgataggctggatttctttaggtctcaacagctctggagaagaagaactcaatcactggactgaaatgaaagagtcaaaaggacagcaagtatgtagatggcatgcgttgctagagtcatgatgaatagaataagcaagcagttaccatcaaaggcagcatatttccaattccaacattactgtttctaccaagtcccattagaagagctgttctttgaagaatcatattcaaccttctaccaaaatgctttaagttctatggaaagaacgtctcatactgacataaatgaagaaaatatgtgtatctagtagagcttgtttaggaaactgagaaacgtacactatcattgctaaactaacagtcctccagaaatttaataagatgtttttgatttgaagttaattttaatttagcaaaagagccagtcattttatgaaaaatcaaaattataagtgattttaaaaaccagaattttagttgcaatacaattttaatatcaccctacatattatttataaaacatagtttgactggccagtccctggtgtttgtaatgttctttaatatgaaaaagtagttctccaactctatcataagtcatatctaatggtgaagggtttcagtcacattgaaaattgttttatttcaggcatgttccctttgtgcacttaggttcattgtgcctcagttcctctcaaaagcactaaatctaagtgcaaacaagtattcattttcatacaggaatttttttaatatgttatttttttaaaagttcatttttcatttgcctccgctttcgcctgatccaaagagaccaagtcactgtactggtcccttgcaagtcttctagacaggttgtactgtagaactacgtaactttctgttgaaagcacttcctgtattcttgtattccaatgtaggaagctaatagagcaggactttactttcaaatttctttcagtgattgactcttcaaaattgcagtagtgtgaaaatacattttttacaaactgaaaatacagtagataagctgtcgaaaatggaaaacaattcaattttaattttctgctctgagtatttagtaaccaacactgcgtaaagcaggtagcattcaaaataagaaactgttctctctctaaatcttcactcttacttcaatttatatttgtgatatgaagactatccagttctcagtttgaattggaacatcatgttaaaaacagttatgagattccttatgaagtttctagtaacttgtaactagactttatgaaattaacagataaagttcttcaacgtgatgtcatcttgtgcctttcatgtaagttaaatttgctcatacagcttgaacgttgtatttgcaaaattaagccttcgatttttataaatgtaaagattcctcagaacagtgtcgcaagatctttatttcctctgaagtatgtaaaagttgtataatgtgctaactttttaatggcaaggcactttcatttgtttttatatttaggaactctaatcaggaatattataagctgttttctttttaattttgcttcttacctaatatatcattttatgcatatactttatcagagtatgttttatatatattaaaaatagtttcttttttctccttctcatttctagttaaaatagacaaaaacatactatttaccagttactaaaaagcagtatatcattgcttctagtcccaactaagtactatatattattgtaaactagaacttgttattaccataataacaaaacaatgcgtagatattacttcagcttggctgtactgaaaggccttaaaagaaacccaaaaagaccgtgaacttctgtatttttttagtttaaaaaatggcagctctatgcattcatacacatgaattataagaaaaaatacaaatgctatattggatgacatgaggtttgagaatgtgtgttacagggctgcattaaagggaaaaatccatcttttattgttacatcaatgagctttttccaggatttttcaaataaacaagtaagagttagaacctgaa

SEQ ID NO: 21113 - DNA, 1860 bp, Homo sapiens
  ENST00000629778
atggcgagcgcatcatggcgattgaaggtggagagagaacctgtggagtacatgaacttatctgtattagaaaagatagggtatttctctgtggccaggctggagtacagtggcaccatcttggctcactgcaacttccgcctcctgggttcaaacgattcttctgcctcagcatcccaagtaactgggactacagtatctccagaggcagttggatttttgtcagctgttggggtgtttattatcttgatgctgctcctttttctctatattaataagaagttctgttttgaaaatgttggcgggtttccagatcttggttcagaatacagtacaaggaagaattcacaagataaaatttataattcctacatggacaaagatgagcatggttcatcctctgaaagtgaagatgaagcgctgggtaaatatcatgaggccttatccagaacacacaattccagactaccactggcagattctagacaaaggaactatgcttgggaaacaaggcagaaatacagtcctctatcggcagagtatgatggatacagtagtgaagcatcaatagatgaaggaaactgcattcagagaatgagaagaacacccccgctggatgaattgcagccaccaccatatcaggatgacagtggttctccccatctgtcatgtacaccctcagaaattggggacagtaaatgtgaattttcccactgcagcaacagtccaagatgctcatataacaagtgcccaagtgaaggaagcacaggtcatgaaatagaaagttttcataataaaggatatgaagaagatgttccaagtgacagcactgcagtcctgagccctgaagatatgtcagctcaaggatcatcttcgcagcttcctaaaccttttgatcctgagccagaagctaaatatggcacactggatgtgacttttgactatgactcacaagaacagaagcttctggtaacagtgacagctgtcacagacatcccaacatataacaggacaggtggcaactcatggcaagtacaccttgttcttctacctataaagaaacagagagcaaaaaccagcatccagagaggaccatgccctgtcttcacagaaacatttaaatttaatcatgttgaatctgagatgattggaaattatgcagttcggtttagactgtatggtgtacatcgcatgaaaaaagaaaagattgtgggggaaaagattttttatttaacaaaattgaatcttcaagggaaaatgtcattgcctgtgatattggaaccttcttacaatcattctggctgtgactcccaaatgagcgtgtcagaaatgtcgtgtagtgaaagtacatcctcatgtcagtctcttgaacatggctcagttccagaaattcttattggcctgctttataatgccacaactggaagactatcagcagaagtgataaaaggcagccacttcaaaaatttggcagcaaacagaccacccaatggactgttctgttgtctaaaacacttgataggtggacaggtttatataatccgagatacatatgttaagttaactctactgaattccatgggtcaagagatgtccaaatgcaagacatccatccgcagagggcagccaaatccagtatataaggaaacttttgtctttcaagtggccctatttcagctttctgatgtgacactcatactgtctgtgtataacaaacgcagcatgaaaagaaaagagatgataggctggatttctttaggtctcaacagctctggagaagaagaactcaatcactggactgaaatgaaagagtcaaaaggacagcaagtatgtagatggcatgcgttgctagagtcatga

SEQ ID NO: 21114 - DNA, 5208 bp, Homo sapiens
  ENST00000537238
ccctctcgctggcggactcagcgcgtcctccgccagccctcgcgtctgctgcccccgccatccagttggtgcggtccatggcgagcgcatcatggcgattgaaggtggagagagaacctgtggagtacatgaacttatctgtattagaaaagaatctggaatctgagtgcatgctgatctcccattgacttctgttctattactgtaccccatcagagagatgtgaggagttggttgaaattcaaatcgggaacatatccaaagaccacaacatcctttgacaccaacaactgtctatgcttccttagaaggagccacctgacaactgggtggttcaacaaagtggccccaggaaagtatctccagaggcagttggatttttgtcagctgttggggtgtttattatcttgatgctgctcctttttctctatattaataagaagttctgttttgaaaatgttggcgggtttccagatcttggttcagaatacagtacaaggaagaattcacaagataaaatttataattcctacatggacaaagatgagcatggttcatcctctgaaagtgaagatgaagcgctgggtaaatatcatgaggccttatccagaacacacaattccagactaccactggcagattctagacaaaggaactatgcttgggaaacaaggcagaaatacagtcctctatcggcagagtatgatggatacagtagtgaagcatcaatagatgaaggaaactgcattcagagaatgagaagaacacccccgctggatgaattgcagccaccaccatatcaggatgacagtggttctccccatctgtcatgtacaccctcagaaattggggacagtaaatgtgaattttcccactgcagcaacagtccaagatgctcatataacaagtgcccaagtgaaggaagcacaggtcatgaaatagaaagttttcataataaaggatatgaagaagatgttccaagtgacagcactgcagtcctgagccctgaagatatgtcagctcaaggatcatcttcgcagcttcctaaaccttttgatcctgagccagaagctaaatatggcacactggatgtgacttttgactatgactcacaagaacagaagcttctggtaacagtgacagctgtcacagacatcccaacatataacaggacaggtggcaactcatggcaagtacaccttgttcttctacctataaagaaacagagagcaaaaaccagcatccagagaggaccatgccctgtcttcacagaaacatttaaatttaatcatgttgaatctgagatgattggaaattatgcagttcggtttagactgtatggtgtacatcgcatgaaaaaagaaaagattgtgggggaaaagattttttatttaacaaaattgaatcttcaagggaaaatgtcattgcctgtgatattggaaccttcttacaatcattctggctgtgactcccaaatgagcgtgtcagaaatgtcgtgtagtgaaagtacatcctcatgtcagtctcttgaacatggctcagttccagaaattcttattggcctgctttataatgccacaactggaagactatcagcagaagtgataaaaggcagccacttcaaaaatttggcagcaaacagaccacccaatacatatgttaagttaactctactgaattccatgggtcaagagatgtccaaatgcaagacatccatccgcagagggcagccaaatccagtatataaggaaacttttgtctttcaagtggccctatttcagctttctgatgtgacactcatactgtctgtgtataacaaacgcagcatgaaaagaaaagagatgataggctggatttctttaggtctcaacagctctggagaagaagaactcaatcactggactgaaatgaaagagtcaaaaggacagcaagtatgtagatggcatgcgttgctagagtcatgatgaatagaataagcaagcagttaccatcaaaggcagcatatttccaattccaacattactgtttctaccaagtcccattagaagagctgttctttgaagaatcatattcaaccttctaccaaaatgctttaagttctatggaaagaacgtctcatactgacataaatgaagaaaatatgtgtatctagtagagcttgtttaggaaactgagaaacgtacactatcattgctaaactaacagtcctccagaaatttaataagatgtttttgatttgaagttaattttaatttagcaaaagagccagtcattttatgaaaaatcaaaattataagtgattttaaaaaccagaattttagttgcaatacaattttaatatcaccctacatattatttataaaacatagtttgactggccagtccctggtgtttgtaatgttctttaatatgaaaaagtagttctccaactctatcataagtcatatctaatggtgaagggtttcagtcacattgaaaattgttttatttcaggcatgttccctttgtgcacttaggttcattgtgcctcagttcctctcaaaagcactaaatctaagtgcaaacaagtattcattttcatacaggaatttttttaatatgttatttttttaaaagttcatttttcatttgcctccgctttcgcctgatccaaagagaccaagtcactgtactggtcccttgcaagtcttctagacaggttgtactgtagaactacgtaactttctgttgaaagcacttcctgtattcttgtattccaatgtaggaagctaatagagcaggactttactttcaaatttctttcagtgattgactcttcaaaattgcagtagtgtgaaaatacattttttacaaactgaaaatacagtagataagctgtcgaaaatggaaaacaattcaattttaattttctgctctgagtatttagtaaccaacactgcgtaaagcaggtagcattcaaaataagaaactgttctctctctaaatcttcactcttacttcaatttatatttgtgatatgaagactatccagttctcagtttgaattggaacatcatgttaaaaacagttatgagattccttatgaagtttctagtaacttgtaactagactttatgaaattaacagataaagttcttcaacgtgatgtcatcttgtgcctttcatgtaagttaaatttgctcatacagcttgaacgttgtatttgcaaaattaagccttcgatttttataaatgtaaagattcctcagaacagtgtcgcaagatctttatttcctctgaagtatgtaaaagttgtataatgtgctaactttttaatggcaaggcactttcatttgtttttatatttaggaactctaatcaggaatattataagctgttttctttttaattttgcttcttacctaatatatcattttatgcatatactttatcagagtatgttttatatatattaaaaatagtttcttttttctccttctcatttctagttaaaatagacaaaaacatactatttaccagttactaaaaagcagtatatcattgcttctagtcccaactaagtactatatattattgtaaactagaacttgttattaccataataacaaaacaatgcgtagatattacttcagcttggctgtactgaaaggccttaaaagaaacccaaaaagaccgtgaacttctgtatttttttagtttaaaaaatggcagctctatgcattcatacacatgaattataagaaaaaatacaaatgctatattggatgacatgaggtttgagaatgtgtgttacagggctgcattaaagggaaaaatccatcttttattgttacatcaatgagctttttccaggatttttcaaataaacaagtaagagttagaacctgaatcaaatggcaaaatatctcatttaagtgttttcagcaacagtatgaaaaaagacttgaagaggggatgtagattttactgagaaattggacttaggcatttgaagctataatgaactttttagactttgaaacaactgactgcattgctaacaactgttatcttcctaataaaaagagttatcagtcttatctgtaactgtaacagagcttagtgaaacacattagtaagaccagcttggtgctttcactcttagtgagaaaaagacctaactaattgttatttgttaaatctaccttttttcagactattcccagaattgtgtgtgtgatttgatacatccctagggatttatctggcataagtatcaaatccttcatggcttaaaaattaataaacagttttttaatatttctggaaagaccctacctccaccccagctgccaagtcctcaaagattataaattatctatatgagtgtatgtatctgtatacacacatgcaccattacacatacaacataaatatgtatatgtatattcatttgtaaaggcaaaggtgccctggctttttcagataactgaatagaaaaacatttcatacatttaggattatttttctcctctatgtatttactagatattatatttggtttgggttgctttctgctgctgttctccttcacacacagcaaaatatacatttgtttctgtagattgacacaacttataataattactcccaaaaagttgtctgttcttttagaaaaggattaaataaggctcaggggacccacttcactctactgaatctaatgtacgagacagtactactgcttctttgtgtgcttgaatttgcatgaaagcttaatagcaaaatcttctatctcagtaattatagcaaatagggacctactggtagggagcaggtgttggctcagaaacctgaaaaagacaacccactttcatacagttctattaaaatcccctaagttttctaataaaatgatatagtccaaatatggcaatcgactggcatttatgggagcctctaaacctggaattatggggtttatttttctcccaaatgagctgcaaaagataattattgctgcccagtaaacaaaatgtatgtcaaatcagtaaagaatttgtttagcataatattgccttatctttcagaagctttcttctatattcttgtgtcttcagtacaatccacttttgtttgaaatccatttgcatattatcttactgtgcatttagtgaattctcaataatgttgtatttgctgacaagaataataaattggaccacaatt

SEQ ID NO: 21115 - DNA, 580 bp, Homo sapiens
  ENST00000554138
gatcatgtatcagttgctcatccagtggacgtccaatcagttagttggccattcattcattcattcatgcaggcatccagttataaagacatccattcacccactcaacagaaatctgctgagagcctactacgtgctgggaactattttcacatcggagacaaaacagagggtgacatgaagagcacggcccacttggagcctacggagatggcgttgagcggtttcgcaggagagctcctgccccggaggattaatgcccagcacctggctcatcctccccacacccctagctcttctcccgctttgctccttccagctggggctgagcatggggtcccaaccccgctggtgagaagctcgaggtagggatgaagcggagaatggaaaagtcactcctgaagccattggcttcttgtctgctgttggggtctttattgttcttctggccgtcctcttcctcttcatcaacaagaagctgtgttttgaaacgataggaggccttcctttcctggagcatcgagggaaaagaaagcattctaaagacaagactgggattcacaaggggctgggtaagcat

SEQ ID NO: 21116 - DNA, 870 bp, Homo sapiens
  ENST00000636344
cgcaccgggcctgccgaggagcgcgcgcccggccgggctcggcgccggtttcccgaacctgggcggccgtcgggcagccccctcgtccgaccatggcgactgacatcactcctgaagccattggcttcttgtctgctgttggggtctttattgttcttctggccgtcctcttcctcttcatcaacaagaagctgtgttttgaaacgataggaggccttcctttcctggagcatcgagggaaaagaaagcattctaaagacaagactgggattcacaaggggctggctggaagttttgagagtgaaatattcacagccattaagagacctccaaattaatttctcaacatgcttattctatagttcacattcaatccagagcactgaaggaactgaacaactggacactgtagacatcagatagctggccatggtgttggccatggcgtctcaggatgttcagaacttcttccagcctttctcttcctggatatctcgggtttatgaagctctccagcaagcaggagatatgttatctgcttcgctggttaacataagcaaacaagactctaaattgagtgacaaactagatcaggacttagataatattcagattcaggaaacgtactttgaagatgaagaacaagacaatgattggagtcaagaggatgcaaattccttgtttcttgaagtggatcatttctcatgttgtaatagtgatttgcaggactctgcccaaaattcaagcccaagccttagccaacatgcaaaggactcatgttccacaatgtcccagtggcccaattgggccagtgatgaccgcaagttaccacatgtgctttcttctattgcggaggaagagcatcacctt

SEQ ID NO: 21117 - DNA, 740 bp, Homo sapiens
  ENST00000636133
gaggagcgcgcgcccggccgggctcggcgccggtttcccgaacctgggcggccgtcgggcagccccctcgtccgaccatggcgactgacatcactcctgaagccattggcttcttgtctgctgttggggtctttattgttcttctggccgtcctcttcctcttcatcaacaagaagctgtgttttgaaacgataggaggccttcctttcctggagcatcgagggaaaagaaagcattctaaagacaagactgggattcacaaggggctggtcaacagctttggggatgacgaagagctgtccacatcttctgacagtgacgaggaggtgatcaaacaatttgagatttccgtgtcccggtcccagagtttccgttcagtgacatctgagaaaggaaagcagacaggattggagcagaaaccaaaattcagccgttcgttgttgacacacggagaagatggcacagaagtatctgcctgcgaagatttggatggagccagccaacggcgttattctgagaatctctcctacggtgaagatgaccacatccctgctcactcacagtccccatgtgaaagaggggatgccaaacaccacggcacatctcaccaagagtccagtgtggtccaaagcctcaggcgccaatccacagagggcagcttggagatggagacagcttttaatagccggggatttgaagattcctatgccactgacagctcctccatgtggagtccagag

SEQ ID NO: 21118 - DNA, 664 bp, Homo sapiens
  ENST00000554436
agtgaccaactgcgcggatggcgggatgctccgtgtcttaaccggggtcctgggctgcctgcaggccttgaaagtgctgaaaattgctgcgagtctgggcccctcttacagtggcagcctgttgctctttgatgccctgagagggcatttctgctgtattcggctgcggagctgcaggctcgactgtgcagcttgcgggaaatggcccactgtgactcatctgctggactatgaagccttctgtggctcctcagccaccgataaatgccgctccctgcagttactgggcccagaggatcgtgtttctgtcactgactataagcgacttctggattctggggcaccccatctgttgctggacatcaggcctaagatggagaaaaatttgctgacccctggtctagaacgtggaagcagcatgaaatgaagaggaatttaaggagacagcattgtttttagaattttctttacgttgtctacagtcactcctgaagccattggcttcttgtctgctgttggggtctttattgttcttctggccgtcctcttcctcttcatcaacaagaagctgtgttttgaaacgataggaggccttcctttcctggagcatcgagggaaaagaaagcattctaaagacaagactgggattcacaaggggctgggt

SEQ ID NO: 21119 - DNA, 13978 bp, Homo sapiens
  ENST00000568344
gggtctgaggttgtaactttaacaggtgtaagtatttctttcctctgtttcagctggaagttttgagagtgaaatattcacagccattaagagacctccaaattaatttctcaacatgcttattctatagttcacattcaatccagagcactgaaggaactgaacaactggacactgtagacatcagatagctggccatggtgttggccatggcgtctcaggatgttcagaacttcttccagcctttctcttcctggatatctcgggtttatgaagctctccagcaagcaggagatatgttatctgcttcgctggttaacataagcaaacaagactctaaattgagtgacaaactagatcaggacttagataatattcagattcaggaaacgtactttgaagatgaagaacaagacaatgattggagtcaagaggatgcaaattccttgtttcttgaagtggatcatttctcatgttgtaatagtgatttgcaggactctgcccaaaattcaagcccaagccttagccaacatgcaaaggactcatgttccacaatgtcccagtggcccaattgggccagtgatgaccgcaagttaccacatgtgctttcttctattgcggaggaagagcatcaccttgaaaagcaaagaagtggccttcaacatggctttgacagccagctccctggtactttagaaactgttaatggaaaaaagcaagtcaacagctttggggatgacgaagagctgtccacatcttctgacagtgacgaggaggtgatcaaacaatttgagatttccgtgtcccggtcccagagtttccgttcagtgacatctgagaaaggaaagcagacaggattggagcagaaaccaaaattcagccgttcgttgttgacacacggagaagatggcacagaagtatctgcctgcgaagatttggatggagccagccaacggcgttattctgagaatctctcctacggtgaagatgaccacatccctgctcactcacagtccccatgtgaaagaggggatgccaaacaccacggcacatctcaccaagagtccagtgtggtccaaagcctcaggcgccaatccacagagggcagcttggagatggagacagcttttaatagccggggatttgaagattcctatgccactgacagctcctccatgtggagtccagaggaacaggacaggaccaatttgcaggtgccatccggggtctcagagcccatctcaaagtgtggtgacctagatgtcatctttgaatatagagccgccagccagaagctcacagtgaccattgtgagggcacagggcctcccagataaggaccgaagtggtgtcaactcctggcaagttcatgtagtgctgctgcctggtaagaaacacaggggcaggacgaacatacagagagggcccaaccccgtcttcagggagaaggtcacctttgccaagctggagcccagagatgtggctgcctgtgctgtccgcttccgcctgtacgctgcccggaagatgacccgagagagaatgatgggagagaaactattctatctcagccacctgcacccagaaggggaaatgaaagtgactctggttctggagccaagaagtaatataagcagtggagggtctccgctcagcccatctgcggtttctcacagtgatagtacttcatccacgcagtcgctgtctcatggaggggcgccagagctgttggtggggctctcgtacaatgccacaacggggcgattatctgtggaaatgatcaaaggcagccatttccgaaacctcgctgttaaccgagcacctgatacatatggaaaactctttctcctcaattctgtgggtcaagagatgtcccgttgcaagacgtccattcggcgtggtcagcccaatcctgtctataaggagacctttgttttccaggtggccctctttcagctgtctgatgtcacgttgatgatttccgtttataacaggcgtactatgaagcgtaaagagatgattggctggattgccctgggccagaacagcagtggagaggaggaacaagatcactgggaggagatgaaggaaaccaaaggccagcagatctgcagatggcacactttgctggaatcctaggtttgctaacctgcatttgtgtgctgtgtccaccttggttacctgtgttgctgtctactgacactaagtgtcctggcaagggtttcagggtttcaaaaacagattccactaacccctaggacattgtgagtgggagttttgggtttctcaatggtctgatttggatttaaatattgtaattttaaaaacacacatacacagtgaagtgtccgtatggaaaatattataccacaattaagaccactgatgagttaatttgtgccaatagatcattgagttttagttcagggtatggggtgaagcttcttctgctgtctctgtttgcttgaagagtaacctgagattgcaagggagctgttaattgttactatttgcaaccatttaggtggatgaatcagaattttcttaatatggtacaaaaaactccaaaatatagatatgaatcagatgctgagcctcataaaagaatcaaactctaatccataaactcttatttcacatttttctctttatcaaagaaacctatttacctaacgagtaaatattataaacttgcacttttaaaataaatttgtattaattaaatacctcttttatcttatattttgtggtttctatgagatttggttagatgaatcattttgaagcaagaaaagagttcagaaactactgttttaagacaacttgtctccttttgaatatgtaagatttcaaacttgtgactttcaaggtttttatgctgtctttctcacccaataagttcttacagaataagaaaacaaaaaacaagactactgcagtcatagatttattgattttttctgcttctggtgttcttttggattatcctttttctatgttcaattatatatactcatatatgaatattttgaatgtactgcatgtaaaccatgctctttttaaactgagtattttccatcactagagcatagtaaattgtacacagtgagtccttaataaatattgatttgattgactcttcaaagtgaacatgttataacacctgtgaatggagaaatattttcagcttgtgtggaatgacattaagtttttctttgagcatttgaagtgcctataactgtcatttttttatggcatttgcagcaacatatattagtcactacttgcaatctgggcatgtgccattcagaatactgatcttgtatggttatgagcatgggattttacttatgacttaattttacatatttatgcagtgcatgtttactttccttattcataggtctgggcccttaatttcaattactttaaattggcattaataaaaaaatagggaaagaatgtatgtacatttaatccctgcgctcaatgtgcagctcttctgagcaattgctcagtcacctatttttagtttctatgtttcattgtggactttttcctgtctgtgggaagagtgatagctagtgatggctgtatacagttaaaaacacataactcctcctcagctccacgttttgacagattgtaagcgtaggctgtaacacttgaagaacatatttattccttacagtgtgtaatggttatcctgacaagaccagactagggcacaggataactctactatgctttcagggttcagtctttgaatgaaatgatttcatatggaagaatgagaatttgccaaataaattaataccttaattacttttcaggtcatgggagtttcatatatatggctgctcagttattaggaatatgtaataaaaccatgttcctctgggtttttaccctacctttctttgggagatctcagagtgcttttccagcattatatccattaactgctgagtggtctttgcagcgtggctaagtcattgagtagaactgagtgcgattgattaagtagcagcacaaagaagtggcttttcacatctcttactctttatgccttgtgtttaaagggaagtagaacagcctcgctatgctttcctttatgcagtaacataatagcagcattcattttaaaatttacatttgaaaaaaatctgtatatattgtacagacagccctgaatttttccctctcatattttcctgctgctgcatccttgtttcttggtacccaataatcacctatacttcattttctgttcccaagacccacccatttttaaggttttcggctggtgtagtgaagatatttgtgtgcttgatctgccttccaatggtctgtttatgatacagtttacaggaatgcgcaccattttaagggaaggaatgcctgaaaacattttttatttttataattttactatgttggtgctactcaccaaataggatgcatgtacatcttgaatatacagcaacattcaccctcagctgattgtatacatttaagtgctgaagacaagatatataacaatatgtggctgattttttttacctttatttgaaattctagtttagtaagatcttttgattttgtgcacttaaactcccttattttcttggcaaagtctagacacaaatgcatttaacatgtttttcacttgagcttttacatttggttttcaaaagagttatgaaagataattagttggttctgcagtaaaaaactgcttttgcctatttcttccagctaatgattaatatctcatagggagatttgacattgaagcagcactggtttttgttgcttgagtaggtctttcagcgattttgcctgaagagcatgcttttaaaataatatcgttaagagtaaatgatgcgctgggtttatggaaatctgctttatagtgtgccttcttttagggtgtgagtttacactgaattgagaaatcctgatttcaccaattacggtggtggctgttgtactctctactcccctctgactattgttgaatttttaaatggaccattcaccaggcagccgaacacctgctctccgttccctctccttcactggctcccagtgtgatgcacagttgttttggactctgtttttgctgatgctgcataactgttggaggtgggggtgtcttgccttccctaacataagaagaatttgtaatgtctttggatgtggcattccacctgcatgaaatcaggaaaagaatcatcaccatgtttgtgagagggaaaagagtatggcattgcatagtcattcgctttaggcactattaattctgacatccttcattgaaaattaactgacatcaaatgtcaatattctccatagtcctaggtgccagtgagcctgaaacacagcttctgccttttcaatgtgtagatttcatgatattttacaaattattgttacctcttgtgcagttactgtgctttagatgaccttatctgagaaccaaaattcttttctttccagatgaagtactatttaagtagaaactagcattaggttaaatcaaagtgcttctctgatagccaccaatttgatttaattgatgattcggtgtggacaccactgtgggtttccaaaaaaactggttatccttttgcagcagaggacttagtattttaaaaacagaaaagtaagtaggaaagtattatttgtaaatgtcataaaaccagatggaggcatattctttactgataaagaaacaggactagaacacgcatgtggtatctccttttacttttgaggaaactgtggttaaagaacattctattctatttgatctaagagcaaagcaaatgatggataatcctgaaatggtaaaagtatttttgtcttaaaaattattcatttgggcaaagtcatttacaacaaaataaaaagtcatacagcacacctatggaagaattaaagaatacataaatgtgctggatacatttagcatcctccagtgagttgtatgtaaggagagtaaactaataaaccaaaatacatatcagatcaactagctatcacttttctaaaacttgtagaattctgaaaaatatttaaagatgggagaaacgaaactgtgctaagacaatgagattggcatagcacagtgaagttggcacaaactgtgatcctggcctgggtttacatgaaactctgctgtgtggccttaagaaaattacttagccagcctgtatcctggtttcttcaactggaaaatggaaataatacctacctcattaggtgtcttaaaagatatcagtgaaatcacagatgtaatgtgcctagcatagagccgggcatgtagttagcattccgtagttcctccttacagtcatgcctgaaaaagaaaatatttaagatgtgtcttctttttctagcaaatgttattataacactagagaaaaacaaaaaccaacgttcagatactgtaacaaggataggctcatgaagccaggctggattcgtaaataaaggaggcttcatcaggacagcctaatcagagataagcctggtatgtggaggaaattgagccttaatagagtccaactgtggtagaaccaagtctttgcatttatccccttagtttggagggagtacaaatccttgatggtttgtgtgtacctcttgatcgatcacaaacaaggcctctccttgtctccagttctcttattcataaatggacaaggcatcttgtcgcctttatcaaaagagttggtgacaatggcagtttgactacatatttcaactgtgatccaaaaaagtaaaataaatgatgtgatactatactgagactgttttaaaaatggataacactttctttaaaacctgcattatatatccattttatatcctgatagccaaacattttaaaatactctaataacacagctctcaaaacgtatctgtttgactggaatgtcctgctcagaacaaattatcactgtttcccttatgagatcctaatgaaagaaattcagttgatactactttttaaaatgggttttaagagtggcttgttgatataatagcgcatccacttgttctcaagtgattcaaaccttgagtaaaaaggagagtttctggagaatttagaagaatctttgttgacatttaatctagagaagtcttcaggagcaaaccacttcaagttcagtgtaaccaggtgccatgagtcagtcatgtgctacttgtggttttaaacgaaacatgattctgggatgagaagtgcgaggctacactcctaatataatcaaattgccaaagcactgttttgagtcctcggtatcccaattaaggagaaacatgaagacattggagaatcacttagcttagggcttttagtagggaataattaaacatgtagggaaggtgaaggagttagatgggaggtaagaaggctgaggagatttctagtaacaatgatccaaaagttctaaccagggggatggtgcacactttctcttcttgaccacatggatagatttcagagcatccctctaaatcaagtctggagaattatgtgaaggttgtttctcattaattcaaaatgtattcattgtctagtactatgctatctgggctggcacagaacttaaaatctctttggagtgctatgagtgcacattgaagcagttggtcatcattatacaatgatgcttaccaatatacaactgttaagttagtctaactatgtgccataaacagtagagttccttgttactagtattggaaggtgaaacattggctgaatttattggggcaagtgtctaggaagccttggactggcagtgagtcttggttgcattatatgggaaattggtggggatgggggtgtcatagaatcatcatctttggaagttttttaaaatagaaaaatgtacttgaagtcttggttctgctaaagaagaatgagaggacacccatgaatataccctttataaagttccttctaatatttaggtgtaacgttaaaaaagaatcaacaataacactccaggcctgtcttcttccactttggacattttttccacattgatttttctctgcatcatagaaagttttctctgaagagttcctatttgggttttgtttagggctttggggatgcctgcaggctcagggggagtttcctctcctatggtgctttgactgtttttgtttcccttgggtcacaaaaccatatcctagacacacagacaataatcaccttatttatatccactgtggaacctgtgaaacagctcgaggctttacagaacaagctcataggcagtcatggagatctgaggcctttcttggaatgaagccgctaacttgctaactgctttccattgctcactaatgctgccttaaggtttcttcatgggaatttttacttcatgcctttgagtgacagtgttaccagttttaccttgaggatgatgagaaggctgacttcctattgtattgccatatttatgcattatttttgtttacgtcatttcccccttgaagtatctagttgctggggttttgtttgttttatacaaaatttattcattcaaaaagatctttataggttgggcatggtggctcacacctgtaatcccagaactttgggaggccgaggtgggagaacagcttgcgtccaggatttctagtccagcctgggcaacatagtgagatcttgtctctacaaaataccaaacattcgctgggtatggtggtgtgcgcctatagtcccagctcctcaggaagctgaggtgggaggattgcttgaacctgtgaggtcaaggctgcagtgagccgggatcatgccactgcattcagcctgggtagcagagtgagactctgtctcaaaaaaaccaaaaaacaagacctttttaagtgtaaatgttccagactcagggttaggggttggagaatggcagatggataaaatagtttaagttcaacaatatttttttgttgtttctaaatattctttttaaaaactagagtctgataagaaatctaggtaaataataagatcttttattaaccttgaatttttggcttaatgtatttctgtaattgtctctttccccctttgaaaggcagaagatttagggaaggtgaaagttattaccctgtatctaattaagaaataggtacacttgtttgtcagtctatgctttcattcaaaataaatggatatgttttgtatctgggggaggaaatgcatcattccattccagcagtgaaaagaattatagcatcaaataggatatttagtattcttgacttttataattaaatactgaatgccctttgcaagacagtaagttagatcctggaatgctaggtctgtacaaacttgacacatttcttacaagctctgtgttttaatagtcaaaggcattgctaccctttgctttttgaaagagtgaactggtaacagtagccgccagagaaagaggtgacaatctaaacaaagagccctgcttacctttctgtgactaaaactagtcttaaaaactgaatacatttggggcatccttatgaaataggtaaaggtcaacattgggagtgtccctaccttggcagatagaccaatacttttttcctagactcaacccatttttaaagcaggagtttttccaatggatttattgtttataattctactaaacatgtcttagtccacgcaaattaactcaaaatctttggtggcctgaaaattctgactgaaagcaagtttttcgtgttgcccagttgatagtccataataaaaaatgtacatatcttgtttaaaaaagaccttgatgtttgagaagaaatatcggaagtctgccagtaaaaactctgattaagtgaggaacatgtacattaaaagatattttcatgtaagttattttaagatagttgcattctaggaccatgtttcttttttgagagtgtttctttgtcaagttccttatagccaatgccttgaccaaagcttactaattttgccacatttccttgtgggttatgataatctttattaattcacaactctaccaaattataatacagtcttttattatgccaccatatgaatgcagctgcaaattcaattttgtgaaatacaaagtcctttccagaattttaaaacttaatttcagtatagattttaagtttgtgaataagaaattagtatttgtataccttattatgacagaggtttctgttacaatattttctcttatagtgttgggataggatttgacctgtattttcaggttaaagctggtctttgagatctactttttaagaaattaataaattttattttttagagttttaggttcacagcaaaattgatcctaaaatatagagttctcatatactccaaacacaaccttcttccccgtgaacattttgaacaccacagtgctatatttgttacaactgatgaaccttcattgacataacattatcacccaaagtgcatagttcatattaaggttcactcttggtgttgtgtattttatgggttttgaccaatgcacaatgacgtgtgtccactattgtagtatcatacagaagattttcactgccctaaaaatcctctgtgctctgcctattcattcctccctcccacctaagccctggcatccactggtccttgtactgtccccagagttttgccttttccagaatgtcatacagtatgtagccttttcagattggcttttttttttttcacttagggatagtcatgtaagttttcatgtctttttatggcttgatagttcatttattttaagtgctgaataatatttcattgtctggttgtatcaccatttatgacctatttgctcttatttctagttccagttgctatggcaaattttattaaagtgcgtgctctcaggaaaagctgcatatattttatatgatccatcaaataaaatgtagcaacttccagtctagaataaatttcacctatatgatattgagcttgttttacattgggggaggagatttatgaaaaaatataataatttcataatttatattaccctatctatgagtttttccctccattggaatctaaacagaaagttctgaaggttatgaagacgtgatcccaaatttagtgactctgtagtgtcttttgttgagcaatgagttaaatacctgtcgataaaaagtgttaattatgttattactgattcatgatagaaaatcaccttctgtcgctagtttatatgactttacatttaccactcctgccaagagaaaggaagctttgtgattgtgccccgtcatagttaattgtacaaatcaattaaaaatggtatgtaagcatctggctcacacagcagctctgaattctgaatgaaaagataacccatgctaatgtatatgttgcatgaacaagtagatgggtgttggaaagaaaacactgatagtcactctgggtgaagggggaggcctggccaatgatttgtatctgagaaacattttgagattatttatatgtcttctgactgccctttgctttgtagctacagcaacttgcagaacctggcattattgcagagatgaaggtatagttgtataaagaatattggattaaagttgatgaggcctgtgttctgatatcaaatcttccactaatgagctctaaaatgaatatcaagtcacaattttttcaagccttcattgttgcatctatcagatgggaatagtaatactcattttacctatttttaccaggtggttgtaggaacaggattcattcattccttcattaatataatgaacactttgagaccccactatataacagggccatacatatgacaaggtgatagatggaaagacgttttgcagaatttttgaagacttgcaatgtttttgaagactacaggatagtttgtgatttttatattaaggtcgtatcaactctttatgtcaatatatcaaagtaattgacacttttagagctctgccaatcagtgggccatattcatagaatgtcagtaatctgtctgaatacaagttatagttggtctttagctgttctgtctctgaggagctagaaataaaatattaggttctaatttttttttgttcaaacactgatcatgtaacaaactgcaaatccatgttttcagcaggttcgccaacctttgagttgaatgcagacctttctttagaacaacctaactttgagtacaggcaaagtattaaatggaatagcttttcctcccctacaaagtggatttgaatacagtccttagaaaaattcttcccctgccaaaaaaggtccttcaatctcctttattatttttcttttgaagaatcaaacttgtccatctctcccctcccaagtgactttcctcactcatgtaatcattttcttcataaatgcccttttactatcccacagaaaaagtaaagatttaaaaaatcatttttaaggtacatccaagatttcatagcaatattttatttgtgttcacagtgcaagataaatctgactttctcaatatttttggtcttcatatggcatctgaaacagttgttcacattcacacatttatgtttcaccatatgcatactgtgtacagctctgttgttctaaaatattttattggttttcctttatatctcaacttttgatgggtgtccttgaagaactttcatgaaaaaaatgtaaatgtgaatgattcattcattttgaacatatgtaactattttaggagattttcaggagattttaccctacatggagtacactgttcttagcagggaatgtgctttatattactattctactcacagctggatgctgcagatgtattaacattgtaaacatgtactttttctattctatgcttactttaatacattatttatatgtgctagactgtgctgagttttggtggttgtcaaaggcagtcagtaattttataaatttcacttttgtggatagttaagtataacatggtttagtataaaatctggtcttcctctagatttctaagtcactagaagaatttcttggcaaattgattgttcaaggccagttttgttagttgtaaggtggaagccaccccaatcctctcccagtgtttcataggcattttcagacctggatgctattatagttcctcctctagttttccagtagagaattcgtatgtggtccagaggttcaagagagagagagaaaaaatttctcctcaaaagaattgaacccttactttagaaacttctgacaatcttcagaacattccatgtgggtgtccttgtgtttctcatagtatgacttattgattcatggtgtctcttattaaagaagcatgaatgtatcactagctgttaccagaacaaacagctgtagaatgtaatgacccatcctatttctaaatttacttctatcagtggataatttgtgtataggaaaaggtgtggaaattttttaattgttaaaaactggaatacctttctaccttttgtagtctttaagatttcataatgatggttttaatgtattactatcttactattatgtattgtgtttaaacaagaccaatcagtgaaatattgaatgtcaatactttttgttagaaatgccctctgaaaatgttagaaaatgtaaaactttacctgtgacaaggaataaattcatgattagaagaattatactgtttttcttgtgcaaataatacttaaggcagatgttcagtctcacagtgatgttggaaagcatattttatgcagtctaaacactatttctgtattagatatttaaatgcatgaggataaattctaattgctttttgtttaaaacagaaacatagaagaagcattagccccagtttgtataaaatgtctgctgcaactgaattcatgatagttcatgaaaactgaaaatcattccaattttgtaaaactgctgctactggttttatcaataaagttttagcagatggcttata

SEQ ID NO: 21120 - DNA, 3219 bp, Homo sapiens
  ENST00000555409
tgtaactttaacaggtgtaagtatttctttcctctgtttcagctggaagttttgagagtgaaatattcacagccattaagagacctccaaattaatttctcaacatgcttattctatagttcacattcaatccagagcactgaaggaactgaacaactggacactgtagacatcagatagctggccatggtgttggccatggcgtctcaggatgttcagaacttcttccagcctttctcttcctggatatctcgggtttatgaagctctccagcaagcaggagatatgttatctgcttcgctggttaacataagcaaacaagactctaaattgagtgacaaactagatcaggacttagataatattcagattcaggaaacgtactttgaagatgaagaacaagacaatgattggagtcaagaggatgcaaattccttgtttcttgaagtggatcatttctcatgttgtaatagtgatttgcaggactctgcccaaaattcaagcccaagccttagccaacatgcaaaggactcatgttccacaatgtcccagtggcccaattgggccagtgatgaccgcaagttaccacatgtgctttcttctattgcggaggaagagcatcaccttgaaaagcaaagaagtggccttcaacatggctttgacagccagctccctggtactttagaaactgttaatggaaaaaagcaagtcaacagctttggggatgacgaagagctgtccacatcttctgacagtgacgaggaggtgatcaaacaatttgagatttccgtgtcccggtcccagagtttccgttcagtgacatctgagaaaggaaagcagacaggattggagcagaaaccaaaattcagccgttcgttgttgacacacggagaagatggcacagaagtatctgcctgcgaagatttggatggagccagccaacggcgttattctgagaatctctcctacggtgaagatgaccacatccctgctcactcacagtccccatgtgaaagaggggatgccaaacaccacggcacatctcaccaagagtccagtgtggtccaaagcctcaggcgccaatccacagagggcagcttggagatggagacagcttttaatagccggggatttgaagattcctatgccactgacagctcctccatgtggagtccagaggctaatttgaatcttaaaagaaaaggatatttattagatgtctactgtctgtcaagtcctctactttttacaacatccctacacagaaggaacaggacaggaccaatttgcaggtgccatccggggtctcagagcccatctcaaagtgtggtgacctagatgtcatctttgaatatagagccgccagccagaagctcacagtgaccattgtgagggcacagggcctcccagataaggaccgaagtggtgtcaactcctggcaagttcatgtagtgctgctgcctggtaagaaacacaggggcaggacgaacatacagagagggcccaaccccgtcttcagggagaaggtcacctttgccaagctggagcccagagatgtggctgcctgtgctgtccgcttccgcctgtacgctgcccggaagatgacccgagagagaatgatgggagagaaactattctatctcagccacctgcacccagaaggggaaatgaaagtgactctggttctggagccaagaagtaatataagcagtggagggtctccgctcagcccatctgcggtttctcacagtgatagtacttcatccacgcagtcgctgtctcatggaggggcgccagagctgttggtggggctctcgtacaatgccacaacggggcgattatctgtggaaatgatcaaaggcagccatttccgaaacctcgctgttaaccgagcacctgatacatatggaaaactctttctcctcaattctgtgggtcaagagatgtcccgttgcaagacgtccattcggcgtggtcagcccaatcctgtctataaggagacctttgttttccaggtggccctctttcagctgtctgatgtcacgttgatgatttccgtttataacaggcgtactatgaagcgtaaagagatgattggctggattgccctgggccagaacagcagtggagaggaggaacaagatcactgggaggagatgaaggaaaccaaaggccagcagatctgcagatggcacactttgctggaatcctaggtttgctaacctgcatttgtgtgctgtgtccaccttggttacctgtgttgctgtctactgacactaagtgtcctggcaagggtttcagggtttcaaaaacagattccactaacccctaggacattgtgagtgggagttttgggtttctcaatggtctgatttggatttaaatattgtaattttaaaaacacacatacacagtgaagtgtccgtatggaaaatattataccacaattaagaccactgatgagttaatttgtgccaatagatcattgagttttagttcagggtatggggtgaagcttcttctgctgtctctgtttgcttgaagagtaacctgagattgcaagggagctgttaattgttactatttgcaaccatttaggtggatgaatcagaattttcttaatatggtacaaaaaactccaaaatatagatatgaatcagatgctgagcctcataaaagaatcaaactctaatccataaactcttatttcacatttttctctttatcaaagaaacctatttacctaacgagtaaatattataaacttgcacttttaaaataaatttgtattaattaaatacctcttttatcttatattttgtggtttctatgagatttggttagatgaatcattttgaagcaagaaaagagttcagaaactactgttttaagacaacttgtctccttttgaatatgtaagatttcaaacttgtgactttcaaggtttttatgctgtctttctcacccaataagttcttacagaataagaaaacaaaaaacaagactactgcagtcatagatttattgattttttctgcttctggtgttcttttggattatcctttttctatgttcaattatatatactcatatatgaatattttgaatgtactgcatgtaaaccatgctctttttaaactgagtattttccatcactagagcatagtaaattgtacacagtgagtccttaataaatattgatttgattgactcttcaaa

SEQ ID NO: 21121 - DNA, 2029 bp, Homo sapiens
  ENST00000430451
tgaatcttaaaagaaaaggatatttattagatgtctactgtctgtcaagtcctctactttttacaacatccctacacagaaggaacaggacaggaccaatttgcaggtgccatccggggtctcagagcccatctcaaagtgtggtgacctagatgtcatctttgaatatagagccgccagccagaagctcacagtgaccattgtgagggcacagggcctcccagataaggaccgaagtggtgtcaactcctggcaagttcatgtagtgctgctgcctggtaagaaacacaggggcaggacgaacatacagagagggcccaaccccgtcttcagggagaaggtcacctttgccaagctggagcccagagatgtggctgcctgtgctgtccgcttccgcctgtacgctgcccggaagatgacccgagagagaatgatgggagagaaactattctatctcagccacctgcacccagaaggggaaatgaaagtgactctggttctggagccaagaagtaatataagcagtggagggtctccgctcagcccatctgcggtttctcacagtgatagtacttcatccacgcagtcgctgtctcatggaggggcgccagagctgttggtggggctctcgtacaatgccacaacggggcgattatctgtggaaatgatcaaaggcagccatttccgaaacctcgctgttaaccgagcacctgatacatatggaaaactctttctcctcaattctgtgggtcaagagatgtcccgttgcaagacgtccattcggcgtggtcagcccaatcctgtctataaggagacctttgttttccaggtggccctctttcagctgtctgatgtcacgttgatgatttccgtttataacaggcgtactatgaagcgtaaagagatgattggctggattgccctgggccagaacagcagtggagaggaggaacaagatcactgggaggagatgaaggaaaccaaaggccagcagatctgcagatggcacactttgctggaatcctaggtttgctaacctgcatttgtgtgctgtgtccaccttggttacctgtgttgctgtctactgacactaagtgtcctggcaagggtttcagggtttcaaaaacagattccactaacccctaggacattgtgagtgggagttttgggtttctcaatggtctgatttggatttaaatattgtaattttaaaaacacacatacacagtgaagtgtccgtatggaaaatattataccacaattaagaccactgatgagttaatttgtgccaatagatcattgagttttagttcagggtatggggtgaagcttcttctgctgtctctgtttgcttgaagagtaacctgagattgcaagggagctgttaattgttactatttgcaaccatttaggtggatgaatcagaattttcttaatatggtacaaaaaactccaaaatatagatatgaatcagatgctgagcctcataaaagaatcaaactctaatccataaactcttatttcacatttttctctttatcaaagaaacctatttacctaacgagtaaatattataaacttgcacttttaaaataaatttgtattaattaaatacctcttttatcttatattttgtggtttctatgagatttggttagatgaatcattttgaagcaagaaaagagttcagaaactactgttttaagacaacttgtctccttttgaatatgtaagatttcaaacttgtgactttcaaggtttttatgctgtctttctcacccaataagttcttacagaataagaaaacaaaaaacaagactactgcagtcatagatttattgattttttctgcttctggtgttcttttggattatcctttttctatgttcaattatatatactcatatatgaatattttgaatgtactgcatgtaaaccatgctctttttaaactgagtattttccatcactagagcatagtaaattgtacacagtgagtccttaataaatattgatttgattgactctt

SEQ ID NO: 21122 - DNA, 580 bp, Homo sapiens
  ENST00000570264
ctctgcaagcctcaccgcaaccgtgctaggcgcgtcgggtggggcgggaataaagtttttccaacccagtttggggagagggctggatgggaaggaccctccctgctgcagacttcatggcaggctgcactgtgtcccctcggctccacggctgccccgggggcgctgctttcgttggaaccattaaacgagggttttctttctagaatctctggtctgctgctgtgcagatggacctgccggcactgctgtcagaagtgctacgagtccagctgttgccagtcaagtgaggatgaagttgaaattctgggacctttccctgctcagacccctccctggctgatggccagccggagcagtgacaaggatggtgactctgtccacacggccagcgaagtcccgctgaccccacggaccaattccccggatggaagacgctcgtcctcagacacatccaagtctacatacagcctgacgcggaggatttcgagtcttgagtcaagacgtcccagctctccactcatcgatattaaacccatcgagtttggcgttctcagcgccaagaaggagcccatccaac

SEQ ID NO: 21123 - DNA, 551 bp, Homo sapiens
  ENST00000566261
agtttttccaacccagtttggggagagggctggatgggaaggaccctccctgctgcagacttcatggcaggctgcactgtgtcccctcggctccacggctgccccgggggcgctgctttcgggttttctttctagaatctctggtctgctgctgtgcagatggacctgccggcactgctgtcagaagtgctacgagtccagctgttgccagtcaagtgaggatgaagttgaaattctgggacctttccctgctcagacccctccctggctgatggccagccggagcagtgacaaggatggtgactctgtccacacggccagcgaagtcccgctgaccccacggaccaattccccggatggaagacgctcgtcctcagacacatccaagtctacatacagcctgacgcggaggatttcgagtcttgagtcaagacgtcccagctctccactcatcgatattaaacccatcgagtttggcgttctcagcgccaagaaggagcccatccaaccttcggtgctcagacggacctataaccccgacgactatttca

SEQ ID NO: 21124 - DNA, 3081 bp, Homo sapiens
  ENST00000355377
ccccggcgtctccggccccgcctgcgctggggtcgctgcagtccccgcagctgccccgggctgcttgcccaggcgccccggccttattccagcctggggagcgcctcggtggggagcacgggacagcgagggaggccgaggcgggggccctgggcgcccgatatctccgaaccggggaggcggccccgattccgagagccggaacgcagggaaaggcaaggacggggcggccggcggaggggcgggcgccgctcatcagccacgccagtcacgtctggggccaccggctgcctttttcttcctttccccctttgctttcttccccctccgctgttggcgagggcaaagtggccgtggcggcgccatgcccgggccggagtgagtgcgcgcgggcgaaaatggcgtacatccagttggaaccattaaacgagggttttctttctagaatctctggtctgctgctgtgcagatggacctgccggcactgctgtcagaagtgctacgagtccagctgttgccagtcaagtgaggatgaagttgaaattctgggacctttccctgctcagacccctccctggctgatggccagccggagcagtgacaaggatggtgactctgtccacacggccagcgaagtcccgctgaccccacggaccaattccccggatggaagacgctcgtcctcagacacatccaagtctacatacagcctgacgcggaggatttcgagtcttgagtcaagacgtcccagctctccactcatcgatattaaacccatcgagtttggcgttctcagcgccaagaaggagcccatccaaccttcggtgctcagacggacctataaccccgacgactatttcaggaagttcgaaccccacctgtactccctcgactccaacagcgacgatgtggactctctgacagacgaggagatcctgtccaagtaccagctgggcatgctgcacttcagcactcagtacgacctgctgcacaaccacctcaccgtgcgcgtgatcgaggccagggacctgccacctcccatctcccacgatggctcgcgccaggacatggcgcactccaacccctacgtcaagatctgtctcctgccagaccagaagaactcaaagcagaccggggtcaaacgcaagacccagaagcccgtgtttgaggagcgctacaccttcgagatccccttcctggaggcccagaggaggaccctgctcctgaccgtggtggattttgataagttctcccgccactgtgtcattgggaaagtttctgtgcctttgtgtgaagttgacctggtcaagggcgggcactggtggaaggcgctgattcccagttctcagaatgaagtggagctgggggagctgcttctgtcactgaattatctcccaagtgctggcagactgaatgttgatgtcattcgagccaagcaacttcttcagacagatgtgagccaaggttcagacccctttgtgaaaatccagctggtgcatggactcaaacttgtgaaaaccaagaagacgtccttcttaaggggcacaattgatcctttctacaatgaatccttcagcttcaaagttccccaagaagaactggaaaatgccagcctagtgtttacagttttcggccacaacatgaagagcagcaatgacttcatcgggaggatcgtcattggccagtactcttcaggcccctctgagaccaaccactggaggcgcatgctcaacacgcaccgcacagccgtggagcagtggcatagcctgaggtcccgagctgagtgtgaccgcgtgtctcctgcctccctggaggtgacctgagggctgcagggaaggcagctttcatttgtttaaaaaaaaaaaaaaaagacggaaaaaaatgtgtcacatactattacatccacacctgcatacacactcgcaacatgtctacacacgtccacacacacagacacacagataccccaaatcctctcagaactgagaggaagctgactattgatcacaaaatggccgccctcagttgagtgaggcctaggaactttccggaagccccatccatagatcacaagctcagtgggctctgccgtgggacttattggcagtgcctgctcttgtcaatactcctgccccaaaatgcactttcaaccctcaggccagagaaaggacctcccaaagggtgccaagctccatcaagactaaatttaccaagagtttggccagtgtgtgggagacttgaacaccccccacttccgaaacacacacctactgggtaacttctgaacaggctgctgttccctggggttcttcaaacctgatacctttctccaaaggtgtaagtatctttgtcttctccgtagtaaatgtgataactagattatgggccatttggagaaaccaaatggcaaccaaaactattccagtgtcagaagcctttcctggcttaacagaattgttcttgtgttagctcatcccagggaacgccctgtgggtatgtatgtgtatgtcctcgtgcatgtgccctcacaggcgaacacgtgtgtgcctatgtgtcctcttggagagcatggcgatgggccaggacctcagccctgagcactgccttctctctgcctctcctgtccagtgagagtccaaccagtgtcctcctgtctgtcagagatcccactttggataaaagtagtgtgtgtgtgtgtgtgtgtgtgtgtgtgtgtgtgtaaagtaaataggatatgatagagcaaaagtaacattttttgaccgaatcatggtgattgtgacccacgaaagacatacaaagacttgatatatggattaaaatggctatcacaccccatccatgatgatcttcttccttaatcatactctgaggatctttctgtgtttttctgtgaacgaatgtcacgtctctcgtgctaaggaattagtgtagttagaatagatctctctctctctctctttctctctctctctttcctctctctctgttggatgcttctgtatctttttccacagcataatgtctggtgtgatggggagctatttattgaaattaaagattatttatttgtgccatgca

SEQ ID NO: 21125 - DNA, 1721 bp, Homo sapiens
  ENST00000568115
ccggccccgcctgcgctggggtcgctgcagtccccgcagctgccccgggctgcttgcccaggcgccccggccttattccagcctggggagcgcctcggtggggagcacgggacagcgagggaggccgaggcgggggccctgggcgcccgatatctccgaaccggggaggcggccccgattccgagagccggaacgcagggaaaggcaaggacggggcggccggcggaggggcgggcgccgctcatcagccacgccagtcacgtctggggccaccggctgcctttttcttcctttccccctttgctttcttccccctccgctgttggcgagggcaaagtggccgtggcggcgccatgcccgggccggagtgagtgcgcgcgggcgaaaatggcgtacatccagaatctctggtctgctgctgtgcagatggacctgccggcactgctgtcagaagtgctacgagtccagctgttgccagtcaagtgaggatgaagttgaaattctgggacctttccctgctcagacccctccctggctgatggccagccggagcagtgacaaggatggtgactctgtccacacggccagcgaagtcccgctgaccccacggaccaattccccggatggaagacgctcgtcctcagacacatccaagtctacatacagcctgacgcggaggatttcgagtcttgagtcaagacgtcccagctctccactcatcgatattaaacccatcgagtttggcgttctcagcgccaagaaggagcccatccaaccttcggtgctcagacggacctataaccccgacgactatttcaggaagttcgaaccccacctgtactccctcgactccaacagcgacgatgtggactctctgacagacgaggagatcctgtccaagtaccagctgggcatgctgcacttcagcactcagtacgacctgctgcacaaccacctcaccgtgcgcgtgatcgaggccagggacctgccacctcccatctcccacgatggctcgcgccaggacatggcgcactccaacccctacgtcaagatctgtctcctgccagaccagaagaactcaaagcagaccggggtcaaacgcaagacccagaagcccgtgtttgaggagcgctacaccttcgagatccccttcctggaggcccagaggaggaccctgctcctgaccgtggtggattttgataagttctcccgccactgtgtcattgggaaagtttctgtgcctttgtgtgaagttgacctggtcaagggcgggcactggtggaaggcgctgattcccagttctcagaatgaagtggagctgggggagctgcttctgtcactgaattatctcccaagtgctggcagactgaatgttgatgtcattcgagccaagcaacttcttcagacagatgtgagccaaggttcagacccctttgtgaaaatccagctggtgcatggactcaaacttgtgaaaaccaagaagacgtccttcttaaggggcacaattgatcctttctacaatgaatccttcagcttcaaagttccccaagaagaactggaaaatgccagcctagtgtttacaggatccaacagccccataccagcctgcgaactgagtagtcacccagctcatggtatcagtccttggataccctcacctggaaatgaacatttccatggcataaagaagcaagtaaaggcaataaaagtagaatgattga

SEQ ID NO: 21126 - DNA, 5092 bp, Homo sapiens
  ENST00000562034
ggggctattgagtagtcgcccaacaaacacttgggcgaccgcctactaagtgctggcactggggatacagtgatgaaaacagcacagttcctgcccctctgggtgcgcaatttagtgagaaatgaacatgattaccggctcctggagttcttaatggccgccttcagcacagagaaattaagtgacttgcccaaggccacatagctgcttaggggtcaaggtgggatctcaagaggggactgtggtagatatgttaagcatctcatatggcgatgacccagtgatgttggttttccttctagaacaaggtgttaaactttgttgtcctgtaaagtgccagatactattttttttctcttggaggctcacatggtctctgtcacaactattccactctgactatagcaccaaaactgctatggacagtagtaaatgagtgggcgtggctgtgttccaataaaactttatttgcaggcaccaaaatttgaattttgtatactttgcacgagtcaagaggcattcatcttttttttttttcaaccttttaaaaactcacaaattattcttagctcaagggctgtagcaaaacaggctgcggggctggttttgatctgcgagccttagtttgccaacctctgtttagaatgcatgggttgtctttcttcctctttctttctggtgtgaattggttctcttccatcggtgtcaaacacgtgagcccaggagacccaatgccagaaagactcagcatgcctgggaatgtcagggcaccctctttcatcttctttgctttctctctgctccttgacactcatcttgcacctgggctttgagaaagttggggaggctgtttttcagcagggccatgaggtgaccttgtctctgttcactttggtttcataaatggcctcttttgaccaccacatgtctaggaaatgcttccctgtattcagaaaatggtcatagattattatgaaaaagtatcactttatcctaacattctaaagcactttttcatgcaagccctatgagggtataatattttgctgttttgtgccctgctgtacctgccgggacaatacccagtgcctactgggttccactaggtcttgacaatcacctaattctcatcacagaaagggtgcattttatttttcagctggaccgcacgcaagtatttgcatagtcagtgtcctgtcccacctcaacagcacgcctttgaggtatagagtagcctttccactaaagaagaggtaaccgaggctcagagaggccccctgtcttgcccaagtcacatgatcagtcgatggtgagactaggactctagtacttcctggctcagcttgttgcgtggcccctcagcacctttgggtcttgttctgtgtatggtttgagttttggctttagagagtttgtgataagtgcctttgactatttcccaagctgttgctattcccttaccacttcgaggatttcaattttttcacaagccacgtaccacctatactatgatgatgatgatgatgatgatgatgatgatgatgattatgattattattttagacagggtctcactctgtcgcccaggctggagtgcagtggtgcgatctcggctcactgcaacctctgcttcccaggttcaagtgattctcctgcctcagcctccccagcagctgggattacaggcgcctgccaccacgcctggctaattttttgtatttttagaaaagagggggtttcaccatgttggccaggctggtctcaaactcctgacctcaggtgatccacccgccttggcctcccaaagtactgtgattataggcatcagccaccacgcccagccctacctatgctattattaacttaattttttttctataaatgggctcatttttatttttactttaaaaaaatcatatgaaaaggaaacattatgtcactaatatcataggaaaccaagatcatgtgacatcgcagaaggcaactagaagaataaacccaatgggaataatgccacattactgaattctaggtggacgtggctgtctccaagcctctggacaagatctactttctttgtttaaaagaaaggggatgggggagggtggaaattggtaagtggtaaaagatgttaacatgtagtggtaccaaattgagactttctcctccttaaaggagaatcggaaaaaagataataactttctccctcttgattcaaagttctgagtttgagtcccacctcagttcacctctgggacatgcccgaggttgggatgcagtacttctaacctatctagcctacttggcccatttggaaaaccaccttaaagagaaggagggagtctgtgccttgagaacccaggagacgaagatggggaggcggggtggggccacaacaggaagggaggacctccttcctcaagaggaccagattagggcttcctttttagttccctctatttgtgggtggtgataggaaacaccccaccatcaccattggagcagaattggaaggtagggcctccgggagggcgggggagccaagtaacatccactgtgtgcctgcctgcatgttagctaatcatgtccttttgggttggctacatggctatttctgtataggaaggtttgctcttctcctgaagtgtggctgcattggatagcatgactatctatccgcccgctctgattcataacagcatacggtgcaaatcaaatcgaaatgctaaagtttcccatttatttggtgttggttaaccaggaggctaccagcagccctgaaaatagcaacaccttgttaggatgttaggaagtcagctcccttcccaggatggtaagtggaaatatgcagggcttttttttttttttgtaaaatttttttgagttgctggaatattgctaaactggtcttgtctctctttctttaaccccttcgttcccttacgcccttggcttcatcgtggatcttaaaagggcagttggaaccattaaacgaggtgggttcatttgatgatttgtttggtctggtttctaatcaagaaatgcctgactttcattttggagtcttatgtggggctgtggggatattgaatattcaacaataacctggtgttaataacggcacagtttccattcctttctaccgaaaggagatcccggttttgaaaagacaccagttgacaagacaagtttccctctccacccctacttattccgtttgattatctctgtctgtttcatgtcaccgagattttttaaaaatattttttcccctgctttcaagaagacacagtaatattcattgtgtttcgaacatatcgtatagcccttatgatgttgtataaaccacccacatgtcaagaaagacgttcacataaactacaaaagaaaatacctgcaaatgttttgcttgctactaacggctccagcgagttgatgtttgctatctttgtgcctgcagttggtaaatagaaatggaaaacattttgttctaagtgctgagcagcagagccagaactcctgaatgtctatttctcatccgagatcggctgcttgtaattttgggtgttgtttctcctcttcctcttccccaccctgcccacctcccctctcccccatccccccgcccacctcccccaatggcctcagggttttctttctagaatctctggtctgctgctgtgcagatggacctgccggcactgctgtcagaagtgctacgagtccagctgttgccagtcaagtgaggatgaagttgaaattctgggacctttccctgctcagacccctccctggctgatggccagccggagcagtgacaaggatggtgactctgtccacacggccagcgaagtcccgctgaccccacggaccaattccccggatggaagacgctcgtcctcagacacatccaagtctacatacagcctgacgcggaggatttcgagtcttgagtcaagacgtcccagctctccactcatcgatattaaacccatcgagtttggcgttctcagcgccaagaaggagcccatccaaccttcggtgctcagacggacctataaccccgacgactatttcaggaagttcgaaccccacctgtactccctcgactccaacagcgacgatgtggactctctgacagacgaggagatcctgtccaagtaccagctgggcatgctgcacttcagcactcagtacgacctgctgcacaaccacctcaccgtgcgcgtgatcgaggccagggacctgccacctcccatctcccacgatggctcgcgccaggacatggcgcactccaacccctacgtcaagatctgtctcctgccagaccagaagaactcaaagcagaccggggtcaaacgcaagacccagaagcccgtgtttgaggagcgctacaccttcgagatccccttcctggaggcccagaggaggaccctgctcctgaccgtggtggattttgataagttctcccgccactgtgtcattgggaaagtttctgtgcctttgtgtgaagttgacctggtcaagggcgggcactggtggaaggcgctgattcccagttctcagaatgaagtggagctgggggagctgcttctgtcactgaattatctcccaagtgctggcagactgaatgttgatgtcattcgagccaagcaacttcttcagacagatgtgagccaaggttcagacccctttgtgaaaatccagctggtgcatggactcaaacttgtgaaaaccaagaagacgtccttcttaaggggcacaattgatcctttctacaatgaatccttcagcttcaaagttccccaagaagaactggaaaatgccagcctagtgtttacagttttcggccacaacatgaagagcagcaatgacttcatcgggaggatcgtcattggccagtactcttcaggcccctctgagaccaaccactggaggcgcatgctcaacacgcaccgcacagccgtggagcagtggcatagcctgaggtcccgagctgagtgtgaccgcgtgtctcctgcctccctggaggtgacctgagggctgcagggaaggcagctttcatttgtttaaaaaaaaaaaaaaaagacgg

SEQ ID NO: 21127 - DNA, 1702 bp, Homo sapiens
  ENST00000562711
gttagctaatcatgtccttttgggttggctacatggctatttctgtataggaaggtttgctcttctcctgaagtgtggctgcattggatagcatgactatctatccgcccgctctgattcataacagcatacggtgcaaatcaaatcgaaatgctaaagtttcccatttatttggtgttggttaaccaggaggctaccagcagccctgaaaatagcaacaccttgttaggatgttaggaagtcagctcccttcccaggatgttggaaccattaaacgagggttttctttctagaatctctggtctgctgctgtgcagatggacctgccggcactgctgtcagaagtgctacgagtccagctgttgccagtcaagtgaggatgaagttgaaattctgggacctttccctgctcagacccctccctggctgatggccagccggagcagtgacaaggatggtgactctgtccacacggccagcgaagtcccgctgaccccacggaccaattccccggatggaagacgctcgtcctcagacacatccaagtctacatacagcctgacgcggaggatttcgagtcttgagtcaagacgtcccagctctccactcatcgatattaaacccatcgagtttggcgttctcagcgccaagaaggagcccatccaaccttcggtgctcagacggacctataaccccgacgactatttcaggaagttcgaaccccacctgtactccctcgactccaacagcgacgatgtggactctctgacagacgaggagatcctgtccaagtaccagctgggcatgctgcacttcagcactcagtacgacctgctgcacaaccacctcaccgtgcgcgtgatcgaggccagggacctgccacctcccatctcccacgatggctcgcgccaggacatggcgcactccaacccctacgtcaagatctgtctcctgccagaccagaagaactcaaagcagaccggggtcaaacgcaagacccagaagcccgtgtttgaggagcgctacaccttcgagatccccttcctggaggcccagaggaggaccctgctcctgaccgtggtggattttgataagttctcccgccactgtgtcattgggaaagtttctgtgcctttgtgtgaagttgacctggtcaagggcgggcactggtggaaggcgctgattcccagttctcagaatgaagtggagctgggggagctgcttctgtcactgaattatctcccaagtgctggcagactgaatgttgatgtcattcgagccaagcaacttcttcagacagatgtgagccaaggttcagacccctttgtgaaaatccagctggtgcatggactcaaacttgtgaaaaccaagaagacgtccttcttaaggggcacaattgatcctttctacaatgaatccttcagcttcaaagttccccaagaagaactggaaaatgccagcctagtgtttacagttttcggccacaacatgaagagcagcaatgacttcatcgggaggatcgtcattggccagtactcttcaggcccctctgagaccaaccactggaggcgcatgctcaacacgcaccgcacagccgtggagcagtggcatagcctgaggtcccgagctgagtgtgaccgcgtgtctcctgcctccctggaggtgacctgagggctgcagggaaggcagctttcatttgttt

SEQ ID NO: 21128 - DNA, 869 bp, Homo sapiens
  ENST00000562274
ctaaattggggaatatttcttcatatcatttcacattttgtgcaaaaagcaagacgttgttgagagtttaaggacaccacactgtcaaatttgcattattccatgttgcataaaatgagtctgagagcggtttcatcgtgggtcttaacccccaagggacagagatgccagtccccggggattcctggacagctactgagacctcttcccttcctataggatggccagccggagcagtgacaaggatggtgactctgtccacacggccagcgaagtcccgctgaccccacggaccaattccccggatggaagacgctcgtcctcagacacatccaagtctacatacagcctgacgcggaggatttcgagtcttgagtcaagacgtcccagctctccactcatcgatattaaacccatcgagtttggcgttctcagcgccaagaaggagcccatccaaccttcggtgctcagacggacctataaccccgacgactatttcaggaagttcgaaccccacctgtactccctcgactccaacagcgacgatgtggactctctgacagacgaggagatcctgtccaagtaccagctgggcatgctgcacttcagcactcagtacgacctgctgcacaaccacctcaccgtgcgcgtgatcgaggccagggacctgccacctcccatctcccacgatggctcgcgccaggacatggcgcactccaacccctacgtcaagatctgtctcctgccagaccagaagaactcaaagcagaccggggtcaaacgcaagacccagaagcccgtgtttgaggagcgctacaccttcgagatccccttcctggaggcccagaggaggaccctgctcctgaccg

SEQ ID NO: 21129 - DNA, 531 bp, Homo sapiens
  ENST00000565183
gccagaccagaagaactcaaagcagaccggggtcaaacgcaagacccagaagcccgtgtttgaggagcgctacaccttcgagatccccttcctggaggcccagaggaggaccctgctcctgaccgtggtggattttgataagttctcccgccactgtgtcattgggaaagtttctgtgcctttgtgtgaagttgacctggtcaagggcgggcactggtggaaggcgctgattcccagttctcagaatgaagtggagctgggggagctgcttctgtcactgaattatctcccaagtgctggcagactgaatgttgatgtcattcgagccaagcaacttcttcagacagatgtgagccaaggttcagctggtgcatggactcaaacttgtgaaaaccaagaagacgtccttcttaaggggcacaattgatcctttctacaatgaatccttcagcttcaaagttccccaagaagaactggaaaatgccagcctagtgtttacaggatccaacagccccataccagcctgcgaac

SEQ ID NO: 21130 - DNA, 812 bp, Homo sapiens
  ENST00000568433
atcgggctcttacaagaaaggaaatgaggcctgtttatttgtgacatcgcttccacaagggacgaggtagaagtgggcctgtcacccagttccttctcctgtcttggcttcgattctgtgggggttggataggacagggggtggaacatcgtgctgacaacccctctcggcccgtggtgtggcagcagctcagcctctgtgttgggggctgcactgcttgatcttggatttgtttctggtgctgtgaatatagtagtggacacatgggcactttctttgcctttatggagaaaaagaatgaagtggagctgggggagctgcttctgtcactgaattatctcccaagtgctggcagactgaatgttgatgtcattcgagccaagcaacttcttcagacagatgtgagccaaggttcagacccctttgtgaaaatccagctggtgcatggactcaaacttgtgaaaaccaagaagacgtccttcttaaggggcacaattgatcctttctacaatgaatccttcagcttcaaagttccccaagaagaactggaaaatgccagcctagtgtttacagttttcggccacaacatgaagagcagcaatgacttcatcgggaggatcgtcattggccagtactcttcaggcccctctgagaccaaccactggaggcgcatgctcaacacgcaccgcacagccgtggagcagtggcatagcctgaggtcccgagctgagtgtgaccgcgtgtctcctgcctccctggaggtgacctgagggctgcagggaaggcagctttcatttgtttaaaaaaaaaaa

SEQ ID NO: 21131 - DNA, 7614 bp, Homo sapiens
  ENST00000367267
atagagagagggagagactcgagagcgagcgagcgcgggagcgagggccgcagcggcagggccggcggggaagtgggaagagggacctggacttcgggaccccagctgtccccgcccccgcccccgcccccgccctctccaccagctcaggctgaacgcgcccggaacgtcccaggctgtttcctctgccaccatgaggaacattttcaagaggaaccaggagcctattgtggctcctgccaccaccaccgccacgatgcccattggacccgtggacaactccactgagagtgggggtgctggggagagccaggaggacatgtttgccaaactgaaggagaagttattcaatgagataaacaagattcccttaccaccctgggcactgatcgccattgctgtggttgctgggctcctgcttctcacctgctgcttctgcatctgcaagaaatgctgctgcaagaagaagaagaacaagaaggagaagggcaaaggcatgaagaatgccatgaacatgaaggacatgaaagggggtcaggatgacgacgacgcagagacaggcctgactgagggggaaggtgaaggggaggaggagaaagagccagagaacctgggcaaactgcagttttccctggactatgattttcaggctaatcagcttactgtgggcgttctgcaggctgctgaactgcctgccctggacatgggaggcacctcagacccttatgtcaaggtcttcctccttcctgacaagaagaagaaatatgagaccaaagtccatcggaagacactgaaccctgccttcaatgaaaccttcaccttcaaggtgccataccaggagcttgggggcaaaactctggtgatggccatctatgactttgaccgcttctccaaacatgacatcattggagaggtaaaggtgcctatgaacacagtggacctcggccagcccattgaggagtggagagacctgcaaggcggggaaaaggaggagccggagaagctgggcgacatctgcacctccctgcgctatgtgcccacggccgggaagctcactgtctgcatcctggaggctaagaacctcaagaagatggacgtgggcggcctttcagacccgtacgtgaagatccacctgatgcagaatggcaagaggctcaagaagaagaagacaaccgtgaagaagaagaccctgaacccatacttcaacgagtccttcagctttgagatccccttcgagcagattcagaaagtccaggtagtggtcaccgtgctggactatgacaagctgggcaagaacgaagccataggcaagatcttcgtgggcagcaatgccacgggcacagagctgcggcactggtccgacatgctggccaacccccggaggcccatcgcccagtggcactcgctcaagcctgaggaggaggtggatgcactcctgggcaagaacaagtagacagcagcggctgggaccccacacctttcacggacactgacaagatccagagctatcaatacctcagttatgcaaccttagaggttttcttttttctttcatttgttgggtggttgtgtccttgtttttccttgtttttctctttttaaagaccaacttccctttgatggctgtgtgaggagagtcccctaagaggtgaaagagaagcctggctctgttcacggtcccaggagctgtccttgctgcatgccctgtcacagttccctcgactctttcaaagcttcacatctgcctcaccccaagcgaggctctctactggcacaaacttgcagcagttcctgttttttgagccttctggaccaacaaaatggcagcacatcctgcttcctgacagggaaggcatcacagtggccaatgatcgtgtgtgtgtgtgtgtgtgtgtgtgtgtatgtgtgtgtgtgtgtgtgtgtgtgtgtgtgtgtgtgtgtctttgagcatttctcttcattcctggaatgtgtgtgtgtgtgtgtctctttgagcatctctcttcattcctggaatgagccatggacagtaaagttgtgtgggaaaagaaggctctttggggaccctgacatgaagaagtccactaagtgggagatcttctctcatctatggcaaagtctcaggatcctgttcagatatcggggctttcatactcctgttggtggctatttgggaggcagcaagatgtgaagactggatgtgttcagaactaggaccaaacgatgccatcaaatacttcctcctgccagtcatggtttccccagaagtgtagttcctgggacattcatggatatgagctattcactagttgggtcagactaacagggactctcagtcccaaaatctcactcttattgacaataaatatcaaactatgaagaaacagaagtcccattaccagaaagaccaaaattaaactcctggatcttcaccccatccagtgggaaacacagatgctttctccctttccagaatataagcagccaagttcatttgcatttattccccattgtgcttttgcttctgtttctcttttaagtggagcaacactgtctgaagacacgttatctgtgcagagccagagaactttaaaaggaaagtttaaatgttcttagttctcctgaggtccaggtaagaagggggtggtaagaagaggatgggggacagatggctgagatcccttgggaggagatataggggagcactggaattcccccgactcccactccttgctcccttggccctctgccctccatgctggagagctgataggtagctggagtggcccagggagacctatgggaaggacccgtcctaccattagggggcttctctctatgaatgctaagaaacaaagggcatccattccaaatgagtagcagaggtgaccttctagggtttctacccatgctcagttgtatcccattccctgttcaccttttgtccccagcactgatataaaagccatatatatgttagtcaggtttgcactgagtcttcttccaatccttcagcctggacaacagagtgaggtccccttgtggccagaggccagccctccttgcctgccttcctttgacctctcttttccatccatgaagccctcaggcccttgccattttttcaccacagaaaactcatggcttctccagaagcctgagtatctctctttcccagcacaaatggcagcatctctatcctgccccatctgggccacttcagcttcctgtagacacccaagacagatggacagtgttggagggaatcaggctttgaggatccagtgtgaagaagttgcagagtgtctttttattttattttaaaaagggggaaggggcttttggttttgctttgttttttggatgaaggagtgagggaaatgagggaatacccccaccagaaacagactggaaagcctgcctgtctcttggagatccttctttgtcttgttagtggtacatgggaagttatgtttttactggtgtgtgtgtgtgtgtgtgtgtgtgtacttaatgatgggaaggtaagactctgatcaggattatgaactgcggtccttgggaccaaaggtgtggtcatggtagagagttgtaggacaatagggtgttttcagaatctgggtggccacagagtgggatttcctggtatggacatcagaagtcactggactcttctcccaaccccagagttatgggattttggtgctttctcagggtctctccccagactcactcttctcacccatatcccacagactcactcatggagacccccttgtcaatatcccctctacctttactcctttgccctttcccaattcatcttctaccacctggattcttttccattcatgaacttcattcagcccttccaaagcccaagatttgcattcccttgacagggaggaaaggcaatggtaggaacctctggtggtctgggtgtctatgtgcctggtgaccagggctggatttttattactctgagcccactgctagtgaggagccttgaggggtggggacaggttgctgagtgattttgaacgttgacaccagtgtggagccagtgtgggtgtggggagcagtgccttcctcaggtcccagctggtcctgatatgccacgtagtggatggcatctgtcttggtccatgggcttggtgggaacatgcttctgcttgtgtgttttccatacctgagggctgacgtagcttaaaccacagggcatcatgccaaacactcactgctgggcaggtttatttctggggatgtcagggtactggggtgtaggcactaagcaggatagagttagggtgtctggctagtaaggggttctggacgcctctggggctgtgagttttcatctcaaagtctgttccagagaaaggaaagtagtatagaggtgatttttagagaagctgagaccatgaaaacaagcctaatcccatccagaaactggggtaaagtctgaaagttcgttttcttcttcctccctgaataattgttccagaagggatgctaactctgccagagctacaggcagatttttgggctttggaagtggaagctgaggcctggggaaggctgggtaaggaatgctggggcaatctcagacagtaggcaggtgcttggcatgaatgagaagtgactttcctggagtccctcagtagaggatgagatagcagggattaggccacagtctcagatcctgatcttttttcttcctaggaaagcatacataacttgtgtctgcagaatcagtgtgggatgattttgctggcccaaggcttcagcgagagggagaagagaggtcactacagccctcctgtgggtaaaagcagctctcttataaacctgcctccatgcagtggggtgggggtaagggtgggtgacagcaaagaggttgaggaacctccctgggtttggggagtgagagcttccatgttcccttaatgtcctaggttaattcataaggcatctgagtcctgggtctcacccagcctcacagagagaaaaactgtccctgagggtgtcccctcccactcaaaggtagaaagagattgagccaggaactgccctcatatcctctgctctgccccttcccttccctttcctctgcccctcccacctaaagctgtttggggccctttctcagagccctgggtggtggcaggcagggaggagtcccaagatcctggtggccctgagccccatgctatggttgccagatttggcaaataaaaatacaggatgtccagttacatttgaatttcagttcaacaacaaacaattattaagtgtaaatatgtcctaggcaaatagttgggacatatactaaaaaataatttgttgtttatctgaaattcaaatgtaactggtcatcctgcattgtgtctgggaaccctaccctatgacttttccccctctccctttggtcccaaggggccaggaaccccaaggatttgacttaaccagttttttgaactgcaatattgagaaggggacactgtgacttgaagacacatgaattactttattttttaagcaacaacaaaataagaaccttctgaagccatttgagcctcatctgcccccatccgtgtatatttaattatatataaaagaagataattacctagaaacatatgaacagaatcttgtttaatcaagatgcatgtctataactttctgtaaatagccgcatggcaatgctgagagtccccttgatccccaacctcaaacccattttacagaactggttgaggctgctcctttgattttatgtcgtgtaaagtctttgttccccagccccacccctgcctcctcccatcgggaaaccccccatgggagtcatcagtgggcgggagtcggtgcctgctccagtccagccctgccttgggagatgctggaggaccctgtcgccctgaaggcctgtttgctgcacatctgcctgcagagccaaacctcagggcccggtgcagtgtccagcctggtatctggcatcccagtagcttccatgttctgtgtatgtgtgtggtgtgccccttcctcccactgtttgaattcactgaaaagccataaagggggcctcctgctggagatttggcctcccttggctcctcccaggagcccccatgtctctccaactggctccccacagaccacttctgaagggctcacctgttgtcactccctcctgctccctcagtcccgtgtcatgagaatggacggtgtccagggcttccggtggggtctcaggagatgcccatgctggccctgcccgagctggctttctcggcctgggttcacagttcagctccatctctacgctgggcgaggagcagacagcagtgggactccatggttctggatacctttcctggggtccctgtggaggcaaccaggattttcaggagcagccagtcagcagctcagccagggatgacagaaccatccctgcttactcacctctgtagtgtgagggtctgtgggtggtgatggaggagggactcagggagaggccggtgaatacaggggctgacgctcttccctcgtgcatcctcctgcagtctgacagaaagcagcccaatagcggggcaacctcagggctaccagcgatcccctgagagtggggtgggcaggttcagctgtgagagaggctcaggcagagcaggtgtggactaagtcccctgaccttcacacctgctccccagagaagccccagccagttgcaccaagtagcagaggtgagtagaggggcctgggggcttccaaggccccaggtcatcctgttgaactgagagggacaggtagcccccctgcctgcggcccctggccccatgggcacctgagggcagtactgcatgggaagagcccaggatgcctcaggcctggcaactgtgacaagtatgaggaaggagagagaacgggaagggaatcaggcagggcgcattcgaggaggccagaggtggcgaggcaggcttgccctgcacaaaccacaacagaagttgcacacagaagtcccagggacctttgtgctgggaactgaaagagtggggaaggtggaggggaccatttcagagcaggctggaatcaggtgcttggaccagtgaagacatgtcttgcttcctccagctctctctggggccctcccactctccacacccacagcagagacaaattgaggcaagagttgagagagcatctgtctggtgaggtgatgggagcagtgtgcatggggcaccaggagttcctccatcccacctgccttagcgatcaggactttaggggggcctcttcaaagatagtgacccttctgccctgactcctgcccatctaaggacttgatttgctgctttctgaaaaccctggggctgaaaacttcaaaatcagggcctggcagagcctagcttcgccaaggtcagcccaccaggagccctgccttcgtctccataggaaggacacatgtacagcccttgcccccggccctctcattcccacttctgcttggcaatgctctccatctcccttatgtggactcttgttcttgtctgatctcttgtcaaattgttattttgtaatgaactgcgtctccttattaaagaaatgagctgaaagaaa

SEQ ID NO: 21132 - DNA, 7598 bp, Homo sapiens
  ENST00000367268
acttcggagccgagttggggcagcggtggagcggggacttcgcgcccccaggggaacgggcgcccctgcgaaaccgtcgccagccacgcgtccttgccgtccgacgccccctcacattggagaccccggatctctcccgcctccttcgggtcgctctccgctgtttcctctgccaccatgaggaacattttcaagaggaaccaggagcctattgtggctcctgccaccaccaccgccacgatgcccattggacccgtggacaactccactgagagtgggggtgctggggagagccaggaggacatgtttgccaaactgaaggagaagttattcaatgagataaacaagattcccttaccaccctgggcactgatcgccattgctgtggttgctgggctcctgcttctcacctgctgcttctgcatctgcaagaaatgctgctgcaagaagaagaagaacaagaaggagaagggcaaaggcatgaagaatgccatgaacatgaaggacatgaaagggggtcaggatgacgacgacgcagagacaggcctgactgagggggaaggtgaaggggaggaggagaaagagccagagaacctgggcaaactgcagttttccctggactatgattttcaggctaatcagcttactgtgggcgttctgcaggctgctgaactgcctgccctggacatgggaggcacctcagacccttatgtcaaggtcttcctccttcctgacaagaagaagaaatatgagaccaaagtccatcggaagacactgaaccctgccttcaatgaaaccttcaccttcaaggtgccataccaggagcttgggggcaaaactctggtgatggccatctatgactttgaccgcttctccaaacatgacatcattggagaggtaaaggtgcctatgaacacagtggacctcggccagcccattgaggagtggagagacctgcaaggcggggaaaaggaggagccggagaagctgggcgacatctgcacctccctgcgctatgtgcccacggccgggaagctcactgtctgcatcctggaggctaagaacctcaagaagatggacgtgggcggcctttcagacccgtacgtgaagatccacctgatgcagaatggcaagaggctcaagaagaagaagacaaccgtgaagaagaagaccctgaacccatacttcaacgagtccttcagctttgagatccccttcgagcagattcagaaagtccaggtagtggtcaccgtgctggactatgacaagctgggcaagaacgaagccataggcaagatcttcgtgggcagcaatgccacgggcacagagctgcggcactggtccgacatgctggccaacccccggaggcccatcgcccagtggcactcgctcaagcctgaggaggaggtggatgcactcctgggcaagaacaagtagacagcagcggctgggaccccacacctttcacggacactgacaagatccagagctatcaatacctcagttatgcaaccttagaggttttcttttttctttcatttgttgggtggttgtgtccttgtttttccttgtttttctctttttaaagaccaacttccctttgatggctgtgtgaggagagtcccctaagaggtgaaagagaagcctggctctgttcacggtcccaggagctgtccttgctgcatgccctgtcacagttccctcgactctttcaaagcttcacatctgcctcaccccaagcgaggctctctactggcacaaacttgcagcagttcctgttttttgagccttctggaccaacaaaatggcagcacatcctgcttcctgacagggaaggcatcacagtggccaatgatcgtgtgtgtgtgtgtgtgtgtgtgtgtgtatgtgtgtgtgtgtgtgtgtgtgtgtgtgtgtgtgtgtgtctttgagcatttctcttcattcctggaatgtgtgtgtgtgtgtgtctctttgagcatctctcttcattcctggaatgagccatggacagtaaagttgtgtgggaaaagaaggctctttggggaccctgacatgaagaagtccactaagtgggagatcttctctcatctatggcaaagtctcaggatcctgttcagatatcggggctttcatactcctgttggtggctatttgggaggcagcaagatgtgaagactggatgtgttcagaactaggaccaaacgatgccatcaaatacttcctcctgccagtcatggtttccccagaagtgtagttcctgggacattcatggatatgagctattcactagttgggtcagactaacagggactctcagtcccaaaatctcactcttattgacaataaatatcaaactatgaagaaacagaagtcccattaccagaaagaccaaaattaaactcctggatcttcaccccatccagtgggaaacacagatgctttctccctttccagaatataagcagccaagttcatttgcatttattccccattgtgcttttgcttctgtttctcttttaagtggagcaacactgtctgaagacacgttatctgtgcagagccagagaactttaaaaggaaagtttaaatgttcttagttctcctgaggtccaggtaagaagggggtggtaagaagaggatgggggacagatggctgagatcccttgggaggagatataggggagcactggaattcccccgactcccactccttgctcccttggccctctgccctccatgctggagagctgataggtagctggagtggcccagggagacctatgggaaggacccgtcctaccattagggggcttctctctatgaatgctaagaaacaaagggcatccattccaaatgagtagcagaggtgaccttctagggtttctacccatgctcagttgtatcccattccctgttcaccttttgtccccagcactgatataaaagccatatatatgttagtcaggtttgcactgagtcttcttccaatccttcagcctggacaacagagtgaggtccccttgtggccagaggccagccctccttgcctgccttcctttgacctctcttttccatccatgaagccctcaggcccttgccattttttcaccacagaaaactcatggcttctccagaagcctgagtatctctctttcccagcacaaatggcagcatctctatcctgccccatctgggccacttcagcttcctgtagacacccaagacagatggacagtgttggagggaatcaggctttgaggatccagtgtgaagaagttgcagagtgtctttttattttattttaaaaagggggaaggggcttttggttttgctttgttttttggatgaaggagtgagggaaatgagggaatacccccaccagaaacagactggaaagcctgcctgtctcttggagatccttctttgtcttgttagtggtacatgggaagttatgtttttactggtgtgtgtgtgtgtgtgtgtgtgtgtacttaatgatgggaaggtaagactctgatcaggattatgaactgcggtccttgggaccaaaggtgtggtcatggtagagagttgtaggacaatagggtgttttcagaatctgggtggccacagagtgggatttcctggtatggacatcagaagtcactggactcttctcccaaccccagagttatgggattttggtgctttctcagggtctctccccagactcactcttctcacccatatcccacagactcactcatggagacccccttgtcaatatcccctctacctttactcctttgccctttcccaattcatcttctaccacctggattcttttccattcatgaacttcattcagcccttccaaagcccaagatttgcattcccttgacagggaggaaaggcaatggtaggaacctctggtggtctgggtgtctatgtgcctggtgaccagggctggatttttattactctgagcccactgctagtgaggagccttgaggggtggggacaggttgctgagtgattttgaacgttgacaccagtgtggagccagtgtgggtgtggggagcagtgccttcctcaggtcccagctggtcctgatatgccacgtagtggatggcatctgtcttggtccatgggcttggtgggaacatgcttctgcttgtgtgttttccatacctgagggctgacgtagcttaaaccacagggcatcatgccaaacactcactgctgggcaggtttatttctggggatgtcagggtactggggtgtaggcactaagcaggatagagttagggtgtctggctagtaaggggttctggacgcctctggggctgtgagttttcatctcaaagtctgttccagagaaaggaaagtagtatagaggtgatttttagagaagctgagaccatgaaaacaagcctaatcccatccagaaactggggtaaagtctgaaagttcgttttcttcttcctccctgaataattgttccagaagggatgctaactctgccagagctacaggcagatttttgggctttggaagtggaagctgaggcctggggaaggctgggtaaggaatgctggggcaatctcagacagtaggcaggtgcttggcatgaatgagaagtgactttcctggagtccctcagtagaggatgagatagcagggattaggccacagtctcagatcctgatcttttttcttcctaggaaagcatacataacttgtgtctgcagaatcagtgtgggatgattttgctggcccaaggcttcagcgagagggagaagagaggtcactacagccctcctgtgggtaaaagcagctctcttataaacctgcctccatgcagtggggtgggggtaagggtgggtgacagcaaagaggttgaggaacctccctgggtttggggagtgagagcttccatgttcccttaatgtcctaggttaattcataaggcatctgagtcctgggtctcacccagcctcacagagagaaaaactgtccctgagggtgtcccctcccactcaaaggtagaaagagattgagccaggaactgccctcatatcctctgctctgccccttcccttccctttcctctgcccctcccacctaaagctgtttggggccctttctcagagccctgggtggtggcaggcagggaggagtcccaagatcctggtggccctgagccccatgctatggttgccagatttggcaaataaaaatacaggatgtccagttacatttgaatttcagttcaacaacaaacaattattaagtgtaaatatgtcctaggcaaatagttgggacatatactaaaaaataatttgttgtttatctgaaattcaaatgtaactggtcatcctgcattgtgtctgggaaccctaccctatgacttttccccctctccctttggtcccaaggggccaggaaccccaaggatttgacttaaccagttttttgaactgcaatattgagaaggggacactgtgacttgaagacacatgaattactttattttttaagcaacaacaaaataagaaccttctgaagccatttgagcctcatctgcccccatccgtgtatatttaattatatataaaagaagataattacctagaaacatatgaacagaatcttgtttaatcaagatgcatgtctataactttctgtaaatagccgcatggcaatgctgagagtccccttgatccccaacctcaaacccattttacagaactggttgaggctgctcctttgattttatgtcgtgtaaagtctttgttccccagccccacccctgcctcctcccatcgggaaaccccccatgggagtcatcagtgggcgggagtcggtgcctgctccagtccagccctgccttgggagatgctggaggaccctgtcgccctgaaggcctgtttgctgcacatctgcctgcagagccaaacctcagggcccggtgcagtgtccagcctggtatctggcatcccagtagcttccatgttctgtgtatgtgtgtggtgtgccccttcctcccactgtttgaattcactgaaaagccataaagggggcctcctgctggagatttggcctcccttggctcctcccaggagcccccatgtctctccaactggctccccacagaccacttctgaagggctcacctgttgtcactccctcctgctccctcagtcccgtgtcatgagaatggacggtgtccagggcttccggtggggtctcaggagatgcccatgctggccctgcccgagctggctttctcggcctgggttcacagttcagctccatctctacgctgggcgaggagcagacagcagtgggactccatggttctggatacctttcctggggtccctgtggaggcaaccaggattttcaggagcagccagtcagcagctcagccagggatgacagaaccatccctgcttactcacctctgtagtgtgagggtctgtgggtggtgatggaggagggactcagggagaggccggtgaatacaggggctgacgctcttccctcgtgcatcctcctgcagtctgacagaaagcagcccaatagcggggcaacctcagggctaccagcgatcccctgagagtggggtgggcaggttcagctgtgagagaggctcaggcagagcaggtgtggactaagtcccctgaccttcacacctgctccccagagaagccccagccagttgcaccaagtagcagaggtgagtagaggggcctgggggcttccaaggccccaggtcatcctgttgaactgagagggacaggtagcccccctgcctgcggcccctggccccatgggcacctgagggcagtactgcatgggaagagcccaggatgcctcaggcctggcaactgtgacaagtatgaggaaggagagagaacgggaagggaatcaggcagggcgcattcgaggaggccagaggtggcgaggcaggcttgccctgcacaaaccacaacagaagttgcacacagaagtcccagggacctttgtgctgggaactgaaagagtggggaaggtggaggggaccatttcagagcaggctggaatcaggtgcttggaccagtgaagacatgtcttgcttcctccagctctctctggggccctcccactctccacacccacagcagagacaaattgaggcaagagttgagagagcatctgtctggtgaggtgatgggagcagtgtgcatggggcaccaggagttcctccatcccacctgccttagcgatcaggactttaggggggcctcttcaaagatagtgacccttctgccctgactcctgcccatctaaggacttgatttgctgctttctgaaaaccctggggctgaaaacttcaaaatcagggcctggcagagcctagcttcgccaaggtcagcccaccaggagccctgccttcgtctccataggaaggacacatgtacagcccttgcccccggccctctcattcccacttctgcttggcaatgctctccatctcccttatgtggactcttgttcttgtctgatctcttgtcaaattgttattttgtaatgaactgcgtctccttattaaagaaatgagctgaaagaaa

SEQ ID NO: 21133 - DNA, 567 bp, Homo sapiens
  ENST00000595557
gggcacaacgaggtgatcggcgtgtgccgtgtgggccccgacgctgccgacccgcacggccgcgagcactgggcagagatgctggccaatccccgcaagcccgtggagcactggcatcagctagtggaggtgagtaggggtcccacaccgacccctgacaagcacccgtgcaccctcggccccttcatccatgcaacgaacgccctgcatgttcgtgagtcgcagagccaggcgtcctaggtttcaatccctgctgtgccaactttagctgtgcggcttagagccagttacccaagcgctctgtgcctcaatttacccactaggaaatgggactgttgatagcatcttctgttaggatagaggtgagatgtgctgagttaaacgttctgtaggtggtcgctgctgttgttacccatgaggctaagttgaaaatagagggggctgggcgtgagccaccgcgcctggctattggcttctctctcgggtaggtgtttgcagtggcaatgagatggtcacttggagctccaggtgtataatgctgtatctgttatgataccttcggctgaa

SEQ ID NO: 21134 - DNA, 2915 bp, Homo sapiens
  ENST00000338916
actctatgtctcctctcgttggattgtgacaccgggaggtcagggaactccaggaccttgttctctgctggattcgcagcaaccagcacagcacgtagggcgtagttggtgctggatggatgtttgttgaatgaatgaatgatgaatggctggcaccttgtctgctcatccctaactcctgttccttcatctgtgcagccctaatctttgtttcctcatctgtccatccctttatttgtgcatcctcattcttagccccttcactgcccttctccatctcttcctccttgttcatttgtccctgttctctgtcctctactccactcatgcccatctctgtccccttgacttacccagtccctgctactatctccatccctaatttctgccctcttgtctgtctactcctaattccttttccttgtccatccctaatacctgtcaccttgtccttcttcctcgaatctccatccctaatccatctgcccctaatctctgtcccctttgcccatccttccttttctcggtgtctctttccacccttatctccacacctgcccaccctgcactcccattctgtttcccatctgcacccttgccccatccctcccacacacaggaccagacggccaccatgtcaggagactacgaggatgacctctgccggcgggcactcatcctggtctcggacctctgtgcgcgggtccgagatgctgacaccaacgacaggtgccaggagttcaatgaccgaatccgaggctatccccggggtccagatgcagacatctccgtgagcctgctgtcggtcatcgtgacattctgtggcattgtccttctgggtgtctctctcttcgtgtcctggaagttgtgctgggtgccctggcgggacaagggaggctcggcagtgggcggtggccccctgcgcaaagacctaggccctggtgtcgggctggcaggcctggtaggcggaggcgggcaccacctggcggctggcctgggtggccatcctctgctgggcggcccacaccaccatgcccatgccgcccaccatccaccctttgctgagctgctggagccaggcagcctggggggttctgacacccctgagccctcctacttggacatggactcgtatccagaggctgcagcagcagcagtggccgctggggtcaaaccgagccaaacatcccctgagctgccctctgaggggggagcaggctctgggttgctcctgctgccccccagtggtgggggcttgcccagtgcccagtcacatcagcaggtcacaagcctggcacccactaccaggtacccagccctgccccgacccctcacccagcagactctgacctcccagccggaccccagcagtgaggagcggccacctgccctgcccttacccctgcctggaggcgaggaaaaagccaaactcattgggcagattaagccagagctgtaccaggggactggccctggtggccggcggagcggtgggggcccaggctctggagaggcaggcacaggggcaccctgtggccgtatcagcttcgccctgcggtacctctatggctcggaccagctggtggtgaggatcctgcaggccctggacctccctgccaaggactccaacggcttctcagacccctacgtcaagatctacctgctgcctgaccgcaagaaaaagtttcagaccaaggtgcacaggaagaccctgaaccccgtcttcaatgagacgtttcaattctcggtgcccctggccgagctggcccaacgcaaactgcacttcagcgtctatgactttgaccgcttctcgcggcacgacctcatcggccaggtggtgctggacaacctcctggagctggccgagcagccccctgaccgcccgctctggagggacatcgtggagggcggctcggaaaaagcagatcttggggagctcaacttctcactctgctacctccccacggccgggcgcctcaccgtgaccatcatcaaagcctctaacctcaaagcgatggacctcactggcttctcagacccctacgtgaaggcctccctgatcagcgaggggcggcgtctgaagaagcggaaaacctccatcaagaagaacacgctgaaccccacctataatgaggcgctggtgttcgacgtggcccccgagagcgtggagaacgtggggctcagcatcgccgtggtagactacgactgcatcgggcacaacgaggtgatcggcgtgtgccgtgtgggccccgacgctgccgacccgcacggccgcgagcactgggcagagatgctggccaatccccgcaagcccgtggagcactggcatcagctagtggaggaaaagactgtgaccagcttcacaaaaggcagcaaaggactatcagagaaagagaactccgagtgaggggtctggcctaggcccgggatcggaccaggctccctcaggaccccatcctttcctgcccggaccgtgaattcatctccttgaagccataacgtccgagctgctggtgcggggcagccctggccctaggcttcctaaccctggaagcgagaggatgagaggaggccggcccagctccttctttcagggtgggggtcattcagcctccactgtgtctgtcttttcttccctggggctccccctcgaggcgaggggccatgcatgtctgggggacccctgccccccaaaaccctctgtctgtctctgtctctttgctgtttgtccaagactcagtgtcccgacccttgttctcgccgtgaatgtcaatgggccaatcctctctgtcctttcagacacacacacacctgtgtccaccccttctgttcgccacacccctgcgtctggccggtccccccactgctgctgctatcaacgccagaataaacacactctgtgggtctcactccaa

SEQ ID NO: 21135 - DNA, 2463 bp, Homo sapiens
  ENST00000600079
ggcggcagcggcggcagcggcggctccggcccctagatcagacattctctctcattacccggcgcgtgggaacgggtccacagccccttgtccgccctagaacccccatgggctgccgcccgccgccgcctcggctgccacccaggacacggcagagataagcgcaggaccagacggccaccatgtcaggagactacgaggatgacctctgccggcgggcactcatcctggtctcggacctctgtgcgcgggtccgagatgctgacaccaacgacaggtgccaggagttcaatgaccgaatccgaggctatccccggggtccagatgcagacatctccgtgagcctgctgtcggtcatcgtgacattctgtggcattgtccttctgggtgtctctctcttcgtgtcctggaagttgtgctgggtgccctggcgggacaagggaggctcggcagtgggcggtggccccctgcgcaaagacctaggccctggtgtcgggctggcaggcctggtaggcggaggcgggcaccacctggcggctggcctgggtggccatcctctgctgggcggcccacaccaccatgcccatgccgcccaccatccaccctttgctgagctgctggagccaggcagcctggggggttctgacacccctgagccctcctacttggacatggactcgtatccagaggctgcagcagcagcagtggccgctggggtcaaaccgagccaaacatcccctgagctgccctctgaggggggagcaggctctgggttgctcctgctgccccccagtggtgggggcttgcccagtgcccagtcacatcagcaggtcacaagcctggcacccactaccaggtacccagccctgccccgacccctcacccagcagactctgacctcccagccggaccccagcagtgaggagcggccacctgccctgcccttacccctgcctggaggcgaggaaaaagccaaactcattgggcagattaagccagagctgtaccaggggactggccctggtggccggcggagcggtgggggcccaggctctggagaggcaggcacaggggcaccctgtggccgtatcagcttcgccctgcggtacctctatggctcggaccagctggtggtgaggatcctgcaggccctggacctccctgccaaggactccaacggcttctcagacccctacgtcaagatctacctgctgcctgaccgcaagaaaaagtttcagaccaaggtgcacaggaagaccctgaaccccgtcttcaatgagacgtttcaattctcggtgcccctggccgagctggcccaacgcaaactgcacttcagcgtctatgactttgaccgcttctcgcggcacgacctcatcggccaggtggtgctggacaacctcctggagctggccgagcagccccctgaccgcccgctctggagggacatcgtggagggcggctcggaaaaagcagatcttggggagctcaacttctcactctgctacctccccacggccgggcgcctcaccgtgaccatcatcaaagcctctaacctcaaagcgatggacctcactggcttctcagacccctacgtgaaggcctccctgatcagcgaggggcggcgtctgaagaagcggaaaacctccatcaagaagaacacgctgaaccccacctataatgaggcgctggtgttcgacgtggcccccgagagcgtggagaacgtggggctcagcatcgccgtggtagactacgactgcatcgggcacaacgaggtgatcggcgtgtgccgtgtgggccccgacgctgccgacccgcacggccgcgagcactgggcagagatgctggccaatccccgcaagcccgtggagcactggcatcagctagtggaggaaaagactgtgaccagcttcacaaaaggcagcaaaggactatcagagaaagagaactccgagtgaggggtctggcctaggcccgggatcggaccaggctccctcaggaccccatcctttcctgcccggaccgtgaattcatctccttgaagccataacgtccgagctgctggtgcggggcagccctggccctaggcttcctaaccctggaagcgagaggatgagaggaggccggcccagctccttctttcagggtgggggtcattcagcctccactgtgtctgtcttttcttccctggggctccccctcgaggcgaggggccatgcatgtctgggggacccctgccccccaaaaccctctgtctgtctctgtctctttgctgtttgtccaagactcagtgtcccgacccttgttctcgccgtgaatgtcaatgggccaatcctctctgtcctttcagacacacacacacctgtgtccaccccttctgttcgccacacccctgcgtctggccggtccccccactgctgctgctatcaacgccagaataaacacactctgtgggtctcactccaa

SEQ ID NO: 21136 - DNA, 2836 bp, Homo sapiens
  ENST00000593901
ggcggcggcggcggcagcggcggcagcggcggctccggcccctagatcagacattctctctcattacccggcgcgtgggaacgggtccacagccccttgtccgccctagaacccccatgggctgccgcccgccgccgcctcggctgccacccaggacacggcagagataagcgcagccccttcactgcccttctccatctcttcctccttgttcatttgtccctgttctctgtcctctactccactcatgcccatctctgtccccttgacttacccagtccctgctactatctccatccctaatttctgccctcttgtctgtctactcctaattccttttccttgtccatccctaatacctgtcaccttgtccttcttcctcgaatctccatccctaatccatctgcccctaatctctgtcccctttgcccatccttccttttctcggtgtctctttccacccttatctccacacctgcccaccctgcactcccattctgtttcccatctgcacccttgccccatccctcccacacacaggaccagacggccaccatgtcaggagactacgaggatgacctctgccggcgggcactcatcctggtctcggacctctgtgcgcgggtccgagatgctgacaccaacgacaggtgccaggagttcaatgaccgaatccgaggctatccccggggtccagatgcagacatctccgtgagcctgctgtcggtcatcgtgacattctgtggcattgtccttctgggtgtctctctcttcgtgtcctggaagttgtgctgggtgccctggcgggacaagggaggctcggcagtgggcggtggccccctgcgcaaagacctaggccctggtgtcgggctggcaggcctggtaggcggaggcgggcaccacctggcggctggcctgggtggccatcctctgctgggcggcccacaccaccatgcccatgccgcccaccatccaccctttgctgagctgctggagccaggcagcctggggggttctgacacccctgagccctcctacttggacatggactcgtatccagaggctgcagcagcagcagtggccgctggggtcaaaccgagccaaacatcccctgagctgccctctgaggggggagcaggctctgggttgctcctgctgccccccagtggtgggggcttgcccagtgcccagtcacatcagcaggtcacaagcctggcacccactaccaggtacccagccctgccccgacccctcacccagcagactctgacctcccagccggaccccagcagtgaggagcggccacctgccctgcccttacccctgcctggaggcgaggaaaaagccaaactcattgggcagattaagccagagctgtaccaggggactggccctggtggccggcggagcggtgggggcccaggctctggagaggcaggcacaggggcaccctgtggccgtatcagcttcgccctgcggtacctctatggctcggaccagctggtggtgaggatcctgcaggccctggacctccctgccaaggactccaacggcttctcagacccctacgtcaagatctacctgctgcctgaccgcaagaaaaagtttcagaccaaggtgcacaggaagaccctgaaccccgtcttcaatgagacgtttcaattctcggtgcccctggccgagctggcccaacgcaaactgcacttcagcgtctatgactttgaccgcttctcgcggcacgacctcatcggccaggtggtgctggacaacctcctggagctggccgagcagccccctgaccgcccgctctggagggacatcgtggagggcggctcggaaaaagcagatcttggggagctcaacttctcactctgctacctccccacggccgggcgcctcaccgtgaccatcatcaaagcctctaacctcaaagcgatggacctcactggcttctcagacccctacgtgaaggcctccctgatcagcgaggggcggcgtctgaagaagcggaaaacctccatcaagaagaacacgctgaaccccacctataatgaggcgctggtgttcgacgtggcccccgagagcgtggagaacgtggggctcagcatcgccgtggtagactacgactgcatcgggcacaacgaggtgatcggcgtgtgccgtgtgggccccgacgctgccgacccgcacggccgcgagcactgggcagagatgctggccaatccccgcaagcccgtggagcactggcatcagctagtggaggaaaagactgtgaccagcttcacaaaaggcagcaaaggactatcagagaaagagaactccgagtgaggggtctggcctaggcccgggatcggaccaggctccctcaggaccccatcctttcctgcccggaccgtgaattcatctccttgaagccataacgtccgagctgctggtgcggggcagccctggccctaggcttcctaaccctggaagcgagaggatgagaggaggccggcccagctccttctttcagggtgggggtcattcagcctccactgtgtctgtcttttcttccctggggctccccctcgaggcgaggggccatgcatgtctgggggacccctgccccccaaaaccctctgtctgtctctgtctctttgctgtttgtccaagactcagtgtcccgacccttgttctcgccgtgaatgtcaatgggccaatcctctctgtcctttcagacacacacacacctgtgtccaccccttctgttcgccacacccctgcgtctggccggtccccccactgctgctgctatcaacgccagaataaacacactctgtgggtctcactccaa

SEQ ID NO: 21137 - DNA, 674 bp, Homo sapiens
  ENST00000595117
ggaagcctgagccctggatgtcagggtgtaaagcaggaggctccgaccggagagaaaatcagggagagttgaagaggggctgaggcaagatatcgctgaccttttccccaactgcaggaaaaagcagatcttggggagctcaacttctcactctgctacctccccacggccgggcgcctcaccgtgaccatcatcaaagcctctaacctcaaagcgatggacctcactggcttctcagacccctacgtgaaggcctccctgatcagcgaggggcggcgtctgaagaagcggaaaacctccatcaagaagaacacgctgaaccccacctataatgaggcgctggtgttcgacgtggcccccgagagcgtggagaacgtggggctcagcatcgccgtggtagactacgactgcatcgggcacaacgaggtgatcggcgtgtgccgtgtgggccccgacgctgccgacccgcacggccgcgagcactgggcagagatgctggccaatccccgcaagcccgtggagcactggcatcagctagtggaggaaaagactgtgaccagcttcacaaaaggcagcaaaggactatcagagaaagagaactccgagtgaggggtctggcctaggcccgggatcggaccaggctccctcaggaccccatcctttcctgcccggac

SEQ ID NO: 21138 - DNA, 586 bp, Homo sapiens
  ENST00000598997
gtagtctctaagccctcaacgggagctgggggcccggaggtgggagggggtggccgggctcccagtgggtcgcctggggtcgggcagctggctcgagtagggcaagatgtgactgttaagctgagctttttctcccggcctcagcccctagatcagacattctctctcattacccggcgcgtgggaacgggtccacagccccttgtccgccctagaacccccatgggctgccgcccgccgccgcctcggctgccacccaggacacggcagagataagcgcaggaccagacggccaccatgtcaggagactacgaggatgacctctgccggcgggcactcatcctggtctcggacctctgtgcgcgggtccgagatgctgacaccaacgacaggtgccaggagttcaatgaccgaatccgaggctatccccggggtccagatgcagacatctccgtgagcctgctgtcggtcatcgtgacattctgtggcattgtccttctgggtgtctctctcttcgtgtcctggaagttgtgctgggtgccctggcgggacaagggaggctcggcagtgggcggtggccccctgc

SEQ ID NO: 21139 - DNA, 4110 bp, Homo sapiens
  ENST00000255224
gatgagcatgtgttgaatcctcaagagaggagggaggaagcaagaaggaaagcttgaagggaggaggggaggggggcaggtgctgatttcagccctgtagcgtcaggattgcgtcaattcgggttccagccacgtctggagtctcggagacgagcttctcagaagagccaaaacaggaaccgaggtggcaaatcactgtgcgagggcgagtggacctccctctttgcctcctccctgttccaggagctggtgccctgggctctgcgctgttgttttcagcgctccgaaagccggcgcttgagatccaggcaagtgaatccagccaggcagttttcccttcagcacctcggacagaacacgcagtaaaaaatggctccgatcaccaccagccgggaagaatttgatgaaatccccacagtggtggggatcttcagtgcatttggcctggtcttcacagtctctctctttgcatggatctgctgtcagagaaaatcatccaagtctaacaagactcctccatacaagtttgtgcatgtgcttaagggagttgatatttaccctgaaaacctaaatagcaaaaagaagtttggagcagatgataaaaatgaagtaaagaataagccagctgtgccaaagaattcattgcatctggatcttgaaaagagagatctcaatggcaattttcccaaaaccaacctcaaacctggcagtccttctgatctggagaatgcaaccccgaagctctttttagaaggggaaaaagagtcagtttcccctgagagtttaaagtccagcacttcccttacttcagaagagaaacaagagaagctgggaactctcttcttctccttagaatacaacttcgagagaaaagcatttgtggtcaatatcaaggaagcccgtggcttgccagccatggatgagcagtcgatgacctctgacccatatatcaaaatgacgatcctcccagagaagaagcataaagtgaaaactagagtgctgagaaaaaccttggatccagcttttgatgagacctttacattctatgggataccctacacccaaatccaagaattggccttgcacttcacaattttgagttttgacaggttttcaagagatgatatcattggggaagttctaattcctctctcgggaattgaattatctgaaggaaaaatgttaatgaatagagagatcatcaagagaaatgttaggaagtcttcaggacggggtgagttactgatctctctctgctatcagtccaccacaaacactctaactgtggttgtcttaaaagctcgacatctgcctaaatctgatgtgtccggactttcagatccctatgtcaaagtgaacctgtaccatgccaaaaagagaatctccaagaagaagactcatgtgaagaaatgcacccccaatgcagtgttcaatgagctgtttgtctttgatattccttgtgagggccttgaagatataagtgttgaatttttggttttggattctgaaagggggtcccgaaatgaggtaatcgggcagttagtcttgggtgcagcagcagaaggaactggtggagagcactggaaagagatctgtgactaccccaggagacaaattgccaagtggcacgtgctctgtgatggttagcatcctagccgtgagttggaacttaaaggtttttactaggcaaggagaaattttctttctttctatattggattgcaagcttgggaaatcaagctacctttttgttgttgttgttgttgctagaaatggattgaattagtagaccagaaagtaacttcaaatgtgtattatgataatttccctatttattagaagagttggataaattttcataagatattcaatatctccttcagattaccagtgatataactaggaatagtcagacattttatgaatactgtgccagaatcccaaattataaatgtgacaatctcattggaacatgtcacaaaaagttaatgtgattaagatttaaaaacgaaaagtatgccttgccttgtgaaaatttatccatttatcttcaggttggggaaatcaatttttctttaaatccaaagatactaaaaaaatgtcctccagtttgtatttattaattctgtcatgtgcaaatggttgtcctgcatataaaagtatctggtcatttcagtttggtttgtaattatttgatgcaattttatcataagagtaactcagattcatttcaaaaggacagtgaacaagctgagaaattattttatcaaagggctgagttgagaacactgtggctgaaatataatttttctcccccctaaggttacatgtgagtcaaaattttgtaaaatataacctcacataagaaccatggccttggattattcactgcctgtcacaagcctcagtgtggcctgagaaatccctatgtacctttgtgaaattgttgaattagttagtgaataaagaaataaacttcaactagaaatccagttagaagtgcaattttcttataggaaataggtatagtgtgcaagtgtacttttaaggccatcgtttgtacccagagtcggcatggccacctaagtcttcatttaatttattgtcccccagaaaagattaagatgctacttgaaaagactgtgaagattttttacattgccagataaaaagtgttacttaaccaacaaacaaatgtaagactacaaaatcgttcaagagcaattctaatataatttacatatgttcacgcaaaatatgcttaggctgtcaaattagcacaacaaagaatgtgtttcactatcttttctaggctaatttgtcttgagctgttgtctatagagcagtttacagacttgtgtcttgtatcattttccagtgccagggttctgaaattcattcagaacctgttagattaaagctgcaccctgtgattatttgaaaagaattagcttgagagtaatgtcactatatttgagttcttagagaagtatgagtggaacttgagtacagttgaattattaaatatgcaagttagaaattaagtctactgaaaaatttacattttgagtcaggttttgtgtcagtactttagcagtttttgagaatgtgtttgatatcacagtgtttgtaaattctatgaaaaatgcattttccaaacaacttatacatgctttttatgactatgcctaatgtaaagaaaatgtattacattctgtatgtacaaagattaaaaatcaacctcttttttgtgctttaaaatgactttgggattaaaaaagcatatttcccaatcattgtcttcattccactacaaagtcacctcacagcatcttgctccactcggcatctctgtgaaagcaacatgaaatgaactgtagtaggtgtgtagtttggggaagtcaaatggccattttatgtatgtgcatttggtatcatgggccgtggaacagaatatatgttggacctctgaaaagttgtaaggggccaattctaagtattcttcacggcagccagaagttaatggtggtagcagctgaggtatggttgttggacgaggccgatttttttttttttaacatggaacaatgaaaccaacaacaaacatttttaaaattaaaatggataatttgtaaatagtttttagcttttaaaatttaaagtgtttttgagtgtgaaaagttgagtaaaactatttgcaactggttttcagaaaagagaaaagaaacaacaaaggaattgaaacaggcagggagatcttaatacctaatttcatcatttctgaaaatgtactgttttagaatgtattacaatatcaatgtgaatatcttgaatcctgttacaaatcctgcactgtattaaacatgtaaattaattgtttgtctgattagccaatctcaccacccaaatggggaggtatacatgtttgaagaactgtgtaactcagtaattgatttgttctgatgttgtaactcaatagaagtgttttggaaggaagcatggtgtgtgagacagtgtctgttcttttgtgccagctctgtatgatgtttgtaagaccatgtttgtaagacatgaataaattgctgcttttgcccaacccgtttcaatgca

SEQ ID NO: 21140 - DNA, 1142 bp, Homo sapiens
  ENST00000586678
aattcgggttccagccacgtctggagtctcggagacgagcttctcagaagagccaaaacaggaaccgaggtggcaaatcactgtgcgagggcgagtggacctccctctttgcctcctccctgttccaggagctggtgccctgggctctgcgctgttgttttcagcgctccgaaagccggcgcttgagatccaggcaagtgaatccagccaggcagttttcccttcagcacctcggacagaacacgcatgttcaatgagctgtttgtctttgatattccttgtgagggccttgaagatataagtgttgaatttttggttttggattctgaaagggggtcccgaaatgaggtaatcgggcagttagtcttgggtgcagcagcagaaggaactggtggagagcactggaaagagatctgtgactaccccaggagacaaattgccaagtggcacgtgctctgtgatggttagcatcctagccgtgagttggaacttaaaggtttttactaggcaaggagaaattttctttctttctatattggattgcaagcttgggaaatcaagctacctttttgttgttgttgttgttgctagaaatggattgaattagtagaccagaaagtaacttcaaatgtgtattatgataatttccctatttattagaagagttggataaattttcataagatattcaatatctccttcagattaccagtgatataactaggaatagtcagacattttatgaatactgtgccagaatcccaaattataaatgtgacaatctcattggaacatgtcacaaaaagttaatgtgattaagatttaaaaacgaaaagtatgccttgccttgtgaaaatttatccatttatcttcaggttggggaaatcaatttttctttaaatccaaagatactaaaaaaatgtcctccagtttgtatttattaattctgtcatgtgcaaatggttgtcctgcatataaaagtatctggtcatttcagtttggtttgtaattatttgatgcaattttatcataagagtaactcagattcatttcaaaaggacagtgaacaagctgagaaattattttatcaaagggctgagttgagaacactgtggctgaaatataatttttctcccccctaa

SEQ ID NO: 21141 - DNA, 1765 bp, Homo sapiens
  ENST00000590752
agaagagccaaaacaggaaccgaggtggcaaatcactgtgcgagggcgagtggacctccctctttgcctcctccctgttccaggagctggtgccctgggctctgcgctgttgttttcagcgctccgaaagccggcgcttgagatccaggcaagtgaatccagccaggcagttttcccttcagcacctcggacagaacacgcagtaaaaaatggctccgatcaccaccagccgggaagaatttgtctctctctttgcatggatctgctgtcagagaaaatcatccaagtctaacaagactcctccatacaagtttgtgcatgtgcttaagggagttgatatttaccctgaaaacctaaatagcaaaaagaagtttggagcagatgataaaaatgaagtaaagaataagccagctgtgccaaagaattcattgcatctggatcttgaaaagagagatctcaatggcaattttcccaaaaccaacctcaaacctggcagtccttctgatctggagaatgcaaccccgaagctctttttagaaggggaaaaagagtcagtttcccctgagagtttaaagtccagcacttcccttacttcagaagagaaacaagagaagctgggaactctcttcttctccttagaatacaacttcgagagaaaagcatttgtggtcaatatcaaggaagcccgtggcttgccagccatggatgagcagtcgatgacctctgacccatatatcaaaatgacgatcctcccagagaagaagcataaagtgaaaactagagtgctgagaaaaaccttggatccagcttttgatgagacctttacattctatgggataccctacacccaaatccaagaattggccttgcacttcacaattttgagttttgacaggttttcaagagatgatatcattggggaagttctaattcctctctcgggaattgaattatctgaaggaaaaatgttaatgaatagagagatcatcaagagaaatgttaggaagtcttcaggacggggtgagttactgatctctctctgctatcagtccaccacaaacactctaactgtggttgtcttaaaagctcgacatctgcctaaatctgatgtgtccggactttcagatccctatgtcaaagtgaacctgtaccatgccaaaaagagaatctccaagaagaagactcatgtgaagaaatgcacccccaatgcagtgttcaatgagctgtttgtctttgatattccttgtgagggccttgaagatataagtgttgaatttttggttttggattctgaaagggggtcccgaaatgaggtaatcgggcagttagtcttgggtgcagcagcagaaggaactggtggagagcactggaaagagatctgtgactaccccaggagacaaattgccaagtggcacgtgctctgtgatggttagcatcctagccgtgagttggaacttaaaggtttttactaggcaaggagaaattttctttctttctatattggattgcaagcttgggaaatcaagctacctttttgttgttgttgttgttgctagaaatggattgaattagtagaccagaaagtaacttcaaatgtgtattatgataatttccctatttattagaagagttggataaattttcataagatattcaatatctccttcagattaccagtgatataactaggaatagtcagacattttatgaatactgtgccagaatcccaaattataaatgtgacaatctcattggaacatgtcac

SEQ ID NO: 21142 - DNA, 746 bp, Homo sapiens
  ENST00000585604
gagcttctcagaagagccaaaacaggaaccgaggtggcaaatcactgtgcgagggcgagtggacctccctctttgcctcctccctgttccaggagctggtgccctgggctctgcgctgttgttttcagcgctccgaaagccggcgcttgagatccagaagtcttcaggacggggtgagttactgatctctctctgctatcagtccaccacaaacactctaactgtggttgtcttaaaagctcgacatctgcctaaatctgatgtgtccggactttcagatccctatgtcaaagtgaacctgtaccatgccaaaaagagaatctccaagaagaagactcatgtgaagaaatgcacccccaatgcagtgttcaatgagctgtttgtctttgatattccttgtgagggccttgaagatataagtgttgaatttttggttttggattctgaaagggggtcccgaaatgaggtaatcgggcagttagtcttgggtgcagcagcagaaggaactggtggagagcactggaaagagatctgtgactaccccaggagacaaattgccaagtggcacgtgctctgtgatggttagcatcctagccgtgagttggaacttaaaggtttttactaggcaaggagaaattttctttctttctatattggattgcaagcttgggaaatcaagctacctttttgttgttgttgttgttgctagaaatggattgaattagtagaccagaaagtaacttcaa

SEQ ID NO: 21143 - DNA, 565 bp, Homo sapiens
  ENST00000596867
agaagagccaaaacaggaaccgaggtggcaaatcactgtgcgagggcgagtggacctccctctttgcctcctccctgttccaggagctggtgccctgggctctgcgctgttgttttcagcgctccgaaagccggcgcttgagatccaggcaagtgaatccagccaggcagttttcccttcagcacctcggacagaacacgcagtaaaaaatggctccgatcaccaccagccgggaagaatttggtaagcaagaaaaatgttaatgaatagagagatcatcaagagaaatgttaggaagtcttcaggacggggtgagttactgatctctctctgctatcagtccaccacaaacactctaactgtggttgtcttaaaagctcgacatctgcctaaatctgatgtgtccggactttcagatccctatgtcaaagtgaacctgtaccatgccaaaaagagaatctccaagaagaagactcatgtgaagaaatgcacccccaatgcagtgttcaatgagctgtttgtctttgatattccttgtgagggccttgaagatataagtgttgaa

SEQ ID NO: 21144 - DNA, 537 bp, Homo sapiens
  ENST00000589479
aaaccaaaagccaaaaataatcctgtgtaggatataatttaaatatcctttaaacatttctaagtaatgggtgtggccaatttattgccaattttaacttcctgtagtaccaaacaagaccacaagatggcaggcagtggtttttcaagcagcgatggtactgctcaaaagcttttagttactcttcaattccttagaatattaaaataaaaataagtaagattatatttaaatgacgatgttatttaaactttaatgaaagtacacacttcaaagttaaaaagatagaaatacttatatcacatttctctttctgcagaagtcttcaggacggggtgagttactgatctctctctgctatcagtccaccacaaacactctaactgtggttgtcttaaaagctcgacatctgcctaaatctgatgtgtccggactttcagatccctatgtcaaagtgaacctgtaccatgccaaaaagagaatctccaagaagaagactcatgtgaagaaatgcacccccaatgcagtgttcaatga

SEQ ID NO: 21145 - DNA, 560 bp, Homo sapiens
  ENST00000593720
ttcagcgctccgaaagccggcgcttgagatccaggcaagtgaatccagccaggcagttttcccttcagcacctcggacagaacacgcagtaaaaaatggctccgatcaccaccagccgggaagaatttgatgaaatccccacagtggtggggatcttcagtgcatttggcctggtcttcacagtctctctctttgcatggatctgctgtcagagaaaatcatccaatgaaaactagagtgctgagaaaaaccttggatccagcttttgatgagacctttacattctatgggataccctacacccaaatccaagaattggccttgcacttcacaattttgagttttgacaggttttcaagagatgatatcattggggaagttctaattcctctctcgggaattgaattatctgaaggaaaaatgttaatgaatagagagatcatcaagagaaatgttaggaagtcttcaggacggggtgagttactgatctctctctgctatcagtccaccacaaacactctaactgtggttgtcttaaaagctcgacatctgcctaaatc

SEQ ID NO: 21146 - DNA, 510 bp, Homo sapiens
  ENST00000591820
agaagagccaaaacaggaaccgaggtggcaaatcactgtgcgagggcgagtggacctccctctttgcctcctccctgttccaggagctggtgccctgggctctgcgctgttgttttcagcgctccgaaagccggcgcttgagatccagatgaaatccccacagtggtggggatcttcagtgcatttggcctggtcttcacagtctctctctttgcatggatctgctgtcagagaaaatcatccaagtctaacaagactcctccatacaagtttgtgcatgtgcttaagggagttgatatttaccctgaaaacctaaatagcaaaaagaagtttggagcagatgataaaaatgaagtaaagaataagccagctgtgccaaagaattcattgcatctggatcttgaaaagagagatctcaatggcaattttcccaaaaccaacctcaaacctggcagtccttctgatctggagaatgcaaccccgaagctctttttagaaggggaaaaagag

SEQ ID NO: 21147 - DNA, 4854 bp, Homo sapiens
  ENST00000263846
ccgggcgcgctcacacacgcgctcacacacacacatacacacggcctcgtacacacacacacgctccggcgcgcacacgcggcgcgcaggccggagggaggcggctcggcgctgttcggcggcggcggcagcgtgctccgcgggcgggcgggagggctggcgggcggcccccgctccccggctccgcggctaggtgcagcccgctcggcccccgccctcggacccgcccccgggggtcgcccggccccatgcccagcggcggcggcggagcagcgcgcggccgcgggcggctctgaggagcccggagggaaccggcgacgaggggaccatgtaccgggacccggaggcggccagcccaggggcgccctcgcgcgacgtcctgctggtctctgccatcatcaccgtcagccttagcgtcactgtcgtcctctgcggcctctgccactggtgtcagcgcaaactgggcaaacgctacaagaattccttggagacggtgggcacgccagactcagggcgtgggcgcagtgagaagaaggctatcaagttgcctgcaggagggaaggcggtgaacacagcccccgtgccaggccagacaccccacgatgagtccgaccgccggaccgagccacgttcctccgtctcagacctcgtcaactccctcaccagcgagatgctcatgctctccccaggctccgaggaggatgaggcccacgagggttgcagccgagagaacctgggccggatccagttcagtgtcggctacaacttccaggagtccacgctcaccgtgaagatcatgaaggcccaggagctgccggccaaggacttcagcggcaccagcgaccccttcgtcaagatctacctgctgcccgacaagaagcacaagctggagaccaaggtgaagcggaagaacctgaacccccactggaacgagaccttcctctttgaaggttttccctatgagaaggtggtgcagaggatcctctacctccaagtcctggactatgaccgcttcagccgcaacgaccccattggggaggtgtccatcccccttaacaaggtggacctgacccagatgcagaccttctggaaggatctgaagccatgcagcgatgggagtgggagccgaggggagctgctcttgtctctctgctacaacccctctgccaactccatcatcgtgaacatcatcaaagcccggaacctcaaagccatggacatcgggggcacatcagacccctacgtgaaggtatggctgatgtacaaggacaagcgggtggagaagaagaagacggtgacgatgaagaggaacctgaaccccatcttcaatgagtccttcgccttcgatatccccacggagaagctgagggagacgaccatcatcatcactgtcatggacaaggacaagctcagccgcaatgacgtcatcggcaagatctacctgtcctggaagagcgggccaggggaggtgaagcactggaaggacatgattgcccgtccccggcagcccgtggcccagtggcaccagctgaaggcctgagtggggccaagggaggcccagggggccgagggcccaggtccccatcatgccctcaccactttatgcacaacgcccggcctgagccccctgccatagggaggggaggaccctgagggctcagccagggaggggtcccaggactcaactgggccccgtttctaggaagtaccagccccatcccccacagtccagctccggggaaggggctctgggaggcattttcctgctttgccccttttcttcctgacttactaatactaaagaagttgggggagctcgagagccagacggccagacaggcagacccctccagaggcccgccaggtgggcatggtcccccattttctttaaggcagcacctggagtggagagaggccactccctctccagcccccgatgtggacccggggaggggaggctgaggcgtttggccccggcctggccaggagaggcccatccccagggcagtttcaggtgccggctgggccctgaatgtcgaggatagtatatagcccgctcctgggtcctggagctgtggccctttgtactcgtgttgtgtccattgtgtgtgtgcgtggggacagaggcctggaaatgcggaggactatacagagaaggcaggttttgtgaaggccaggcagggttggaggccgggggtgtgagaggagaggcccatagggctgagtggggtcgggtgaggcagaggtcagaaacagaagagctgcagttgctggagctgggctgagaactgggctgcctcctgccatccccccgtctcctccccttctccccttggtgcccccctctgctcagaatctgaagtagttccctcctcagcaatttcatctcttgaacactgactcacaccttttaggcacctactgtgtgcatagcattccaccaggactcatctcccttccttctcagggggtcccgagccccgactagctttgccctaactccttcatcaaaagaccccccgccagcttcccacacctcatacgcagccacatctgccctattctccatgctttccagcttgcctgcccttcctcatctctccctgcctgtgcagacctccacccttctttcctccacccctccatcccccaatgcttgtagaccttccattcattccgtctcatcgtgcgtggtctctgatcgtccatcacctgaccttctccaggactgtcttctcacccttccccactccctggtccccgggagcagctccttctgcccgactcactcacagtgcagggaaaggaggcagggaaaagaccaggattctgtgagttctgaggttgccacacacaaagaagctgtggtttctctgcctcggccactgatgagactaaaactggcttccccttggagacggcagatttcaggctgatccctgcttaagccctctcatccccacgctggtcctggtattgatacaagacccagctggtgacaaagcctccaatcctgggggtccacgagcctgggcctgacattcccagaactaccgccaggtggcgccaggcccccacagtctgtggccgtggtcttagcccccagttccactctggatgggcctgtgacaccccaaagagaagaaggggactctggatagggtccccacatccagggcgtggggagaccattggcatttgggaaccattttccttcgaacggcttccccttgagctgagcattctgcttgctgcagtagacgggtcgccttttgcccataccgaaattttctgaaattaaatcgcacacccccaccatttcctctccctgggatctggaggaacatcatacatagtaggtgaatcgttttgtagagtgaagaatgctaatgtaaagcaaatagtcacccacgttccttgtaaatccaaatgtttctatattgtagctttgcttaaaatggggtcggccccaactgcatcctcctctttggcgggctggggagcggcccccagccgggacgggagggcagcgaccccgaggcctcgtggacgtgggagagagtgtggtgggaagtcttgagcggaggaggggatctgcccttctccactcctctcttggatccgcctcggtttcctgtccccccaccacccgcctgccccgcggaagaccgcccagtgagccagcccccaccttccaggcgccttcgccctggggatccaaccaacttgtatcgagtgggcggggcaacggctccccatttttcccgagccccgcccacagagctcttagccaatcctatgcagagagcatctcctggcaggggtctcttcccaaccagaccccacccaggcacattagcgaccaggcttgggcttccccagcgccccaccaccaccacgtgcaggtggagctctgggatgctatgttggggcggcaagcggtgggccgagggccgggtaggctagcacgggaggtaagggtggtatgggatggggcgggggcggtctagggcaataggagagcagagaatgggggaacttgagggtggggggagggcaccggagccttgccaccatcccaggactttgggcaagtcacccgcactccctgggcctcggtttccccatctgtaaaatgatggtaataatacttcacctacctcataggggaggttgtgaggccaccatcacctgacctgggggtcaaggcaggaggactccgaaggtgctacccgtgagcaaagtgtaattaccgaatcctgactgcaaggcccacctgcccctcccccacagagcctccagagctagctgaggccaacgcaggcccatccgtctcttcactctgtcgcaggccctttcatgggcttcgtctgccatctttgtgggtgccctagacttagtccttatcttgtcctggtttcctttcttgtgaccatctccccatgaaagtgctgtacaaattccacccgccccaggacccccgcacctgccctctggcaccagatgccagggaagggacagaggaaaacagccacaaacaagccaggggggctccccggagccccaggggtggggattggtggccactgtttgtatgttcttgagtgcaagtgttttataaaaaataaaacaaaaacccaccatcacaaaaaaaaaaattttgcagcgaagagaaatgaagaaaaactgaagaaaaaaaaaaaacaggaaaaaaagaaccatacaaaatttttccaccacacataccctctaagccagcaagatttcctctttgcaaaatcatatttttgtgggaatgggccctgctttttgtggcaaggcctgttctgattaataaaggatcgtgaaaaagta

SEQ ID NO: 21148 - DNA, 2013 bp, Homo sapiens
  ENST00000540677
gggaccatgtaccgggacccggaggcggccagcccaggggcgccctcgcgcgacgtcctgctggtctctgccatcatcaccgtcagccttagcgtcactgtcgtcctctgcggcctctgccactggtgtcagcgcaaactgggcaaacgctacaagaattccttggagacggtgggcacgccagactcagggcgtgggcgcagtgagaagaaggctatcaatggcaccctcctgtcgggcgccaaagtggccgccgcggcggggctggcggtggagcgggaaggccggctgggggagaagccggcaccggtgccgccacccggagaggacgccttgagaagcggcggggctgcccccagcgagccgggcagcggtggcaaggcggggagaggccgctggcggacggtgcagagccacctggccgcagggaagctcaacttgtccaagttgcctgcaggagggaaggcggtgaacacagcccccgtgccaggccagacaccccacgatgagtccgaccgccggaccgagccacgttcctccgtctcagacctcgtcaactccctcaccagcgagatgctcatgctctccccaggctccgaggaggatgaggcccacgagggttgcagccgagagaacctgggccggatccagttcagtgtcggctacaacttccaggagtccacgctcaccgtgaagatcatgaaggcccaggagctgccggccaaggacttcagcggcaccagcgaccccttcgtcaagatctacctgctgcccgacaagaagcacaagctggagaccaaggtgaagcggaagaacctgaacccccactggaacgagaccttcctctttgaaggttttccctatgagaaggtggtgcagaggatcctctacctccaagtcctggactatgaccgcttcagccgcaacgaccccattggggaggtgtccatcccccttaacaaggtggacctgacccagatgcagaccttctggaaggatctgaagccatgcagcgatgggagtgggagccgaggggagctgctcttgtctctctgctacaacccctctgccaactccatcatcgtgaacatcatcaaagcccggaacctcaaagccatggacatcgggggcacatcagacccctacgtgaaggtatggctgatgtacaaggacaagcgggtggagaagaagaagacggtgacgatgaagaggaacctgaaccccatcttcaatgagtccttcgccttcgatatccccacggagaagctgagggagacgaccatcatcatcactgtcatggacaaggacaagctcagccgcaatgacgtcatcggcaagatctacctgtcctggaagagcgggccaggggaggtgaagcactggaaggacatgattgcccgtccccggcagcccgtggcccagtggcaccagctgaaggcctgagtggggccaagggaggcccagggggccgagggcccaggtccccatcatgccctcaccactttatgcacaacgcccggcctgagccccctgccatagggaggggaggaccctgagggctcagccagggaggggtcccaggactcaactgggccccgtttctaggaagtaccagccccatcccccacagtccagctccggggaaggggctctgggaggcattttcctgctttgccccttttcttcctgacttactaatactaaagaagttgggggagctcgagagccagacggccagacaggcagacccctccagaggcccgccaggtgggcatggtcccccattttctttaaggcagcacctggagtggagagaggccactccctctccagcccccgatgtggacccggggaggggaggctgaggcgtttggccccggcctggccaggagaggcccatccccagggcagtttcaggtgccggctgggccctgaatgtcgaggatagtatatagcccgctcctgggtcctggagctgtggccctttgtactcgtgttgtgtccattgtgtgt

SEQ ID NO: 21149 - DNA, 1961 bp, Homo sapiens
  ENST00000539246
atgtaccgggacccggaggcggccagcccaggggcgccctcgcgcgacgtcctgctggtctctgccatcatcaccgtcagccttagcgtcactgtcgtcctctgcggcctctgccactggtgtcagcgcaaactgggcaaacgctacaagaattccttggagacggtgggcacgccagactcagggcgtgggcgcagtgagaagaaggctatcaatgatctagacagagacttttggaataacaatgagagcacagtgcagcagaaatggagctcctaccctcccaaggagtttattctaaacatttcaccctacgccccttatggcgacccacgactgtccctcaacccgctcttcctccgtcgttaacccttcgttgtcctgtgggatagagttggaggtggctgccctcccccaacccccgccgcccctgccccaggcggtggggaggggccccccctccgttgtcgtgtttcgaggactccaccctgtccacggccactacccttgagtctatccccagctccacgggagagccgaaatgccagcgaccccgcaccctgatgcggcagcagagcctgcaacagccgctgagccagcaccagcggggccggcagcccagccagcccaccaccagccagagcctgggccagctgcaggcccacatggcctcggcaccaggccccaacccccgggcctatggccggggccaggctcggcagggcacctcggccggctccaagtaccgggcggcagggggccgcagccgctccaacccaggcagctgggaccacgtggtggggcagattcgaaaccgaggcttggacatgaaatccttcctggaaggccggatggtggtgctatccttggtcttagggctttcggaacaggatgactttgccaatatccctgacctgcaaaacccaggaacccagcagaaccagaacgctcagggggacaagaggttgcctgcaggagggaaggcggtgaacacagcccccgtgccaggccagacaccccacgatgagtccgaccgccggaccgagccacgttcctccgtctcagacctcgtcaactccctcaccagcgagatgctcatgctctccccaggctccgaggaggatgaggcccacgagggttgcagccgagagaacctgggccggatccagttcagtgtcggctacaacttccaggagtccacgctcaccgtgaagatcatgaaggcccaggagctgccggccaaggacttcagcggcaccagcgaccccttcgtcaagatctacctgctgcccgacaagaagcacaagctggagaccaaggtgaagcggaagaacctgaacccccactggaacgagaccttcctctttgaaggttttccctatgagaaggtggtgcagaggatcctctacctccaagtcctggactatgaccgcttcagccgcaacgaccccattggggaggtgtccatcccccttaacaaggtggacctgacccagatgcagaccttctggaaggatctgaagccatgcagcgatgggagtgggagccgaggggagctgctcttgtctctctgctacaacccctctgccaactccatcatcgtgaacatcatcaaagcccggaacctcaaagccatggacatcgggggcacatcagacccctacgtgaaggtatggctgatgtacaaggacaagcgggtggagaagaagaagacggtgacgatgaagaggaacctgaaccccatcttcaatgagtccttcgccttcgatatccccacggagaagctgagggagacgaccatcatcatcactgtcatggacaaggacaagctcagccgcaatgacgtcatcggcaagatctacctgtcctggaagagcgggccaggggaggtgaagcactggaaggacatgattgcccgtccccggcagcccgtggcccagtggcaccagctgaaggcctga

SEQ ID NO: 21150 - DNA, 2186 bp, Homo sapiens
  ENST00000539468
atgtaccgggacccggaggcggccagcccaggggcgccctcgcgcgacgtcctgctggtctctgccatcatcaccgtcagccttagcgtcactgtcgtcctctgcggcctctgccactggtgtcagcgcaaactgggcaaacgctacaagaattccttggagacggtgggcacgccagactcagggcgtgggcgcagtgagaagaaggctatcaatgatctagacagagacttttggaataacaatgagagcacagtgcagcagaaatggagctcctaccctcccaaggagtttattctaaacatttcaccctacgccccttatggcgacccacgactgtccctcaacccgctcttcctccgtcgttaacccttcgttgtcctgtgggatagagttggaggtggctgccctcccccaacccccgccgcccctgccccaggcggtggggaggggccccccctccgttgtcgtgtggcaccctcctgtcgggcgccaaagtggccgccgcggcggggctggcggtggagcgggaaggccggctgggggagaagccggcaccggtgccgccacccggagaggacgccttgagaagcggcggggctgcccccagcgagccgggcagcggtggcaaggcggggagaggccgctggcggacggtgcagagccacctggccgcagggaagctcaacttgtccaatttcgaggactccaccctgtccacggccactacccttgagtctatccccagctccacgggagagccgaaatgccagcgaccccgcaccctgatgcggcagcagagcctgcaacagccgctgagccagcaccagcggggccggcagcccagccagcccaccaccagccagagcctgggccagctgcaggcccacatggcctcggcaccaggccccaacccccgggcctatggccggggccaggctcggcagggcacctcggccggctccaagtaccgggcggcagggggccgcagccgctccaacccaggcagctgggaccacgtggtggggcagattcgaaaccgaggcttggacatgaaatccttcctggaaggccggatggtggtgctatccttggtcttagggctttcggaacaggatgactttgccaatatccctgacctgcaaaacccaggaacccagcagaaccagaacgctcagggggacaagaggttgcctgcaggagggaaggcggtgaacacagcccccgtgccaggccagacaccccacgatgagtccgaccgccggaccgagccacgttcctccgtctcagacctcgtcaactccctcaccagcgagatgctcatgctctccccaggctccgaggaggatgaggcccacgagggttgcagccgagagaacctgggccggatccagttcagtgtcggctacaacttccaggagtccacgctcaccgtgaagatcatgaaggcccaggagctgccggccaaggacttcagcggcaccagcgaccccttcgtcaagatctacctgctgcccgacaagaagcacaagctggagaccaaggtgaagcggaagaacctgaacccccactggaacgagaccttcctctttgaaggttttccctatgagaaggtggtgcagaggatcctctacctccaagtcctggactatgaccgcttcagccgcaacgaccccattggggaggtgtccatcccccttaacaaggtggacctgacccagatgcagaccttctggaaggatctgaagccatgcagcgatgggagtgggagccgaggggagctgctcttgtctctctgctacaacccctctgccaactccatcatcgtgaacatcatcaaagcccggaacctcaaagccatggacatcgggggcacatcagacccctacgtgaaggtatggctgatgtacaaggacaagcgggtggagaagaagaagacggtgacgatgaagaggaacctgaaccccatcttcaatgagtccttcgccttcgatatccccacggagaagctgagggagacgaccatcatcatcactgtcatggacaaggacaagctcagccgcaatgacgtcatcggcaagatctacctgtcctggaagagcgggccaggggaggtgaagcactggaaggacatgattgcccgtccccggcagcccgtggcccagtggcaccagctgaaggcctga

SEQ ID NO: 21151 - DNA, 2061 bp, Homo sapiens
  ENST00000539008
atgtaccgggacccggaggcggccagcccaggggcgccctcgcgcgacgtcctgctggtctctgccatcatcaccgtcagccttagcgtcactgtcgtcctctgcggcctctgccactggtgtcagcgcaaactgggcaaacgctacaagaattccttggagacggtgggcacgccagactcagggcgtgggcgcagtgagaagaaggctatcaatgatctagacagagacttttggaataacaatgagagcacagtgcagcagaaatggagctcctaccctcccaaggagtttattctaaacatttcaccctacgccccttatggcgacccacgactgtccctcaatggcaccctcctgtcgggcgccaaagtggccgccgcggcggggctggcggtggagcgggaaggccggctgggggagaagccggcaccggtgccgccacccggagaggacgccttgagaagcggcggggctgcccccagcgagccgggcagcggtggcaaggcggggagaggccgctggcggacggtgcagagccacctggccgcagggaagctcaacttgtccaatttcgaggactccaccctgtccacggccactacccttgagtctatccccagctccacgggagagccgaaatgccagcgaccccgcaccctgatgcggcagcagagcctgcaacagccgctgagccagcaccagcggggccggcagcccagccagcccaccaccagccagagcctgggccagctgcaggcccacatggcctcggcaccaggccccaacccccgggcctatggccggggccaggctcggcagggcacctcggccggctccaagtaccgggcggcagggggccgcagccgctccaacccaggcagctgggaccacgtggtggggcagattcgaaaccgaggcttggacatgaaatccttcctggaaggccggatggtggtgctatccttggtcttagggctttcggaacaggatgactttgccaatatccctgacctgcaaaacccaggaacccagcagaaccagaacgctcagggggacaagaggttgcctgcaggagggaaggcggtgaacacagcccccgtgccaggccagacaccccacgatgagtccgaccgccggaccgagccacgttcctccgtctcagacctcgtcaactccctcaccagcgagatgctcatgctctccccaggctccgaggaggatgaggcccacgagggttgcagccgagagaacctgggccggatccagttcagtgtcggctacaacttccaggagtccacgctcaccgtgaagatcatgaaggcccaggagctgccggccaaggacttcagcggcaccagcgaccccttcgtcaagatctacctgctgcccgacaagaagcacaagctggagaccaaggtgaagcggaagaacctgaacccccactggaacgagaccttcctctttgaaggttttccctatgagaaggtggtgcagaggatcctctacctccaagtcctggactatgaccgcttcagccgcaacgaccccattggggaggtgtccatcccccttaacaaggtggacctgacccagatgcagaccttctggaaggatctgaagccatgcagcgatgggagtgggagccgaggggagctgctcttgtctctctgctacaacccctctgccaactccatcatcgtgaacatcatcaaagcccggaacctcaaagccatggacatcgggggcacatcagacccctacgtgaaggtatggctgatgtacaaggacaagcgggtggagaagaagaagacggtgacgatgaagaggaacctgaaccccatcttcaatgagtccttcgccttcgatatccccacggagaagctgagggagacgaccatcatcatcactgtcatggacaaggacaagctcagccgcaatgacgtcatcggcaagatctacctgtcctggaagagcgggccaggggaggtgaagcactggaaggacatgattgcccgtccccggcagcccgtggcccagtggcaccagctgaaggcctga

SEQ ID NO: 21152 - DNA, 1362 bp, Homo sapiens
  ENST00000542836
accggcgacgaggggaccatgtaccgggacccggaggcggccagcccaggggcgccctcgcgcgacgtcctgctggtctctgccatcatcaccgtcagccttagcgtcactgtcgtcctctgcggcctctgccactggtgtcagcgcaaactgggcaaacgctacaagaattccttggagacggtgggcacgccagactcagggcgtgggcgcagtgagaagaaggctatcaatgatctagacagagacttttggaataacaatgagagcacagtgcagcagaaatggagctcctaccctcccaaggagtttattctaaacatttcaccctacgccccttatggcgacccacgactgtccctcaagttgcctgcaggagggaaggcggtgaacacagcccccgtgccaggccagacaccccacgatgagtccgaccgccggaccgagccacgttcctccgtctcagacctcgtcaactccctcaccagcgagatgctcatgctctccccaggctccgaggaggatgaggcccacgagggttgcagccgagagaacctgggccggatccagttcagtgtcggctacaacttccaggagtccacgctcaccgtgaagatcatgaaggcccaggagctgccggccaaggacttcagcggcaccagcgaccccttcgtcaagatctacctgctgcccgacaagaagcacaagctggagaccaaggtgaagcggaagaacctgaacccccactggaacgagaccttcctctttgaaggttttccctatgagaaggtggtgcagaggatcctctacctccaagtcctggactatgaccgcttcagccgcaacgaccccattggggaggtgtccatcccccttaacaaggtggacctgacccagatgcagaccttctggaaggatctgaagccatgcagcgatgggagtgggagccgaggggagctgctcttgtctctctgctacaacccctctgccaactccatcatcgtgaacatcatcaaagcccggaacctcaaagccatggacatcgggggcacatcagacccctacgtgaaggtatggctgatgtacaaggacaagcgggtggagaagaagaagacggtgacgatgaagaggaacctgaaccccatcttcaatgagtccttcgccttcgatatccccacggagaagctgagggagacgaccatcatcatcactgtcatggacaaggacaagctcagccgcaatgacgtcatcggcaagatctacctgtcctggaagagcgggccaggggaggtgaagcactggaaggacatgattgcccgtccccggcagcccgtggcccagtggcaccagctgaaggcctga

SEQ ID NO: 21153 - DNA, 1887 bp, Homo sapiens
  ENST00000542670
cggccgcgggcggctctgaggagcccggagggaaccggcgacgaggggaccatgtaccgggacccggaggcggccagcccaggggcgccctcgcgcgacgtcctgctggtctctgccatcatcaccgtcagccttagcgtcactgtcgtcctctgcggcctctgccactggtgtcagcgcaaactgggcaaacgctacaagaattccttggagacggtgggcacgccagactcagggcgtgggcgcagtgagaagaaggctatcaatgatctagacagagacttttggaataacaatgagagcacagtgcagcagaaatggagctcctaccctcccaaggagtttattctaaacatttcaccctacgccccttatggcgacccacgactgtccctcaatttcgaggactccaccctgtccacggccactacccttgagtctatccccagctccacgggagagccgaaatgccagcgaccccgcaccctgatgcggcagcagagcctgcaacagccgctgagccagcaccagcggggccggcagcccagccagcccaccaccagccagagcctgggccagctgcaggcccacatggcctcggcaccaggccccaacccccgggcctatggccggggccaggctcggcagggcacctcggccggctccaagtaccgggcggcagggggccgcagccgctccaacccaggcagctgggaccacgtggtggggcagattcgaaaccgaggcttggacatgaaatccttcctggaaggccggatggtggtgctatccttggtcttagggctttcggaacaggatgactttgccaatatccctgacctgcaaaacccaggaacccagcagaaccagaacgctcagggggacaagaggttgcctgcaggagggaaggcggtgaacacagcccccgtgccaggccagacaccccacgatgagtccgaccgccggaccgagccacgttcctccgtctcagacctcgtcaactccctcaccagcgagatgctcatgctctccccaggctccgaggaggatgaggcccacgagggttgcagccgagagaacctgggccggatccagttcagtgtcggctacaacttccaggagtccacgctcaccgtgaagatcatgaaggcccaggagctgccggccaaggacttcagcggcaccagcgaccccttcgtcaagatctacctgctgcccgacaagaagcacaagctggagaccaaggtgaagcggaagaacctgaacccccactggaacgagaccttcctctttgaaggttttccctatgagaaggtggtgcagaggatcctctacctccaagtcctggactatgaccgcttcagccgcaacgaccccattggggaggtgtccatcccccttaacaaggtggacctgacccagatgcagaccttctggaaggatctgaagccatgcagcgatgggagtgggagccgaggggagctgctcttgtctctctgctacaacccctctgccaactccatcatcgtgaacatcatcaaagcccggaacctcaaagccatggacatcgggggcacatcagacccctacgtgaaggtatggctgatgtacaaggacaagcgggtggagaagaagaagacggtgacgatgaagaggaacctgaaccccatcttcaatgagtccttcgccttcgatatccccacggagaagctgagggagacgaccatcatcatcactgtcatggacaaggacaagctcagccgcaatgacgtcatcggcaagatctacctgtcctggaagagcgggccaggggaggtgaagcactggaaggacatgattgcccgtccccggcagcccgtggcccagtggcaccagctgaaggcctga

SEQ ID NO: 21154 - DNA, 1621 bp, Homo sapiens
  ENST00000535826
gcggccgcgggcggctctgaggagcccggagggaaccggcgacgaggggaccatgtaccgggacccggaggcggccagcccaggggcgccctcgcgcgacgtcctgctggtctctgccatcatcaccgtcagccttagcgtcactgtcgtcctctgcggcctctgccactggtgtcagcgcaaactgggcaaacgctacaagaattccttggagacggtgggcacgccagactcagggcgtgggcgcagtgagaagaaggctatcaatgatctagacagagacttttggaataacaatgagagcacagtgcagcagaaatggagctcctaccctcccaaggagtttattctaaacatttcaccctacgccccttatggcgacccacgactgtccctcaatggcaccctcctgtcgggcgccaaagtggccgccgcggcggggctggcggtggagcgggaaggccggctgggggagaagccggcaccggtgccgccacccggagaggacgccttgagaagcggcggggctgcccccagcgagccgggcagcggtggcaaggcggggagaggccgctggcggacggtgcagagccacctggccgcagggaagctcaacttgtccaagttgcctgcaggagggaaggcggtgaacacagcccccgtgccaggccagacaccccacgatgagtccgaccgccggaccgagccacgttcctccgtctcagacctcgtcaactccctcaccagcgagatgctcatgctctccccaggctccgaggaggatgaggcccacgagggttgcagccgagagaacctgggccggatccagttcagtgtcggctacaacttccaggagtccacgctcaccgtgaagatcatgaaggcccaggagctgccggccaaggacttcagcggcaccagcgaccccttcgtcaagatctacctgctgcccgacaagaagcacaagctggagaccaaggtgaagcggaagaacctgaacccccactggaacgagaccttcctctttgaaggttttccctatgagaaggtggtgcagaggatcctctacctccaagtcctggactatgaccgcttcagccgcaacgaccccattggggaggtgtccatcccccttaacaaggtggacctgacccagatgcagaccttctggaaggatctgaagccatgcagcgatgggagtgggagccgaggggagctgctcttgtctctctgctacaacccctctgccaactccatcatcgtgaacatcatcaaagcccggaacctcaaagccatggacatcgggggcacatcagacccctacgtgaaggtatggctgatgtacaaggacaagcgggtggagaagaagaagacggtgacgatgaagaggaacctgaaccccatcttcaatgagtccttcgccttcgatatccccacggagaagctgagggagacgaccatcatcatcactgtcatggacaaggacaagctcagccgcaatgacgtcatcggcaagatctacctgtcctggaagagcgggccaggggaggtgaagcactggaaggacatgattgcccgtccccggcagcccgtggcccagtggcaccagctgaaggcctga

SEQ ID NO: 21155 - DNA, 723 bp, Homo sapiens
  ENST00000540831
ggtgaacacagcccccgtgccaggccagacaccccacgatgagtccgaccgccggaccgagccacgttcctccgtctcagacctcgtcaactccctcaccagcgagatgctcatgctctccccaggctccgaggaggatgaggcccacgagggttgcagccgagagaacctgggccggatccagttcagtgtcggctacaacttccaggagtccacgctcaccgtgaagatcatgaaggcccaggagctgccggccaaggacttcagcggcaccagcgaccccttcgtcaagatctacctgctgcccgacaagaagcacaagctggagaccaaggtgaagcggaagaacctgaacccccactggaacgagaccttcctctttgaagctgggagtctgggcaagtactttaagccgtctgagcctcatctgtaagatggacgagatgccattcaccttggagaattgttgagggaatcccatgagacggtgacagttcttgctagcacttcagttttccctatgagaaggtggtgcagaggatcctctacctccaagtcctggactatgaccgcttcagccgcaacgaccccattggggaggtgtccatcccccttaacaaggtggacctgacccagatgcagaccttctggaaggatctgaagccatgcagcgatgggagtgggagccgaggggagctgctcttgtctctctgctacaacccc

SEQ ID NO: 21156 - DNA, 578 bp, Homo sapiens
  ENST00000545053
gcggccgcgggcggctctgaggagcccggagggaaccggcgacgaggggaccatgtaccgggacccggaggcggccagcccaggggcgccctcgcgcgacgtcctgctggtctctgccatcatcaccgtcagccttagcgtcactgtcgtcctctgcggcctctgccactggtgtcagcgcaaactgggcaaacgctacaagaattccttggagacggtgggcacgccagactcagggcgtgggcgcagtgagaagaaggctatcaagttgcctgcaggagggaaggcggtgaacacagcccccgtgccaggccagacaccccacgatgagtccgaccgccggaccgagccacgttcctccgtctcagacctcgtcaactccctcaccagcgagatgctcatgctctccccaggctccgaggaggatgaggcccacgagggttgcagccgagagaacctgggccggatccagttcagtgtcggctacaacttccaggagtccacgctcaccgtgaagatcatgaaggcccaggagctgccggccaaggacttcagcggcaccagcgaccccttcgtca

SEQ ID NO: 21157 - DNA, 7470 bp, Homo sapiens
  ENST00000263635
ccgcctcgggagccggaggagaggcagccgcggagcgccgagctggcctcgccccgaggcccggccctgggtgtggggaaccgcgctgaggagctggaaactttcccggcaggagctgactgctgggcaggaacgtctctcaggagaaagagtggaagagaaaattgtgaactaaggccccctgcccccttttcctggtgcatgtgaagttatcaaaaacagaaacaagtgttgaaaatgttaaaggctgtgctgaagaagagccgagagggaggaaagggaggcaagaaggaagcaggaagtgactttggtccagagacttctccagtcctgcaccttgaccacagtgctgactctcctgtgagcagtcttcccacagcagaggacacctatagggtgagcttggccaaaggtgtctcgatgtctctgccttcctcacctttgctgcctcgacagtctcacttggtgcaatcaagagtgaacaaaaaatccccaggtcccgtcaggaagcccaagtatgtggaaagccccagagtgcctggagatgcagttataatgccattcagagaagtagccaagccaacagagcctgatgagcatgaagcaaaggccgataatgaaccgagctgttcgccggcagctcaagaactgttgacaaggctgggatttttactgggagaagggatcccaagtgccacacacataaccattgaagacaaaaatgaaaccatgtgcacagctctgagtcaaggcatcagtccttgctccacactaacaagcagcaccgcatctcctagcaccgatagcccctgctcaaccttgaatagctgtgtcagcaagacggcagccaacaaaagtccctgtgagaccattagcagccctagttccaccctggaaagcaaggacagtggaattatagccacaattacaagttcatccgaaaatgatgaccggagtggctccagtttggaatggaataaagatggaaacctaagattaggggttcagaagggagtgcttcatgaccgcagggcagataactgctccccagtggcagaagaggagaccaccgggtcagcagagagcacgctgcccaaagcagaatcctcagctggagatggtccagtcccttattctcagggctccagctcactaataatgccacggcccaactcagttgcagcaacaagctcaaccaaattggaagatctgagttatttagacgggcagagaaatgctcctctacggacgtcaattagattaccatggcacaatacggccggaggtagggcacaggaagttaaagcacgatttgctccctacaagccacaagacattttgttgaaacccttgttgtttgaagtaccaagcataacaacagactctgtgtttgtgggaagggattggctctttcaccagatagaagaaaacttgaggaacacagaactggcagaaaacagaggcgcggtggtggttggcaatgtgggatttgggaagacggcaatcatttccaagttggtggccctgagctgccacggaagccgcatgaggcagattgcttccaacagcccgggttcatcacctaaaacctctgaccccactcaggatcttcatttcactccgttgctttcaccgagttcttccacaagtgcttccagcacagctaaaacacctcttgggtctatcagtgctgaaaaccagagaccaagagaggatgcagtgaaatatcttgcttctaaggtggtggcctaccactactgccaggctgacaacacgtacacttgcctggtgcccgagtttgtgcacagcatcgcagctttgctctgccggtcccatcagctggccgcctacagagaccttctgataaaggagccccaactacagagcatgctgagcctccgatcctgtgtgcaggacccggtggcagctttcaagaggggagtgctggagccactcacaaacctgagaaatgagcagaaaattcctgaagaagaatacattattttgatagatggcttaaatgaagctgagtttcataaacctgattatggagatacgctttcttcatttattaccaaaattatttctaaatttcctgcctggttgaagttgattgtgactgtaagagcaaattttcaggaaatcataagtgcgctgccatttgtcaagctttccttagatgacttcccagacaacaaagacatccacagtgacctgcacgcctacgtccagcacagggtgcacagcagccaggacatcctcagcaacatctccctgaatggcaaggccgatgccacactcattggaaaagtgagcagccacctggtgctgcggagcctcggctcctacctgtacctcaagctcaccctggaccttttccagaggggccacttggtcattaagagtgccagctacaaggtggtgcccgtgtctctctctgagctctatttgcttcagtgcaacatgaagttcatgacccagtccgcctttgagagggcacttccgattctcaacgtggccctcgcatccctccaccccatgacagacgagcagatctttcaggctattaatgctggccacatccagggggagcagggatgggaagactttcagcagaggatggacgccctctcctgcttcctcattaagaggcgagacaaaacccgcatgttctgccacccgtccttcagggagtggcttgtatggagagcagacggggaaaacacggccttcctgtgtgagcccaggaacgggcacgcgctcttggcattcatgttctcgcgtcaggagggcaagttgaaccgccagcagaccatggagcttggccaccacatcctgaaggcgcacattttcaagggcctcagtaagaagacgggaatttcttcaagccatctccaagccctgtggatcggctacagcaccgaggggctgtccgccgccctggcctctctcaggaatctctatactcccaacgtgaaggtgagccgtctcctgattttgggaggggccaacgtgaactacaggacagaagtgttaaataatgccccaatcctgtgcgtccagtctcaccttggccacgaggaagttgtcactctgctcctggaatttggtgcctgcctggacggaacgtcagagaacggcatgactgccctctgttacgcagcagctgctggccacatgaagctggtgtgtctgctgaccaagaagggagtgagagtggaccacttggataagaagggccagtgtgcgcttgtccacagtgccctacggggccacggtgacattctccagtacctgctgacttgtgagtggtcgccgggtcctccccagccaggcaccctgaggaagagccacgccctgcagcaggcgctgaccgcggcggccagcatgggccacagctcggtggtccagtgcttgctggggatggagaaggaacatgaagtagaagtcaatggcaccgacacattgtggggagaaacagccctgactgccgccgcaggaagagggaagctggaggtctgtgagctgctgctggggcatggagctgctgtgtcgcggacaaacaggagaggggttccacctttgttttgtgcagcacgccaggggcattggcagattgttagactgctgttggaacgcggctgtgatgtgaacctaagtgacaagcaaggccggacgcccctcatggtggctgcttgtgaagggcacttgagcaccgtggaattcctcctttcaaaaggtgcagccctttcttctctagacaaagagggtctgtcagcattaagctgggcttgtctgaaaggtcacagggcagtggtccagtatctggttgaagaaggagctgcaatagaccagacagacaagaatggccgcacacccttggacctggctgccttctatggcgatgccgagactgtgctgtacctggtggagaagggagccgtgatcgagcatgtggaccacagcgggatgcggcccttggacagagccatcggctgccggaacacatctgtagtggtggcgctactcagaaagggagccaagttaggaaatgctgcttgggcgatggccacttccaaacctgatatcttgattatacttttacagaaattaatggaggaaggaaatgtgatgtacaaaaaagggaaaatgaaagaggcagcccagaggtaccagtatgccttaagaaagtttcctcgagaaggattcggagaggacatgagacccttcaatgaattaagggtttccctctatctcaatttgtcgcgatgccgaagaaaaacaaatgactttggcatggcagaggaatttgcttccaaggctctcgaattgaagcccaagtcctatgaagccttttatgccagagcaagagcgaagagaaatagcaggcaattcgtggcagctctggctgacctgcaagaggctgtgaaactctgtcccaccaatcaggaagtcaagaggcttctggcccgcgtagaagaggagtgcaaacaactccagaggagtcaacagcaaaaacagcagggcccgctaccagctccactcaacgactccgagaacgaagaggacaccccaacccctggcttaagtgaccactttcactctgaggagactgaagaggaagaaacttctccccaggaagaatctgtttccccaactcccaggtcccagccatcctcatctgtcccttcctcatacatccgaaaccttcaagaagggttacagtccaaaggaaggccggtatcgccacagagcagggcaggaatcggcaagtccctgagagagcctgtggcccagccagggctgctcctgcagccctccaagcaggcccagatcgtgaaaaccagccagcacctgggctctggccagtcggcagtgagaaatggcagtatgaaagttcagatctcttctcagaaccctcctccaagtcccatgccagggagaatcgctgccactcctgctgggagcagaacccagcatttagagggaacaggtactttcactacaagagctggttgtggccactttggggatcggctgggccccagccagaatgtccgcctgcagtgtggtgagaatggccctgcacaccctttaccaagtaagacgaaaaccacagagaggcttctgtctcattcctccgtggctgtggacgcagcccctccaaaccaaggtgggctggcgacctgcagcgacgtgcgacacccagcttccctcaccagctcaggctcttctggttctccatccagcagcataaagatgtcaagttcaaccagtagtttgacttcgagcagcagtttttcagatggcttcaaggtccaaggaccagatactagaattaaagacaaggttgtaacccacgttcagagcggtacagctgagcacagaccccgcaacacgccgttcatgggcatcatggataagactgcgaggttccaacagcagagcaatcctccaagccgcagctggcactgtccggcaccagaggggctgctgacaaacacgtcttctgcagctggcctgcagtctgctaacactgagaagccctctctcatgcaagtgggaggatataataaccaagccaaaacctgttctgtttctaccctgagtgcaagtgtccacaatggggcacaagtgaaggagctagaagaaagcaagtgccaaattccagtccactctcaagagaacaggataactaagactgtttctcatctgtaccaggaaagtatctccaaacagcagcctcatattagtaatgaagcccacaggagccacctcactgcagccaaaccaaagcgatcatttatagagtcaaatgtgtgaaccttaagaaatccccatttgtggaatttggaaacgtgtgttgactcctggtggtaaattaaatagtttttttcatcagaaaaattattttttagccattttttttctttggggtggatctgatgccattgatatatctaaaatgtgggataaaacttctttaatagctagaaatcaccataaataagaatgctaaacagaattgaaaattatatcaacttaaaattttaagacagcccagaagacattaatgactctcacttatgaaattgtttggcttttgccactttcttccttgcctttgctatatggtagaatcacagaacttacttagagaataaatatgtctattgttcaagagtaacaggtttaactcatgaccaagtgatgtacatccaagtgatgtattctggaaacgatggaattttacagttacagttccattgagtcaaatcccattttatatatacataaaaattaagttctgagtgagttctagctaaatataagtgcgactgtaaacgcagccaatttttttaagcagaatatgagaacacctaagtattctcttcatagcagttcctataaagggattaaacacttatttctgtgttatggttcttattcatatatttttatagcacttttggaacctatatttgtgcttgaaggtgtttttgatatttggaaacagtataagccatttggagtcatgattggtggtcaagtggattcaagctaaaatactaagaccagcattcttagtggcgcttataaattagctctcacctggtttccaaactgcttttaacaatggtagtgctcctggaacaatccttccaagctcctctaaggacaatatttaattcagatactaaaggtaagactggttgttacttttgttttgttgtacaattagtactttatagtcacatgttgtatatattaaatagcccagttttattcagacttgtaaatagaactatttcaatgtagttaatctaaaaacaaaaaagaaaaccccagtcacgatttgcatgttctctgtaagcttcatccatgctggttattgcactgaatgatatattattagggcatgttaacagtataccagtaacagcactttatctcatttatatgaacacctttgaggtgctacttaagtccaagctctgatgtattattcatttgtaaagataaggtacaggaatgaaccttggtttaaaggtatttttatatgaaaatggtgtgttattggaagatgttaaaatgctaatttgagagaagtaggagtgtatctgttttatatgttgggatgtgaaatttattttctaaaattgaggagaaggaagttatatatttgcagaatgttttaaagtgaattgttgtaatgaagttcctgtgaacatcattatggttttgtacaaataggaacctctgatgtcattcttcaacgtttgttcctgtgtgtacaattgtactttgtatgaacagctttatcatttttataggctttccatgagttttgctgtaactactatggcttatttattttctttaatatttgtgaaagtcttactcctttgttagttttgtttctgcacaactactgtacttttccatatggaataaagactattaatagaa

SEQ ID NO: 21158 - DNA, 1736 bp, Homo sapiens
  ENST00000464096
gtcaggaagcccaagtatgtggaaagccccagagtgcctggagatgcagttataatgccattcagagaagtagccaagccaacagagcctgatgagcatgaagcaaaggccgataatgaaccgagctgttcgccggcagctcaagaactgttgacaaggctgggatttttactgggagaagggatcccaagtgccacacacataaccattgaagacaaaaatgaaaccatggtaatgcccgaggaagacactacattgcatacctcttcagaggatgaacgaagcaataaccatcttctccctttccttgagcagggaagccattgttcagttaaatgagttctgggctgttgtgtattgaaatttatttcaacagtttggttctgggtttttgcagtggggaggtagggaaaagcagaaagaagcagaacgtaagaaaatgtccacattaaccttctagtcaccacccagagaataatggccacatgaattaaagaggctaaaagaatgccttcataatgctaccagtacttttacctttatagcaccgttcttctcatctggttgctttggtatacgctttcctgtgcctttttagctgttgagattttggagggtcagtggggtgaggaaaagatttataggagatgaggcagagacaaaataagatgagatcaaatggtccatctatcaggaaagcacttcccctccaagggagcagcagcatgcaccctgccacctcccagatgtgatgtgtgcatctgaatagcaatgcaggatggagcttctaccctggtgaaggtctctgcactgcaagggagggtgtcatgcattgattgagactgagtggtcaccagtctccttcccctgattgcagagcccataaatcttgaggaattgaatcaggttgcagtgttcgtgaaacatcacaaaaacagagctcccaggtcttccgtacagaggtcaaataacccatttgtcttctgcagacttcaaatgaaaggaagtctgcctgtttgccatttctgttgtacaaatgtgcatcctcactaaattattgctaagactgaccttttaataaaaaggaaaatcacaaaggaggggaaccgaacaaagatactgctttctcaaaatttggaagaccacatatacatttatatagataaagctccatgaatccatatctatacacacatatctctttagattttttttttaaaacttccgttttcctgttcttagttttattgttttagcacaaaaacaaaagcatgtgtcgaagcatcctgtgtaagccgtgctaactcctccttccattcatcttgcagtgcacagctctgagtcaaggcatcagtccttgctccacactaacaagcagcaccgcatctcctagcaccgatagcccctgctcaaccttgaatagctgtgtcagcaagacggcagccaacaaaagtccctgtgagaccattagcagccctagttccaccctggaaagcaaggacagtggaattataggtaagaagcacactgctcggtaacataatggctcgaatctcatcaaccagagcattcaccaggcacttcctcagagggttttagcatggtctgtgaaggtcagtctgccagcgcctgctctgttctttgcaggcagcactgactccatgtgtagctgagagagtggagcattggcttttacattccttgatgtttactttataacagtcagctcatttgtt

SEQ ID NO: 21159 - DNA, 2141 bp, Homo sapiens
  ENST00000465963
caaaatgtgctttgaggtaggaagggacctcctgtagagcggctttggcatgaggtcgacccgccctggggtggctccttttccctgtgttggcttggggccactgccccttcatgtttggctcacatggtccagaagcatcagggctcttttaacccagaatagtcaagccttggtttccttacccctgcagttttccagagcagctaaaaaacatccaagctggcaaaccattcttcctactccaaacattaggagcttttaccagtaagcaaggggtgggaagcttttcctttcttgaagatgctgccagcgtagtttcccttgtagctgccatcctgggtgcatgacttgcaaaactgatatgtgagtgacaataagccagatggcctttgcaaaagctctgcttattttgatttttgtggttccttacaaaaggcgaagtgagcattgatctttgttggtgctgttgtagctcaacggcaacatcactgtgttgtttcctcattttatttttcctaaaacctttacccattatctgcagattttcacatctaagcaaaataggttcatatgagtccagttacctagacaattaataaaaaagagcaaaatgttgagtgactatgtcataggttacttattgttaagttacagctttgtaagcagcttgctttgtaaatttttcatcccctgatggatgctgattttagaaggtgagagacgtgttagaaggatgtgaatatcgttttatttattggccataattaagtgcctttgggctttttgggtacagggttaaactacagctcaacatttaaatcaaatccaaccataaaattctcttaagtacaaaaaaaccagatgaccaacctcagggagaacccaagaaaaggtgggctttcccagcattgctgtgcagcattctgagaatacagcttgatttttctacatctttgcatgggcaacagtggtactgggtcctgtctcttgggacaagtttcactgtgattttaaatttttgtttcaacttggattcttcacgattgaccgtcaagttgaaatcctggttttgactttcactactgtgggatgtgcacaggaagttttccaccaaattttccacgtcgttcccctggcttgtttaatgagagcttggatttcagttttactccaacacctaaatagcctgggtctctaccagcatgccactagggttttacttcatttcagcctcctgtgggcattggacacccggcactctgtgagggtaacatgaaagataggcccttttcttacccaagctgatgtctgaagtacccgttttcacatgactcggaattaggaattgccgtcagataacactgggctcttctcactcaccctttgcacttggagtttttgttttactgtttccttaacctgtcacagtcccttaattagaatgtattgctagaggacagggtgcgttgtccaactttgtgcgcattttatagaaacacacaaaatcaccagacaaagcagctgtagtgtgaactcatccagatgcgatactgaaattccccagaggggcatcttcattgttttctttctttgttccagaagcaaaggccgataatgaaccgagctgttcgccggcagctcaagaactgttgacaaggctgggatttttactgggagaagggatcccaagtgccacacacataaccattgaagacaaaaatgaaaccatgtgcacagctctgagtcaaggcatcagtccttgctccacactaacaagcagcaccgcatctcctagcaccgatagcccctgctcaaccttgaatagctgtgtcagcaagacggcagccaacaaaagtccctgtgagaccattagcagccctagttccaccctggaaagcaaggacagtggaattataggtaagaagcacactgctcggtaacataatggctcgaatctcatcaaccagagcattcaccaggcacttcctcagagggttttagcatggtctgtgaaggtcagtctgccagcgcctgctctgttctttgcaggcagcactgactccatgtgtagctgagagagtggagcattggcttttacattccttgatgtttactttataacagtcagctcatttgtt

SEQ ID NO: 21160 - DNA, 4351 bp, Homo sapiens
  ENST00000470074
aagtcaatggcaccgacacattgtggggagaaacagccctgactgccgccgcaggaagagggaagctggaggtctgtgagctgctgctggggcatggagctgctgtgtcgcggacaaacaggagaggggttccacctttgttttgtgcagcacgccaggggcattggcagattgttagactgctgttggaacgcggctgtgatgtgaacctaagtgacaagcaaggccggacgcccctcatggtggctgcttgtgaagggcacttgagcaccgtggaattcctcctttcaaaaggtagcagcgtgatgccctcaaaggtttcttttggacggacacagagagaacttcagcagacccattcagtgctttctgattcaaattctaagttttctgttaatggaaattttctaataaacagtagagagaataggcaacacagccacatgcctggtattcctcttcagcagcgatgaccattctgccagcccatccggccagtgtcacccttcacagtgcttgactgacacttggttcaggccgggtgttccgcaggtgtgaaacaatttgctttctggctttgtcatctcataatgttcatgttctgtgaatgggctttcctttcaggtgcagccctttcttctctagacaaagagggtctgtcagcattaagctgggcttgtctgaaaggtcacagggcagtggtccagtatctggttgaagaaggagctgcaatagaccagacagacaagaatggccgcacacccttggacctggctgccttctatggcgatgccgagactgtgctgtacctggtggagaagggagccgtgatcgagcatgtggaccacagcgggatgcggcccttggacagagccatcggctgccggaacacatctgtagtggtggcgctactcagaaagggagccaagttaggaaatgctgcttgggcgatggccacttccaaacctgatatcttgattatacttttacagaaattaatggaggaaggaaatgtgatgtacaaaaaagggaaaatgaaagaggcagcccagaggtaccagtatgccttaagaaagtttcctcgagaaggattcggagaggacatgagacccttcaatgaattaagggtttccctctatctcaatttgtcgcgatgccgaagaaaaacaaatgactttggcatggcagaggaatttgcttccaaggctctcgaattgaagcccaagtcctatgaagccttttatgccagagcaagagcgaagagaaatagcaggcaattcgtggcagctctggctgacctgcaagaggctgtgaaactctgtcccaccaatcaggaagtcaagaggcttctggcccgcgtagaagaggagtgcaaacaactccagaggagtcaacagcaaaaacagcagggcccgctaccagctccactcaacgactccgagaacgaagaggacaccccaacccctggcttaagtgaccactttcactctgaggagactgaagaggaagaaacttctccccaggaagaatctgtttccccaactcccaggtcccagccatcctcatctgtcccttcctcatacatccgaaaccttcaagaagggttacagtccaaaggaaggccggtatcgccacagagcagggcaggaatcggcaagtccctgagagagcctgtggcccagccagggctgctcctgcagccctccaagcaggcccagatcgtgaaaaccagccagcacctgggctctggccagtcggcagtgagaaatggcagtatgaaagttcagatctcttctcagaaccctcctccaagtcccatgccagggagaatcgctgccactcctgctgggagcagaacccagcatttagagggaacaggtactttcactacaagagctggttgtggccactttggggatcggctgggccccagccagaatgtccgcctgcagtgtggtgagaatggccctgcacaccctttaccaagtaagacgaaaaccacagagaggcttctgtctcattcctccgtggctgtggacgcagcccctccaaaccaaggtgggctggcgacctgcagcgacgtgcgacacccagcttccctcaccagctcaggctcttctggttctccatccagcagcataaagatgtcaagttcaaccagtagtttgacttcgagcagcagtttttcagatggcttcaaggtccaaggaccagatactagaattaaagacaaggttgtaacccacgttcagagcggtacagctgagcacagaccccgcaacacgccgttcatgggcatcatggataagactgcgaggttccaacagcagagcaatcctccaagccgcagctggcactgtccggcaccagaggggctgctgacaaacacgtcttctgcagctggcctgcagtctgctaacactgagaagccctctctcatgcaagtgggaggatataataaccaagccaaaacctgttctgtttctaccctgagtgcaagtgtccacaatggggcacaagtgaaggagctagaagaaagcaagtgccaaattccagtccactctcaagagaacaggataactaagactgtttctcatctgtaccaggaaagtatctccaaacagcagcctcatattagtaatgaagcccacaggagccacctcactgcagccaaaccaaagcgatcatttatagagtcaaatgtgtgaaccttaagaaatccccatttgtggaatttggaaacgtgtgttgactcctggtggtaaattaaatagtttttttcatcagaaaaattattttttagccattttttttctttggggtggatctgatgccattgatatatctaaaatgtgggataaaacttctttaatagctagaaatcaccataaataagaatgctaaacagaattgaaaattatatcaacttaaaattttaagacagcccagaagacattaatgactctcacttatgaaattgtttggcttttgccactttcttccttgcctttgctatatggtagaatcacagaacttacttagagaataaatatgtctattgttcaagagtaacaggtttaactcatgaccaagtgatgtacatccaagtgatgtattctggaaacgatggaattttacagttacagttccattgagtcaaatcccattttatatatacataaaaattaagttctgagtgagttctagctaaatataagtgcgactgtaaacgcagccaatttttttaagcagaatatgagaacacctaagtattctcttcatagcagttcctataaagggattaaacacttatttctgtgttatggttcttattcatatatttttatagcacttttggaacctatatttgtgcttgaaggtgtttttgatatttggaaacagtataagccatttggagtcatgattggtggtcaagtggattcaagctaaaatactaagaccagcattcttagtggcgcttataaattagctctcacctggtttccaaactgcttttaacaatggtagtgctcctggaacaatccttccaagctcctctaaggacaatatttaattcagatactaaaggtaagactggttgttacttttgttttgttgtacaattagtactttatagtcacatgttgtatatattaaatagcccagttttattcagacttgtaaatagaactatttcaatgtagttaatctaaaaacaaaaaagaaaaccccagtcacgatttgcatgttctctgtaagcttcatccatgctggttattgcactgaatgatatattattagggcatgttaacagtataccagtaacagcactttatctcatttatatgaacacctttgaggtgctacttaagtccaagctctgatgtattattcatttgtaaagataaggtacaggaatgaaccttggtttaaaggtatttttatatgaaaatggtgtgttattggaagatgttaaaatgctaatttgagagaagtaggagtgtatctgttttatatgttgggatgtgaaatttattttctaaaattgaggagaaggaagttatatatttgcagaatgttttaaagtgaattgttgtaatgaagttcctgtgaacatcattatggttttgtacaaataggaacctctgatgtcattcttcaacgtttgttcctgtgtgtacaattgtactttgtatgaacagctttatcatttttataggctttccatgagttttgctgtaactactatggcttatttattttctttaatatttgtgaaagtcttactcctttgttagttttgtttctgcacaactactgtacttttccatatggaataaagactattaat

SEQ ID NO: 21161 - DNA, 7586 bp, Homo sapiens
  ENST00000496406
gaggagcggtgagctcccgattgtagaagcctagacagcacagagagtgacctgctcccaggttaggaagtaagatgtcagatgtttgcagatctctgtctcagtctcacttaatcaccattatacacaatgtgtaagtagctcacggtgtttctgcggggagggtgtggaaagcagaggctggtgttgaaggacagtctggagtggtatcagtggccaggaaccacgccagagaggaaccacagcctcttgctgtggggtggggccgggtagtgctgctgaaagctcccccaggtgactctgagcagcagcggaggctgagccactgttctagagccaccagtcagctgtgtggggaaatggccaccacagcaagtttctgtgaagaagtagtagtatgatttcatggagacaaactaggacgatacttgaggattgtgtgggggaccctgagtagggaaagccctttccacgtggctggctttgacacaaacacaccattccagatgtggggagggtcactattttggtttgatgtatggagcccttggtcaggagcagctctgggtagggcactgtgatgaaaatgctattcactaatactgtcaagcagtgaatagtgccaggaactatccaagcagtttcgccctctgccttaatccctaccacagccctgaaagtctcagtgacaatcccatgattttacagatgaggaaaccaaggcaccgagcagctaaatggcttcccccaggactgccttgtggtactcgccgtggggacctagcagctggctccagggctgtgctcttcagcactcctcccacagtgtcccgagagctcaggcaggggttagagaggttgtggccgagctgtagggtaggagagagaagccatgacatctcggagtacagcagatgacacagcacagggactgcgtgctgagaacacatgcctgcacggtggccgctgcaggaactgaggaggttatgctaaggcctcatttaattaattttccccacatcccacccggaagggaggaatgagttttcgctgctcggatgccttcgtttctcattacttttttcagtaaaataacaaggacagatttgagtgcccaggtcagtgggaaaggattagcaacagcctcgccggcgtcctgctccctccctcatcgtgctgtggtccttgcagctgggctcctgctggtgctgacctccagccgtggggccacggaggaattgggatcctttccgcagggcctctgaagtgcctctgaatgcgtgtttgttttgcaggaaatgctgcttgggcgatggccacttccaaacctgatatcttgattatacttttacagaaattaatggaggaaggaaatgtgatgtacaaagtaagtggttccgcccttttctttgccattgaaactgcctgggagcaccctcttaattgggtacataatggctacagctgtgctactgcacagtctccatgtaatagaagtgcaaaaagtggctgggtggggtggctcacgcctgtaactccagcacttttggaggccgaggtgggcagatcacttgaggccaggaattccagaccaacctggccaatatggcaaaaccccatctttactaaaaatacaaaaatcagccaggtgcctgtaatcccagctactcgggaggctgaggcaggagaattgtttcaatctgggaggcagaggttgcagtgagctgagattgcaccactgcactccagcctcagcaacagagtgagactcagtctcagaagaaaaaaaaaaaaagtgccaagaggtgctgacctggcctcatgcccgttgttggcttaatatctttccggcagaatcttaaaggtagaaagcacctctctttgtgtctgagagccattatttctgagctaatccttgaggttgtagtggtgacttcctgtctgaagccatggcgtgaagctgagtcacctctaggtcaactgaacatcatagagaaggttcctcagcccttcacattctgagttcagaacaccatgctgaggcacagtcatgagacgtgggagaggaacacccagcagacatttctagaagaaaagggttattctgtctcctaagcctttcctaatttttaatatctattaatttctagaatttgaaagtgttgttagagatttttacttaatacagtcaagtaatacctcagttactcagaagactgaattaattttttccattttcccttggaaatggaaatatgatttacagatcaataaacttcactttaaatttttccaaataagacatcagtttaggtcagaggtcagcaaactttttttgtaaagggccagacagtaaatgttttaggctttgcagactgtgtggcctctgtcacaactccccagttctgatgtgggggcacagatagcacagagtgaatgaacacagctgtgtcccaataaaactttatttgtaaacacaggtggctggccagacttagtatccaagctatagtttgccaacccctggtttagatagatatgcaggccatttgcataggtcactattctttgcagctctgtgattagacagaattaaaagattataggggaaaaactagattatgaccatgttaatcctttttactgttaggcagctgtatttggtatgttgtagattttttccttctcattttttaaaatagtaacaaataaataggcaatatagcatgacccagcagggttcctggcttggaatcagcttgaaattgagttgagtgtattgttgtggctttgaagtgcttttaatatggattggtaggcaattatgtcagaaataggaagccattttcaacaggcttcatacctgctgtgcaatgggactgactgagcaaatggatttttttagctttgaaaatgatgtgtggtgctgttctgatttttaaagcccatgttttaattcctcttagaagaaaaattattattctgcagcaagctctctaggtttatctacaagatgctacttgtcctaggaataggatcagtttttcatctgatttctattacacttagcattcaaatagatttgagatcattcttgaaataattttcaaaaatacataccagaaggtaatctgattcattaagtttggtaattatcaatctagcagtttacagacaccttattgtaaaaccagcttctttctcactgtgtaaccacaggatgcgggtgcatgtgaggacagtgaagccctcatgtgccagcccagttagtgaactagctcccaccttgacacttgtttggatgctttcaatgttctgtcgtgggtttgcaggggggagtaaactccccacggtgttccaggtgtgggagttattcattttagaacctctgaaaaaggacaaatgtttgtgatttttgaatcctagaaagggaaaatgaaagaggcagcccagaggtaccagtatgccttaagaaagtttcctcgagaaggattcggagaggacatgagacccttcaatgaattaagggtttccctctatctcaatttgtcgcgatgccgaagaaaaacaaatgtaagctgtgcccctttattccaacccagtcttccagcaacagagcccttctccagcagtgaaggccagcccttctccagaccagatcctgggccctcctgtccaatttgcttgcacatttacatgaacctggcatgtgggaaacagctcctatccgtgactatcgtttggtcacggctgctacgctcctcgcatgatgttgaaggaatgcacttgggtttcgtttccttggcctcagtaatgagaagcaaatgcagtctgctcctctgcagcttcccaacactgttgctgctggcactgccgtccccggattcaggagagtccaacccaagcctattgtggtgggcctgccttctgtgttaggtttgctcagagggtctgccagtaactaatttgtaaccggtcgtggggaactcatagtcgatttgtaactagtagatctgtttcagtagtacttcctaccttttttttaactgtgtcctcctgccccagtctgttgagctgcttgcttctgtgccctgctgccggaatagatgcagtgtctgcgctcctctctgaggctgcccctccaccgggctgtgaggttccaccatctggccttcttggggcactgttactaccactgttttcatagtggattcttctcctaatgatattaatcaaccatcattatctcctcactttaaaacaagatagaaaacggaactttcccttcctccctctctggctgtgcctcagagcgctgctaccctttagaacaaaactagacgggcttcccacaatcgtgtgtccaggctgcttctgactcctgtatttcttgtcgacaccaggactttggcatggcagaggaatttgcttccaaggctctcgaattgaagcccaagtcctatgaagccttttatgccagagcaagagcgaagagaaatagcaggcaattcgtggcagctctggctgacctgcaagaggctgtgaaactctgtcccaccaatcaggaagtcaagaggcttctggcccgcgtagaagaggagtgcaaacaactccagaggagtcaacagcaaaaacagcagggcccgctaccagctccactcaacgactccgagaacgaagaggacaccccaacccctggcttaagtgaccactttcactctgaggagactgaagaggaagaaacttctccccaggaagaatctgtttccccaactcccaggtcccagccatcctcatctgtcccttcctcatacatccgaaaccttcaagaagggttacagtccaaaggaaggccggtatcgccacagagcagggcaggaatcggcaagtccctgagagagcctgtggcccagccagggctgctcctgcagccctccaagcaggcccagatcgtgaaaaccagccagcacctgggctctggccagtcggcagtgagaaatggcagtatgaaagttcagatctcttctcagaaccctcctccaagtcccatgccagggagaatcgctgccactcctgctgggagcagaacccagcatttagagggaacaggtactttcactacaagagctggttgtggccactttggggatcggctgggccccagccagaatgtccgcctgcagtgtggtgagaatggccctgcacaccctttaccaagtaagacgaaaaccacagagaggcttctgtctcattcctccgtggctgtggacgcagcccctccaaaccaaggtgggctggcgacctgcagcgacgtgcgacacccagcttccctcaccagctcaggctcttctggttctccatccagcagcataaagatgtcaagttcaaccagtagtttgacttcgagcagcagtttttcagatggcttcaaggtccaaggaccagatactagaattaaagacaaggttgtaacccacgttcagagcggtacagctgagcacagaccccgcaacacgccgttcatgggcatcatggataagactgcgaggttccaacagcagagcaatcctccaagccgcagctggcactgtccggcaccagaggggctgctgacaaacacgtcttctgcagctggcctgcagtctgctaacactgagaagccctctctcatgcaagtgggaggatataataaccaagccaaaacctgttctgtttctaccctgagtgcaagtgtccacaatggggcacaagtgaaggagctagaagaaagcaagtgccaaattccagtccactctcaagagaacaggataactaagactgtttctcatctgtaccaggaaagtatctccaaacagcagcctcatattagtaatgaagcccacaggagccacctcactgcagccaaaccaaagcgatcatttatagagtcaaatgtgtgaaccttaagaaatccccatttgtggaatttggaaacgtgtgttgactcctggtggtaaattaaatagtttttttcatcagaaaaattattttttagccattttttttctttggggtggatctgatgccattgatatatctaaaatgtgggataaaacttctttaatagctagaaatcaccataaataagaatgctaaacagaattgaaaattatatcaacttaaaattttaagacagcccagaagacattaatgactctcacttatgaaattgtttggcttttgccactttcttccttgcctttgctatatggtagaatcacagaacttacttagagaataaatatgtctattgttcaagagtaacaggtttaactcatgaccaagtgatgtacatccaagtgatgtattctggaaacgatggaattttacagttacagttccattgagtcaaatcccattttatatatacataaaaattaagttctgagtgagttctagctaaatataagtgcgactgtaaacgcagccaatttttttaagcagaatatgagaacacctaagtattctcttcatagcagttcctataaagggattaaacacttatttctgtgttatggttcttattcatatatttttatagcacttttggaacctatatttgtgcttgaaggtgtttttgatatttggaaacagtataagccatttggagtcatgattggtggtcaagtggattcaagctaaaatactaagaccagcattcttagtggcgcttataaattagctctcacctggtttccaaactgcttttaacaatggtagtgctcctggaacaatccttccaagctcctctaaggacaatatttaattcagatactaaaggtaagactggttgttacttttgttttgttgtacaattagtactttatagtcacatgttgtatatattaaatagcccagttttattcagacttgtaaatagaactatttcaatgtagttaatctaaaaacaaaaaagaaaaccccagtcacgatttgcatgttctctgtaagcttcatccatgctggttattgcactgaatgatatattattagggcatgttaacagtataccagtaacagcactttatctcatttatatgaacacctttgaggtgctacttaagtccaagctctgatgtattattcatttgtaaagataaggtacaggaatgaaccttggtttaaaggtatttttatatgaaaatggtgtgttattggaagatgttaaaatgctaatttgagagaagtaggagtgtatctgttttatatgttgggatgtgaaatttattttctaaaattgaggagaaggaagttatatatttgcagaatgttttaaagtgaattgttgtaatgaagttcctgtgaacatcattatggttttgtacaaataggaacctctgatgtcattcttcaacgtttgttcctgtgtgtacaattgtactttgtatgaacagctttatcatttttataggctttccatgagttttgctgtaactactatggcttatttattttctttaatatttgtgaaagtcttactcctttgttagttttgtttctgcacaactactgtacttttccatatggaataaagactattaatagaa

SEQ ID NO: 21162 - DNA, 5169 bp, Homo sapiens
  ENST00000308893
accgccagtcgtgggacagagtgccgggctcctccccttgcaagtctagctcttctccccgcctcctccggcctggggtccgcgtggcggggcgggcgcgcactcgggcttggcggctgccggtctcccaggccgcggcagtgaggagagagggcggggctgagtcctctgcgcccccgccccctttagcccggcgtccctaccgcgcctgcgcgctcccgcccggtctccatcttggaattgggaggaagagggagagggagaccgggacgagaccggggctgtggtgcggagagaggctgagacggagaagaggagaggcagagagggcgcggggaccgtcagcagcaccttagctacaatcgttcagctattctcggaagagagaagggagagggaggaggccggggcgggagtgggggctgtcaccctcggaccccggcgtgagaggggccgtgcggccggacgtcctcggggtgggcccccagtcggtggccgaagacctacagctcaggcccctgggtcccaaatttccaggctttgcccctcctcctttctcagatacccgggtaacagtcctcatagtccagatatccgggactcgggtcccaacctctctaaacctgggtctctgtttcatagaatttcaaatatcaggttcaggcccctgcgtgcaccagtatccggggttcattccccgggcgttcaaatatcggattcagtctccatcccgttcagatattcggggttcagaccccacaatcagaaatccggaattcggcagctgtcgccctcgacgagggggaggactggaccgcgaggtcagattaggttgtcaccccctcccctccaggggaggcttcccgggcccgcccctcaggaagggcgaaagccgaggaagaggtggcaaggggaaaggtctccttgcccctctccctgcttggcagagccgctggaggaccccaggcggaagcggaggcgctggggcaccatagtgacccctaccaggccaggccccactctcagggcccccaggggccaccatgccagctgggggccgggccgggagcctgaaggacccagatgtggctgagctcttcttcaaggatgacccagaaaagctcttctctgacctccgggaaattggccatggcagctttggagccgtatactttgcccgggatgtccggaatagtgaggtggtggccatcaagaagatgtcctacagtgggaagcagtccaatgagaaatggcaagacatcatcaaggaggtgcggttcttacagaagctccggcatcccaacaccattcagtaccggggctgttacctgagggagcacacggcttggctggtaatggagtattgcctgggctcagcttctgaccttctagaagtgcacaagaaaccccttcaggaggtagagatcgcagctgtgacccacggggcgcttcagggcctggcatatctgcactcccacaacatgatccatagggatgtgaaggctggaaacatcctgctgtcagagccagggttagtgaagctaggggactttggttctgcgtccatcatggcacctgccaactccttcgtgggcaccccatactggatggcacccgaggtgatcctggccatggatgaggggcagtacgatggcaaagtggacgtctggtccttggggataacctgcatcgagctggctgaacggaaaccaccgctctttaacatgaatgcgatgagtgccttataccacattgcacagaacgaatcccccgtgctccagtcaggacactggtctgagtacttccggaattttgtcgactcctgtcttcagaaaatccctcaagacagaccaacctcagaggttctcctgaagcaccgctttgtgctccgggagcggccacccacagtcatcatggacctgatccagaggaccaaggatgccgtgcgggagctggacaacctgcagtaccgcaagatgaagaagatcctgttccaagaggcacccaacggccctggtgccgaggccccagaggaggaagaggaggccgagccctacatgcaccgggccgggactctgaccagcctcgagagtagccactcagtgcccagcatgtccatcagcgcctccagccagagcagctccgtcaacagcctagcagatgcctcagacaacgaggaagaggaggaggaggaggaggaagaggaggaggaggaagaaggccctgaagcccgggagatggccatgatgcaggagggggagcacacagtcacctctcacagctccattatccaccggctgccgggctctgacaacctatatgatgacccctaccagccagagataacccccagccctctccagccgcctgcagccccagctcccacttccaccacctcttccgcccgccgccgggcctactgccgtaaccgagaccactttgccaccatccgaaccgcctccctggtcagccgtcagatccaggagcatgagcaggactctgcgctgcgggagcagctgagcggctataagcggatgcgacgacagcaccagaagcagctgctggccctggagtcacggctgaggggtgaacgggaggagcacagtgcacggctgcagcgggagcttgaggcgcagcgggctggctttggggcagaggcagaaaagctggcccggcggcaccaggccataggtgagaaggaggcacgagctgcccaggccgaggagcggaagttccagcagcacatccttgggcagcagaagaaggagctggctgccctgctggaggcacagaagcggacctacaaacttcgcaaggaacagctgaaggaggagctccaggagaaccccagcactcccaagcgggagaaggccgagtggctgctgcggcagaaggagcagctccagcagtgccaggcggaggaggaagcagggctgctgcggcggcagcgccagtactttgagctgcagtgtcgccagtacaagcgcaagatgttgctggctcggcacagcctggaccaggacctgctgcgggaggacctgaacaagaagcagacccagaaggacttggagtgtgcactgctgcttcggcagcacgaggccacgcgggagctggagctgcggcagctccaggccgtgcagcgcacgcgggctgagctcacccgcctgcagcaccagacggagctgggcaaccagctggagtacaacaagcggcgtgagcaagagttgcggcagaagcatgcggcccaggttcgccagcagcccaagagcctcaaagtacgtgcaggccagcgccccccgggccttccactccccattcctggggctctgggcccacccaacacaggcacccctatagaacagcagccctgctcacctggccaggaggcagtcctggaccaaagaatgcttggcgaggaggaggaagcagttggagagagaaggattctgggaaaggaaggggccactttggagcccaagcagcagaggattctgggggaagaatcaggagcccctagtcccagtccacaaaaacatgggagcctggttgatgaggaagtttggggtctgcctgaggagatagaggagcttagggtgccctcccttgtaccccaggagaggagcattgttggccaggaggaggctgggacatggagcttgtgggggaaggaggatgagagtcttctggatgaggagtttgagcttggctgggtccagggcccagcactgactcccgtccctgaggaggaggaagaagaggaagagggggctccgattgggacccctagggatcctggagatggttgtccttcccccgacatccctcctgaaccccctccaacacacctgaggccctgccctgccagccagctccctggactcctgtcccatggcctcctggccggcctctcctttgcagtggggtcctcctctggcctcctgcccctcctgctgctgctgctgcttccattgctggcagcccagggtgggggtggcctgcaggcagcgctgctggcccttgaggtggggctggtgggtctgggggcctcctacctgctcctttgtacagccctgcacctgccctccagtcttttcctactcctggcccagggtaccgcactgggggccgtcctgggcctgagctggcgccgaggcctcatgggtgttcccctgggccttggagctgcctggctcttagcttggccaggcctagctctacctctggtggctatggcagcggggggcagatgggtgcggcagcagggcccccgggtgcgccggggcatatctcgactctggttgcgggttctgctgcgcctgtcacccatggccttccgggccctgcagggctgtggggctgtgggggaccggggtctgtttgcactgtaccccaaaaccaacaaggatggcttccgcagccgcctgcccgtccctgggccccggcggcgtaatccccgcaccacccaacacccattagctctgttggcaagggtctgggtcctgtgcaagggctggaactggcgtctggcacgggccagccagggtttagcatcccacttgcccccgtgggccatccacacactggccagctggggcctgcttcggggtgaacggcccacccgaatcccccggctactaccacgcagccagcgccagctagggccccctgcctcccgccagccactgccagggactctagccgggcggaggtcacgcacccgccagtcccgggccctgcccccctggaggtagctgactccagcccttccagcccaaatctagagcattgagcactttatctcccacgactcagtgaagtttctccagtccctagtcctctcttttcacccaccttcctcagtttgctcacttaccccaggcccagcccttcggacctctagacaggcagcctcctcagctgtggagtccagcagtcactctgtgttctcctggcgctcctcccctaagttattgctgttcgcccgctgtgtgtgctcatcctcaccctcattgactcaggcctggggccaggggtggtggagggtgggaagagtcatgttttttttctcctctttgattttgtttttctgtctcccttccaacctgtccccttccccccaccaaaaaaagaaaaagacaaacacaaataaaatatctgagcggaactgtg

SEQ ID NO: 21163 - DNA, 4072 bp, Homo sapiens
  ENST00000543033
tgcccctcctcctttctcagatacccgggtaacagtcctcatagtccagatatccgggactcgggtcccaacctctctaaacctgggtctctgtttcatagaatttcaaatatcaggttcaggcccctgcgtgcaccagtatccggggttcattccccgggcgttcaaatatcggattcagtctccatcccgttcagatattcggggttcagaccccacaatcagaaatccggaattcggcagctgtcgccctcgacgagggggaggactggaccgcgaggtcagattaggttgtcaccccctcccctccaggggaggcttcccgggcccgcccctcaggaagggcgaaagccgaggaagaggtggcaaggggaaaggtctccttgcccctctccctgcttggcagagccgctggaggaccccaggcggaagcggaggcgctggggcaccatagtgacccctaccaggccaggccccactctcagggcccccaggggccaccatgccagctgggggccgggccgggagcctgaaggacccagatgtggctgagctcttcttcaaggatgacccagaaaagctcttctctgacctccgggaaattggccatggcagctttggagccgtatactttgcccgggatgtccggaatagtgaggtggtggccatcaagaagatgtcctacagtgggaagcagtccaatgagaaatggcaagacatcatcaaggaggtgcggttcttacagaagctccggcatcccaacaccattcagtaccggggctgttacctgagggagcacacggcttggctggtaatggagtattgcctgggctcagcttctgaccttctagaagtgcacaagaaaccccttcaggaggtagagatcgcagctgtgacccacggggcgcttcagggcctggcatatctgcactcccacaacatgatccatagggatgtgaaggctggaaacatcctgctgtcagagccagggttagtgaagctaggggactttggttctgcgtccatcatggcacctgccaactccttcgtgggcaccccatactggatggcacccgaggtgatcctggccatggatgaggggcagtacgatggcaaagtggacgtctggtccttggggataacctgcatcgagctggctgaacggaaaccaccgctctttaacatgaatgcgatgagtgccttataccacattgcacagaacgaatcccccgtgctccagtcaggacactggtctgagtacttccggaattttgtcgactcctgtcttcagaaaatccctcaagacagaccaacctcagaggttctcctgaagcaccgctttgtgctccgggagcggccacccacagtcatcatggacctgatccagaggaccaaggatgccgtgcgggagctggacaacctgcagtaccgcaagatgaagaagatcctgttccaagaggcacccaacggccctggtgccgaggccccagaggaggaagaggaggccgagccctacatgcaccgggccgggactctgaccagcctcgagagtagccactcagtgcccagcatgtccatcagcgcctccagccagagcagctccgtcaacagcctagcagatgcctcagacaacgaggaagaggaggaggaggaggaggaagaggaggaggaggaagaaggccctgaagcccgggagatggccatgatgcaggagggggagcacacagtcacctctcacagctccattatccaccggctgccgggctctgacaacctatatgatgacccctaccagccagagataacccccagccctctccagccgcctgcagccccagctcccacttccaccacctcttccgcccgccgccgggcctactgccgtaaccgagaccactttgccaccatccgaaccgcctccctggtcagccgtcagatccaggagcatgagcaggactctgcgctgcgggagcagctgagcggctataagcggatgcgacgacagcaccagaagcagctgctggccctggagtcacggctgaggggtgaacgggaggagcacagtgcacggctgcagcgggagcttgaggcgcagcgggctggctttggggcagaggcagaaaagctggcccggcggcaccaggccataggtgagaaggaggcacgagctgcccaggccgaggagcggaagttccagcagcacatccttgggcagcagaagaaggagctggctgccctgctggaggcacagaagcggacctacaaacttcgcaaggaacagctgaaggaggagctccaggagaaccccagcactcccaagcgggagaaggccgagtggctgctgcggcagaaggagcagctccagcagtgccaggcggaggaggaagcagggctgctgcggcggcagcgccagtactttgagctgcagtgtcgccagtacaagcgcaagatgttgctggctcggcacagcctggaccaggacctgctgcgggaggacctgaacaagaagcagacccagaaggacttggagtgtgcactgctgcttcggcagcacgaggccacgcgggagctggagctgcggcagctccaggccgtgcagcgcacgcgggctgagctcacccgcctgcagcaccagacggagctgggcaaccagctggagtacaacaagcggcgtgagcaagagttgcggcagaagcatgcggcccaggttcgccagcagcccaagagcctcaaagagaggagcattgttggccaggaggaggctgggacatggagcttgtgggggaaggaggatgagagtcttctggatgaggagtttgagcttggctgggtccagggcccagcactgactcccgtccctgaggaggaggaagaagaggaagagggggctccgattgggacccctagggatcctggagatggttgtccttcccccgacatccctcctgaaccccctccaacacacctgaggccctgccctgccagccagctccctggactcctgtcccatggcctcctggccggcctctcctttgcagtggggtcctcctctggcctcctgcccctcctgctgctgctgctgcttccattgctggcagcccagggtgggggtggcctgcaggcagcgctgctggcccttgaggtggggctggtgggtctgggggcctcctacctgctcctttgtacagccctgcacctgccctccagtcttttcctactcctggcccagggtaccgcactgggggccgtcctgggcctgagctggcgccgaggcctcatgggtgttcccctgggccttggagctgcctggctcttagcttggccaggcctagctctacctctggtggctatggcagcggggggcagatgggtgcggcagcagggcccccgggtgcgccggggcatatctcgactctggttgcgggttctgctgcgcctgtcacccatggccttccgggccctgcagggctgtggggctgtgggggaccggggtctgtttgcactgtaccccaaaaccaacaaggatggcttccgcagccgcctgcccgtccctgggccccggcggcgtaatccccgcaccacccaacacccattagctctgttggcaagggtctgggtcctgtgcaagggctggaactggcgtctggcacgggccagccagggtttagcatcccacttgcccccgtgggccatccacacactggccagctggggcctgcttcggggtgaacggcccacccgaatcccccggctactaccacgcagccagcgccagctagggccccctgcctcccgccagccactgccagggactctagccgggcggaggtcacgcacccgccagtcccgggccctgcccccctggaggtagctgactccagcccttccagcccaaatctagagcattgagcactttatctcccacgactcagtgaagtttctccagtccctagtcctctcttttcacccaccttcctcagtttgctcacttaccccaggcccagcccttcggacctctagacaggcagcctcctcagctgtggagtccagcagtcactctgtgttctcctgg

SEQ ID NO: 21164 - DNA, 4246 bp, Homo sapiens
  ENST00000279394
agaatttcaaatatcaggttcaggcccctgcgtgcaccagtatccggggttcattccccgggcgttcaaatatcggattcagtctccatcccgttcagatattcggggttcagaccccacaatcagaaatccggaattcggcagctgtcgccctcgacgagggggaggactggaccgcgaggtcagattaggttgtcaccccctcccctccaggggaggcttcccgggcccgcccctcaggaagggcgaaagccgaggaagaggtggcaaggggaaaggtctccttgcccctctccctgcttggcagagccgctggaggaccccaggcggaagcggaggcgctggggcaccatagtgacccctaccaggccaggccccactctcagggcccccaggggccaccatgccagctgggggccgggccgggagcctgaaggacccagatgtggctgagctcttcttcaaggatgacccagaaaagctcttctctgacctccgggaaattggccatggcagctttggagccgtatactttgcccgggatgtccggaatagtgaggtggtggccatcaagaagatgtcctacagtgggaagcagtccaatgagaaatggcaagacatcatcaaggaggtgcggttcttacagaagctccggcatcccaacaccattcagtaccggggctgttacctgagggagcacacggcttggctggtaatggagtattgcctgggctcagcttctgaccttctagaagtgcacaagaaaccccttcaggaggtagagatcgcagctgtgacccacggggcgcttcagggcctggcatatctgcactcccacaacatgatccatagggatgtgaaggctggaaacatcctgctgtcagagccagggttagtgaagctaggggactttggttctgcgtccatcatggcacctgccaactccttcgtgggcaccccatactggatggcacccgaggtgatcctggccatggatgaggggcagtacgatggcaaagtggacgtctggtccttggggataacctgcatcgagctggctgaacggaaaccaccgctctttaacatgaatgcgatgagtgccttataccacattgcacagaacgaatcccccgtgctccagtcaggacactggtctgagtacttccggaattttgtcgactcctgtcttcagaaaatccctcaagacagaccaacctcagaggttctcctgaagcaccgctttgtgctccgggagcggccacccacagtcatcatggacctgatccagaggaccaaggatgccgtgcgggagctggacaacctgcagtaccgcaagatgaagaagatcctgttccaagaggcacccaacggccctggtgccgaggccccagaggaggaagaggaggccgagccctacatgcaccgggccgggactctgaccagcctcgagagtagccactcagtgcccagcatgtccatcagcgcctccagccagagcagctccgtcaacagcctagcagatgcctcagacaacgaggaagaggaggaggaggaggaggaagaggaggaggaggaagaaggccctgaagcccgggagatggccatgatgcaggagggggagcacacagtcacctctcacagctccattatccaccggctgccgggctctgacaacctatatgatgacccctaccagccagagataacccccagccctctccagccgcctgcagccccagctcccacttccaccacctcttccgcccgccgccgggcctactgccgtaaccgagaccactttgccaccatccgaaccgcctccctggtcagccgtcagatccaggagcatgagcaggactctgcgctgcgggagcagctgagcggctataagcggatgcgacgacagcaccagaagcagctgctggccctggagtcacggctgaggggtgaacgggaggagcacagtgcacggctgcagcgggagcttgaggcgcagcgggctggctttggggcagaggcagaaaagctggcccggcggcaccaggccataggtgagaaggaggcacgagctgcccaggccgaggagcggaagttccagcagcacatccttgggcagcagaagaaggagctggctgccctgctggaggcacagaagcggacctacaaacttcgcaaggaacagctgaaggaggagctccaggagaaccccagcactcccaagcgggagaaggccgagtggctgctgcggcagaaggagcagctccagcagtgccaggcggaggaggaagcagggctgctgcggcggcagcgccagtactttgagctgcagtgtcgccagtacaagcgcaagatgttgctggctcggcacagcctggaccaggacctgctgcgggaggacctgaacaagaagcagacccagaaggacttggagtgtgcactgctgcttcggcagcacgaggccacgcgggagctggagctgcggcagctccaggccgtgcagcgcacgcgggctgagctcacccgcctgcagcaccagacggagctgggcaaccagctggagtacaacaagcggcgtgagcaagagttgcggcagaagcatgcggcccaggttcgccagcagcccaagagcctcaaatctaaggagctgcagatcaagaagcagttccaggagacgtgtaagatccagactcggcagtacaaggctctgcgagcacacttgctggagaccacgcccaaagctcagcacaagagcctccttaagcggctcaaggaagagcagacccgcaagctggcgatcttggcggagcagtatgaccagtccatctcagagatgctcagctcacaggcgctgcggcttgatgagacccaggaggcagagttccaggcccttcggcagcagcttcaacaggagctggagctgctcaacgcttaccagagcaagatcaagatccgcacagagagccagcacgagagggagctgcgggagctggagcagagggtcgcgctgcggcgggcactgctggagcagcgggtggaagaggagctgctggccctgcagacaggacgctccgagcgaatccgcagtctgcttgagcggcaggcccgtgagatcgaggccttcgatgcggaaagcatgaggctgggcttctccagcatggctctggggggcatcccggctgaagctgctgcccagggctatcctgctccaccccctgccccagcctggccctcccgtcccgttccccgttctggggcacactggagccatggccctcctccaccaggcatgccccctccagcctggcgtcagccgtctctgctggctcccccaggccccccaaactggctggggccccccacacaaagtgggacaccccgtggcggagccctgctgctgctaagaaacagcccccagcccctgcggcgggcagcctcggggggcagtggcagtgagaatgtgggcccccctgctgccgcggtgcccgggcccctgagccgcagcaccagtgtcgcttcccacatcctcaatggttcttcccacttctattcctgaggtgcagcggggaggagcagatgagctgggcagggcaggggtgggtggagcctgaccctggagggcactgagctggaggcccctgcaagggtaggggacaagatgtaggctccagctcccctcagacctcctcatctcatgagcttcttggggctggccagtggcccagggccagcttggcgataggtgcctcaaggctgcctgggagccccgcctccctaccatggtgccaggggtctccctccgccacctaggaaaggagggagatgtgcgtgtcaaatattcatctagtcccctgggggaggggaagggtgggtctagacatactatattcagagaactatactaccctcacagtgaggccctcagacctgccacagggcagagcaggtctggggcctgaggcagggagaatgagaggccaccttactggcaggaaggatcaggatggggtcttggggtcaggatgcctgggtctcttcccgtaactgtctgacgtcctgtgccgtcttgtcctttatctttttttttttttttttaattgggatcagggctggggcggggaaacaagggaaggaccttggaaggggctgctcccaggcctggggggcagtcgtgggagcccctctcagctgtggggctggcacagagccccaggcaagcttttaataaactgttggttattctaacaga

SEQ ID NO: 21165 - DNA, 4780 bp, Homo sapiens
  ENST00000416441
ctcccttccagtctgtcttaagtactgatgccagagaggtctgcctaagctcagtgctgtcatttcactccctgtttggagccatgagtggccccctgttgccttcaagactgaagccatccccatccttcctcccaccaacctagaggctttgcttcgtaaatgctggccctttccttcatgggctccaccctctgagtgtgtcatgaactcttccacttccttgccttggttcgtattgggtcctctgcccgaggtcagagatttggacgagcccttctcctccatcttcacagtctccatttaccattagatgccaggcccagacagttgatgaaaaatgtaagaaacggacccaagtataagaaaaagctagatctgtccattttatttctagtttttggaagagatgtggatacagagaaatattactctactattgaaaaaaatatatatcagtctgattataaatgtcaactcatactaagtcaatatcagggaagcagtgtggagaaggatgtggcaaactggagattgctgtttccatagaaagagggcagctaatgcttatctccagaccattgttatgcagtaatgtagactccatttcaccagatttaattcttaaggagaaactggaaacttgtattattatttgattattacttttggcagttaattttaaaaatcaccgtttaggccaaaacaacatgacatttgtctgggctacaagggactcttagcgactcttagcttgcacttacctttctaatctcagggctttttacaaagcccttctctgaattccctgaagatatgctagcttgaaggctcactgcatactctcaacttcccagccacttccctgtttccctcttataccagttaatactttgatgttattttttcagtcctatttaatcttttagactggaggttccttgagggtggggcctaattcttgtttttatcttccccatagcaattatcaagttatctgctccctttggcacctaagaaatattagttggggtgataactgaatggctgtccttctgccttcgttactgcttttgtggatgttattttctttgacccctattccacccgtgtgcagtggagaggatgggtgttgtattttacagaggaaggaattaactgagacgcaacaggatgatgggaacttctcaaggtcatgtggcaaggaagtcaaggaattggggtttgaacccaagtcgtctcagttccattccattgtcctctaccccctgccacctctcaccttcttccctttcacctttttctgtagctgaacggaaaccaccgctctttaacatgaatgcgatgagtgccttataccacattgcacagaacgaatcccccgtgctccagtcaggacactggtctgagtacttccggaattttgtcgactcctgtcttcagaaaatccctcaagacagaccaacctcagaggttctcctgaagcaccgctttgtgctccgggagcggccacccacagtcatcatggacctgatccagaggaccaaggatgccgtgcgggagctggacaacctgcagtaccgcaagatgaagaagatcctgttccaagaggcacccaacggccctggtgccgaggccccagaggaggaagaggaggccgagccctacatgcaccgggccgggactctgaccagcctcgagagtagccactcagtgcccagcatgtccatcagcgcctccagccagagcagctccgtcaacagcctagcagatgcctcagacaacgaggaagaggaggaggaggaggaggaagaggaggaggaggaagaaggccctgaagcccgggagatggccatgatgcaggagggggagcacacagtcacctctcacagctccattatccaccggctgccgggctctgacaacctatatgatgacccctaccagccagagataacccccagccctctccagccgcctgcagccccagctcccacttccaccacctcttccgcccgccgccgggcctactgccgtaaccgagaccactttgccaccatccgaaccgcctccctggtcagccgtcagatccaggagcatgagcaggactctgcgctgcgggagcagctgagcggctataagcggatgcgacgacagcaccagaagcagctgctggccctggagtcacggctgaggggtgaacgggaggagcacagtgcacggctgcagcgggagcttgaggcgcagcgggctggctttggggcagaggcagaaaagctggcccggcggcaccaggccataggtgagaaggaggcacgagctgcccaggccgaggagcggaagttccagcagcacatccttgggcagcagaagaaggagctggctgccctgctggaggcacagaagcggacctacaaacttcgcaaggaacagctgaaggaggagctccaggagaaccccagcactcccaagcgggagaaggccgagtggctgctgcggcagaaggagcagctccagcagtgccaggcggaggaggaagcagggctgctgcggcggcagcgccagtactttgagctgcagtgtcgccagtacaagcgcaagatgttgctggctcggcacagcctggaccaggacctgctgcgggaggacctgaacaagaagcagacccagaaggacttggagtgtgcactgctgcttcggcagcacgaggccacgcgggagctggagctgcggcagctccaggccgtgcagcgcacgcgggctgagctcacccgcctgcagcaccagacggagctgggcaaccagctggagtacaacaagcggcgtgagcaagagttgcggcagaagcatgcggcccaggttcgccagcagcccaagagcctcaaagtacgtgcaggccagcgccccccgggccttccactccccattcctggggctctgggcccacccaacacaggcacccctatagaacagcagccctgctcacctggccaggaggcagtcctggaccaaagaatgcttggcgaggaggaggaagcagttggagagagaaggattctgggaaaggaaggggccactttggagcccaagcagcagaggattctgggggaagaatcaggagcccctagtcccagtccacaaaaacatgggagcctggttgatgaggaagtttggggtctgcctgaggagatagaggagcttagggtgccctcccttgtaccccaggagaggagcattgttggccaggaggaggctgggacatggagcttgtgggggaaggaggatgagagtcttctggatgaggagtttgagcttggctgggtccagggcccagcactgactcccgtccctgaggaggaggaagaagaggaagagggggctccgattgggacccctagggatcctggagatggttgtccttcccccgacatccctcctgaaccccctccaacacacctgaggccctgccctgccagccagctccctggactcctgtcccatggcctcctggccggcctctcctttgcagtggggtcctcctctggcctcctgcccctcctgctgctgctgctgcttccattgctggcagcccagggtgggggtggcctgcaggcagcgctgctggcccttgaggtggggctggtgggtctgggggcctcctacctgctcctttgtacagccctgcacctgccctccagtcttttcctactcctggcccagggtaccgcactgggggccgtcctgggcctgagctggcgccgaggcctcatgggtgttcccctgggccttggagctgcctggctcttagcttggccaggcctagctctacctctggtggctatggcagcggggggcagatgggtgcggcagcagggcccccgggtgcgccggggcatatctcgactctggttgcgggttctgctgcgcctgtcacccatggccttccgggccctgcagggctgtggggctgtgggggaccggggtctgtttgcactgtaccccaaaaccaacaaggatggcttccgcagccgcctgcccgtccctgggccccggcggcgtaatccccgcaccacccaacacccattagctctgttggcaagggtctgggtcctgtgcaagggctggaactggcgtctggcacgggccagccagggtttagcatcccacttgcccccgtgggccatccacacactggccagctggggcctgcttcggggtgaacggcccacccgaatcccccggctactaccacgcagccagcgccagctagggccccctgcctcccgccagccactgccagggactctagccgggcggaggtcacgcacccgccagtcccgggccctgcccccctggaggtagctgactccagcccttccagcccaaatctagagcattgagcactttatctcccacgactcagtgaagtttctccagtccctagtcctctcttttcacccaccttcctcagtttgctcacttaccccaggcccagcccttcggacctctagacaggcagcctcctcagctgtggagtccagcagtcactctgtgttctcctggcgctcctcccctaagttattgctgttcgcccgctgtgtgtgctcatcctcaccctcattgactcaggcctggggccaggggtggtggagggtgggaagagtcatgttttttttctcctctttgattttgtttttctgtctcccttccaacctgtccccttccccccaccaaaaaaagaaaaagacaaacacaaataaaatatctgagcggaactgtg

SEQ ID NO: 21166 - DNA, 2372 bp, Homo sapiens
  ENST00000566552
gttgaaaacccatgctcttccccacggaagaccccttgtgttaattaactaggggccaggctgagccccagctctcaccctctctccttccccaggtcagccgtcagatccaggagcatgagcaggactctgcgctgcgggagcagctgagcggctataagcggatgcgacgacagcaccagaagcagctgctggccctggagtcacggctgaggggtgaacgggaggagcacagtgcacggctgcagcgggagcttgaggcgcagcgggctggctttggggcagaggcagaaaagctggcccggcggcaccaggccataggtgagaaggaggcacgagctgcccaggccgaggagcggaagttccagcagcacatccttgggcagcagaagaaggagctggctgccctgctggaggcacagaagcggacctacaaacttcgcaaggaacagctgaaggaggagctccaggagaaccccagcactcccaagcgggagaaggccgagtggctgctgcggcagaaggagcagctccagcagtgccaggcggaggaggaagcagggctgctgcggcggcagcgccagtactttgagctgcagtgtcgccagtacaagcgcaagatgttgctggctcggcacagcctggaccaggacctgctgcgggaggacctgaacaagaagcagacccagaaggacttggagtgtgcactgctgcttcggcagcacgaggccacgcgggagctggagctgcggcagctccaggccgtgcagcgcacgcgggctgagctcacccgcctgcagcaccagacggagctgggcaaccagctggagtacaacaagcggcgtgagcaagagttgcggcagaagcatgcggcccaggttcgccagcagcccaagagcctcaaagtacgtgcaggccagcgccccccgggccttccactccccattcctggggctctgggcccacccaacacaggcacccctatagaacagcagccctgctcacctggccaggaggcagtcctggaccaaagaatgcttggcgaggaggaggaagcagttggagagagaaggattctgggaaaggaaggggccactttggagcccaagcagcagaggattctgggggaagaatcaggagcccctagtcccagtccacaaaaacatgggagcctggttgatgaggaagtttggggtctgcctgaggagatagaggagcttagggtgccctcccttgtaccccaggagaggagcattgttggccaggaggaggctgggacatggagcttgtgggggaaggaggatgagagtcttctggatgaggagtttgagcttggctgggtccagggcccagcactgactcccgtccctgaggaggaggaagaagaggaagagggggctccgattgggacccctagggatcctggagatggttgtccttcccccgacatccctcctgaaccccctccaacacacctgaggccctgccctgccagccagctccctggactcctgtcccatggcctcctggccggcctctcctttgcagtggggtcctcctctggcctcctgcccctcctgctgctgctgctgcttccattgctggcagcccagggtgggggtggcctgcaggcagcgctgctggcccttgaggtggggctggtgggtctgggggcctcctacctgctcctttgtacagccctgcacctgccctccagtcttttcctactcctggcccagggtaccgcactgggggccgtcctgggcctgagctggcgccgaggcctcatgggtgttcccctgggccttggagctgcctggctcttagcttggccaggcctagctctacctctggtggctatggcagcggggggcagatgggtgcggcagcagggcccccgggtgcgccggggcatatctcgactctggttgcgggttctgctgcgcctgtcacccatggccttccgggccctgcagggctgtggggctgtgggggaccggggtctgtttgcactgtaccccaaaaccaacaaggatggcttccgcagccgcctgcccgtccctgggccccggcggcgtaatccccgcaccacccaacacccattagctctgttggcaagggtctgggtcctgtgcaagggctggaactggcgtctggcacgggccagccagggtttagcatcccacttgcccccgtgggccatccacacactggccagctggggcctgcttcggggtgaacggcccacccgaatcccccggctactaccacgcagccagcgccagctagggccccctgcctcccgccagccactgccagggactctagccgggcggaggtcacgcacccgccagtcccgggccctgcccccc

SEQ ID NO: 21167 - DNA, 1721 bp, Homo sapiens
  ENST00000570844
cttgggaaactcacatactctccctctgttcgtgttctccacaatgatttatttcatattctcctcagtggttttattctttctcttagtattttcttaaggtcttgacaaagccatgtgcctattcccaagaaccaccaaggaaaagagtggctattatttttttcctgggcctgagttagtttaatgggtaaacagggtgcagattaaagtgagtgtggccctcaagcccatttactcagacttctggaggattttgaaagttgctgttctaaaaaaatgatcacacctaacactggaatgggccacttaaaatgtgcggagagggtggagagtggaaacgccccacccaaggctgttctctcacccagtcccacctctcccaggtaacttgttaataattaactgtattttgtgttttttcagtgcacattttgaaaaattatatgaattttaaacacagatggaatcatactttacatttactttctgtaacttcttttttccacttaatatttcttggacatcttcccctgtcagtacacctgtctcattttttttacagcatagaattttccatggtatggctgtaccataatttatttaacccatcccttattggtggacatttaggttgtttccagtattttgctatcacaacgcttccgtgaacacctcgagcacatgtgcaagtatacctgggggatagattctgcagtgtaattgctgtgccacagggtatgaccatcttccattctgatagatgttgagaccgctgcttcttgaaaccttagggcccaggcctacctggggcaggggaggatagtgggggtgggggaggagatccctacaactggttgttcatcttccccagctgcggcttgatgagacccaggaggcagagttccaggcccttcggcagcagcttcaacaggagctggagctgctcaacgcttaccagagcaagatcaagatccgcacagagagccagcacgagagggagctgcgggagctggagcagagggtcgcgctgcggcgggcactgctggagcagcgggtggaagaggagctgctggccctgcagacaggacgctccgagcgaatccgcagtctgcttgagcggcaggcccgtgagatcgaggccttcgatgcggaaagcatgaggctgggcttctccagcatggctctggggggcatcccggctgaagctgctgcccagggctatcctgctccaccccctgccccagcctggccctcccgtcccgttccccgttctggggcacactggagccatggccctcctccaccaggcatgccccctccagcctggcgtcagccgtctctgctggctcccccaggccccccaaactggctggggccccccacacaaagtgggacaccccgtggcggagccctgctgctgctaagaaacagcccccagcccctgcggcgggcagcctcggggggcagtggcagtgagaatgtgggcccccctgctgccgcggtgcccgggcccctgagccgcagcaccagtgtcgcttcccacatcctcaatggttcttcccacttctattcctgaggtgcagcggggaggagcagatgagctgggcagggcaggggtgggtggagcctgaccctggagggcactgagctggaggcccctgcaagggtaggggacaagatgtaggctccagctcccctcagacctcctcatctcatga

SEQ ID NO: 21168 - DNA, 4301 bp, Homo sapiens
  ENST00000419821
gttgtaacaggaaatacttcagcttgcaatactgatagtaatgtgtggcacccagatcacgctgtttttatctgcagttcctttttagtattgtacaaagtttcttgaagatttttaaatacataagtttaaaagagaattaactttcaatttgcaaattaaaatgagaatggttgccttttcttcattatcaagagatggtgagttgtcctcctgttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccagtgaggtggtggcaattaagaagatgtcctatagtgggaagcagacccatgagaaatggcaagatattcttaaggaagttaaatttttacgacaattgaagcatcctaatactattgagtacaaaggctgttacttgaaagaacacactgcttggttggtgatggaatattgcttaggctcagcctctgatttattagaagttcataaaaaaccacttcaggaagtggagatcgctgccattactcatggagccttgcatggactagcctacctacattctcatgcattgattcatagggatattaaagcaggaaatattcttctaacagagccaggtcaggtaaaactagctgattttggatctgcttcaatggcttctcctgccaactccttcgtgggcacaccttactggatggctccagaggtgatcttagctatggatgaaggacagtatgatgggaaagttgatatttggtcacttggcatcacttgtattgaattggcggaacggaagccgccccttttcaacatgaatgcaatgagtgccttatatcacattgcccagaatgactccccaacgttacagtctaatgaatggacagactcctttaggagatttgttgattactgcttgcagaaaatacctcaggaaaggccaacatcagcagaactattaaggcatgactttgttcgacgagaccggccactacgtgtcctcattgacctcatacagaggacaaaagatgcagttcgtgagctagataacctacagtaccgaaaaatgaaaaaaatacttttccaagagacacggaatggacccttgaatgagtcacaggaggatgaggaagacagtgaacatggaaccagcctgaacagggaaatggacagcctgggcagcaaccattccattccaagcatgtccgtgagcacaggcagccagagcagcagtgtgaacagcatgcaggaagtcatggacgagagcagttccgaacttgtcatgatgcacgatgacgaaagcacaatcaattccagctcctccgtcgtgcataagaaagatcatgtattcataagggatgaggcgggccacggcgatcccaggcctgagccgcggcctacccagtcagttcagagccaggccctccactaccggaacagagagcgctttgccacgatcaaatcagcatctttggttacacgacagatccatgagcatgagcaggagaacgagttgcgggaacagatgtcaggttataagcggatgcggcgccagcaccagaagcagctgatcgccctggagaacaagctgaaggctgagatggacgagcaccgcctcaagctacagaaggaggtggagacgcatgccaacaactcgtccatcgagctggagaagctggccaagaagcaagtggctatcatagaaaaggaggcaaaggtagctgcagcagatgagaagaagttccagcaacagatcttggcccagcagaagaaagatttgacaactttcttagaaagtcagaagaagcagtataagatttgtaaggaaaaaataaaagaggaaatgaatgaggaccatagcacacccaagaaagagaagcaagagcggatctccaaacataaagagaacttgcagcacacacaggctgaagaggaagcccaccttctcactcaacagagactgtactacgacaaaaattgtcgtttcttcaagcggaaaataatgatcaagcggcacgaggtggagcagcagaacattcgggaggaactaaataaaaagaggacccagaaggagatggagcatgccatgctaatccggcacgacgagtccacccgagagctagagtacaggcagctgcacacgttacagaagctacgcatggatctgatccgtttacagcaccagacggaactggaaaaccagctggagtacaataagaggcgagaaagagaactgcacagaaagcatgtcatggaacttcggcaacagccaaaaaacttaaaggccatggaaatgcaaattaaaaaacagtttcaggacacttgcaaagtacagaccaaacagtataaagcactcaagaatcaccagttggaagttactccaaagaatgagcacaaaacaatcttaaagacactgaaagatgagcagacaagaaaacttgccattttggcagagcagtatgaacagagtataaatgaaatgatggcctctcaagcgttacggctagatgaggctcaagaagcagaatgccaggccttgaggctacagctccagcaggaaatggagctgctcaacgcctaccagagcaaaatcaagatgcaaacagaggcacaacatgaacgtgagctccagaagctagagcagagagtgtctctgcgcagagcacaccttgagcagaagattgaagaggagctggctgcccttcagaaggaacgcagcgagagaataaagaacctattggaaaggcaagagcgagagattgaaacttttgacatggagagcctcagaatgggatttgggaatttggttacattagattttcctaaggaggactacagatgagattaaattttttgccatttacaaaaaaaaaaaaaaaaaagaaaacagaaaaaaattcagaccctgcaaaaccacattccccattttaacgggcgttgctctcactctctctctctcttactcttactgacatcgtgtcggactagtgcctgtttattcttactccatcaggggcccccttcctccccccgtgtcaactttcagtgctggccaaaacctggccgtctcttctattcacagtacacgtcacagtattgatgtgattcaaaatgtttcagtgaaaactttggagacagttttaacaaaaccaataaaccaacaacaaaaaaagtggatgtatattgctttaagcaatcactcattaccaccaatctgtgaaagtaaagcaaaaaataataataataaatgccaagggggagagagacacaatatccgcagccttacaccttaactagctgctgcattattttattttattttatttttttggtatttattcatcaggaataaaaaaaacaaagttttattaaagattgaaaatttgatacattttacagaaactaattgtgatgtacatatcagtggtgacatattattacttttttggggacggggggtgggtggggtgaagagatcttgtgatttttaagaacctgctggcaagagtttaacttgtcttcagcatattctgattgtatcataatcattttctgctgttgcagaggatgtgaatacacttaaggagctcacagaatcccagtagcacaaattgggctttggcaaatcgtgtattttgtgtatagaaggaatttaaggagaggtattacttattttcatattgtattttaactgtttctctgatcaaatttttttacttcctcctcctgttcctccccacctccctccttttccagttcagtatttggagttcaacactgtctctcaatcagatcatcttgatctttttctttatctcccttccccttcctaagtcccatttcttggtcataaatattgcattattcacactttcaaactgtgtattttcttacaataaaaaatgatgaaaaaaaaaaaggctttacttcttttgcatgcactttaaaaacaaaacaaaacatttttcaggttccaaggaagagcatgataactgtcagagcttttaattatatttgtaaataaaagtgttcatcaca

SEQ ID NO: 21169 - DNA, 4384 bp, Homo sapiens
  ENST00000392533
gtgctcggcgcagtccggtgcgattggccacccctggcaggagccgcacctcggacagcagcagcggcggcggccgcgggagggtccttgtggcgccgggcggcggggtcctgcgtggagagtgggacgcaacgccgagaccgcgagcagaggctgcgcacagccggatccggcactcagcgaccggacccaaggatccgccggggaacaagccacaggagagcgactcaggaacaagtgtgggagaggaagcggcggcggcggcgccgggcccgggggtggtgacagcaggtctgaggttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccagtgaggtggtggcaattaagaagatgtcctatagtgggaagcagacccatgagaaatggcaagatattcttaaggaagttaaatttttacgacaattgaagcatcctaatactattgagtacaaaggctgttacttgaaagaacacactgcttggttggtgatggaatattgcttaggctcagcctctgatttattagaagttcataaaaaaccacttcaggaagtggagatcgctgccattactcatggagccttgcatggactagcctacctacattctcatgcattgattcatagggatattaaagcaggaaatattcttctaacagagccaggtcaggtaaaactagctgattttggatctgcttcaatggcttctcctgccaactccttcgtgggcacaccttactggatggctccagaggtgatcttagctatggatgaaggacagtatgatgggaaagttgatatttggtcacttggcatcacttgtattgaattggcggaacggaagccgccccttttcaacatgaatgcaatgagtgccttatatcacattgcccagaatgactccccaacgttacagtctaatgaatggacagactcctttaggagatttgttgattactgcttgcagaaaatacctcaggaaaggccaacatcagcagaactattaaggcatgactttgttcgacgagaccggccactacgtgtcctcattgacctcatacagaggacaaaagatgcagttcgtgagctagataacctacagtaccgaaaaatgaaaaaaatacttttccaagagacacggaatggacccttgaatgagtcacaggaggatgaggaagacagtgaacatggaaccagcctgaacagggaaatggacagcctgggcagcaaccattccattccaagcatgtccgtgagcacaggcagccagagcagcagtgtgaacagcatgcaggaagtcatggacgagagcagttccgaacttgtcatgatgcacgatgacgaaagcacaatcaattccagctcctccgtcgtgcataagaaagatcatgtattcataagggatgaggcgggccacggcgatcccaggcctgagccgcggcctacccagtcagttcagagccaggccctccactaccggaacagagagcgctttgccacgatcaaatcagcatctttggttacacgacagatccatgagcatgagcaggagaacgagttgcgggaacagatgtcaggttataagcggatgcggcgccagcaccagaagcagctgatcgccctggagaacaagctgaaggctgagatggacgagcaccgcctcaagctacagaaggaggtggagacgcatgccaacaactcgtccatcgagctggagaagctggccaagaagcaagtggctatcatagaaaaggaggcaaaggtagctgcagcagatgagaagaagttccagcaacagatcttggcccagcagaagaaagatttgacaactttcttagaaagtcagaagaagcagtataagatttgtaaggaaaaaataaaagaggaaatgaatgaggaccatagcacacccaagaaagagaagcaagagcggatctccaaacataaagagaacttgcagcacacacaggctgaagaggaagcccaccttctcactcaacagagactgtactacgacaaaaattgtcgtttcttcaagcggaaaataatgatcaagcggcacgaggtggagcagcagaacattcgggaggaactaaataaaaagaggacccagaaggagatggagcatgccatgctaatccggcacgacgagtccacccgagagctagagtacaggcagctgcacacgttacagaagctacgcatggatctgatccgtttacagcaccagacggaactggaaaaccagctggagtacaataagaggcgagaaagagaactgcacagaaagcatgtcatggaacttcggcaacagccaaaaaacttaaaggccatggaaatgcaaattaaaaaacagtttcaggacacttgcaaagtacagaccaaacagtataaagcactcaagaatcaccagttggaagttactccaaagaatgagcacaaaacaatcttaaagacactgaaagatgagcagacaagaaaacttgccattttggcagagcagtatgaacagagtataaatgaaatgatggcctctcaagcgttacggctagatgaggctcaagaagcagaatgccaggccttgaggctacagctccagcaggaaatggagctgctcaacgcctaccagagcaaaatcaagatgcaaacagaggcacaacatgaacgtgagctccagaagctagagcagagagtgtctctgcgcagagcacaccttgagcagaagattgaagaggagctggctgcccttcagaaggaacgcagcgagagaataaagaacctattggaaaggcaagagcgagagattgaaacttttgacatggagagcctcagaatgggatttgggaatttggttacattagattttcctaaggaggactacagatgagattaaattttttgccatttacaaaaaaaaaaaaaaaaaagaaaacagaaaaaaattcagaccctgcaaaaccacattccccattttaacgggcgttgctctcactctctctctctcttactcttactgacatcgtgtcggactagtgcctgtttattcttactccatcaggggcccccttcctccccccgtgtcaactttcagtgctggccaaaacctggccgtctcttctattcacagtacacgtcacagtattgatgtgattcaaaatgtttcagtgaaaactttggagacagttttaacaaaaccaataaaccaacaacaaaaaaagtggatgtatattgctttaagcaatcactcattaccaccaatctgtgaaagtaaagcaaaaaataataataataaatgccaagggggagagagacacaatatccgcagccttacaccttaactagctgctgcattattttattttattttatttttttggtatttattcatcaggaataaaaaaaacaaagttttattaaagattgaaaatttgatacattttacagaaactaattgtgatgtacatatcagtggtgacatattattacttttttggggacggggggtgggtggggtgaagagatcttgtgatttttaagaacctgctggcaagagtttaacttgtcttcagcatattctgattgtatcataatcattttctgctgttgcagaggatgtgaatacacttaaggagctcacagaatcccagtagcacaaattgggctttggcaaatcgtgtattttgtgtatagaaggaatttaaggagaggtattacttattttcatattgtattttaactgtttctctgatcaaatttttttacttcctcctcctgttcctccccacctccctccttttccagttcagtatttggagttcaacactgtctctcaatcagatcatcttgatctttttctttatctcccttccccttcctaagtcccatttcttggtcataaatattgcattattcacactttcaaactgtgtattttcttacaataaaaaatgatgaaaaaaaaaaaggctttacttcttttgcatgcactttaaaaacaaaacaaaacatttttcaggttccaaggaagagcatgataactgtcagagcttttaattatatttgtaaataaaagtgttcatcaca

SEQ ID NO: 21170 - DNA, 597 bp, Homo sapiens
  ENST00000543709
gccatggaaatgcaaattaaaaaacagtttcaggacacttgcaaagtacagaccaaacagtataaagcactcaagaatcaccagttggaagttactccaaagaatgagcacaaaacaatcttaaagacactgaaagatgagcagacaagaaaacttgccattttggcagagcagtatgaacagagtataaatgaaatgatggcctctcaagcgttacggctagatgaggctcaagaagcagaatgccaggccttgaggctacagctccagcaggaaatggagctgctcaacgcctaccagagcaaaatcaagatgcaaacagaggcacaacatgaacgtgagctccagaagctagagcagagagtgtctctgcgcagagcacaccttgagcagaagattgaagaggagctggctgcccttcagaaggaacgcagcgagagaataaagaacctattggaaagtatttggagttcaacactgtctctcaatcagatcatcttgatctttttctttatctcccttccccttcctaagtcccatttcttggtcataaatattgcattattcacactttcaaactgtgtattttcttacaat

SEQ ID NO: 21171 - DNA, 3932 bp, Homo sapiens
  ENST00000537305
taaatttttacgacaattgaagcatcctaatactattgagtacaaaggctgttacttgaaagaacacactgcttggttggtgatggaatattgcttaggctcagcctctgatttattagaagttcataaaaaaccacttcaggaagtggagatcgctgccattactcatggagccttgcatggactagcctacctacattctcatgcattgattcatagttctgtctgccaatgcctaatgtcaccatgaggaaggaaactgaattttcaagggaagtttttataaaagttattttgaagcatttgaaccttatcattttcagcttgacataaatttcctcatcttctctgttttatcttttcactgaccatcaacttccaattcatggtttctagtgctcattacacctcatgccttttttaaaaagaataaggagtacatccacaccttctcattctaaattaccataatgaaaaatgaattttttgaattatatttttaaaactttttgctatataatacctctattagctttagtagtaaccacgtgcaattctttgtagtaatacaatagaaatgtaatttcctaacccctaatccttgtttgttttgatctttcagggtcttctttttactgtacagagttatttttaaaatatcaccttctatataacatgtacctcaaatgccttagagttgcagttacaattaaagacagagagaaagggtcacaggcaagaaagaaaaggtatgtgtgtagttgaggtttattggtaggtggtcaatacggaatcattgcaggtttgtttaggctccaaaaatgtcacataatttggaaaagcagaaaaagcagttaaaattggcaccaattttctcagcacagggaatactattgataactggatttagcctttaagaatatgcctttgtaagtgtagcagctgaataggttttcttgttcgccatgtctgccttttttctcatttgtattccctccctctgaagaaagctctacctttaagtaactagtatgacctacctgcaagtacacccaggaatctgggcccccttacaacatgcagtaattactaaatctccttctggctatctgagcaagggatattaaagcaggaaatattcttctaacagagccaggtcaggtaaaactagctgattttggatctgcttcaatggcttctcctgccaactccttcgtgggcacaccttactggatggctccagaggtgatcttagctatggatgaaggacagtatgatgggaaagttgatatttggtcacttggcatcacttgtattgaattggcggaacggaagccgccccttttcaacatgaatgcaatgagtgccttatatcacattgcccagaatgactccccaacgttacagtctaatgaatggacagactcctttaggagatttgttgattactgcttgcagaaaatacctcaggaaaggccaacatcagcagaactattaaggcatgactttgttcgacgagaccggccactacgtgtcctcattgacctcatacagaggacaaaagatgcagttcgtgagctagataacctacagtaccgaaaaatgaaaaaaatacttttccaagagacacggaatggacccttgaatgagtcacaggaggatgaggaagacagtgaacatggaaccagcctgaacagggaaatggacagcctgggcagcaaccattccattccaagcatgtccgtgagcacaggcagccagagcagcagtgtgaacagcatgcaggaagtcatggacgagagcagttccgaacttgtcatgatgcacgatgacgaaagcacaatcaattccagctcctccgtcgtgcataagaaagatcatgtattcataagggatgaggcgggccacggcgatcccaggcctgagccgcggcctacccagtcagttcagagccaggccctccactaccggaacagagagcgctttgccacgatcaaatcagcatctttggttacacgacagatccatgagcatgagcaggagaacgagttgcgggaacagatgtcaggttataagcggatgcggcgccagcaccagaagcagctgatcgccctggagaacaagctgaaggctgagatggacgagcaccgcctcaagctacagaaggaggtggagacgcatgccaacaactcgtccatcgagctggagaagctggccaagaagcaagtggctatcatagaaaaggaggcaaaggtagctgcagcagatgagaagaagttccagcaacagatcttggcccagcagaagaaagatttgacaactttcttagaaagtcagaagaagcagtataagatttgtaaggaaaaaataaaagaggaaatgaatgaggaccatagcacacccaagaaagagaagcaagagcggatctccaaacataaagagaacttgcagcacacacaggctgaagaggaagcccaccttctcactcaacagagactgtactacgacaaaaattgtcgtttcttcaagcggaaaataatgatcaagcggcacgaggtggagcagcagaacattcgggaggaactaaataaaaagaggacccagaaggagatggagcatgccatgctaatccggcacgacgagtccacccgagagctagagtacaggcagctgcacacgttacagaagctacgcatggatctgatccgtttacagcaccagacggaactggaaaaccagctggagtacaataagaggcgagaaagagaactgcacagaaagcatgtcatggaacttcggcaacagccaaaaaacttaaaggccatggaaatgcaaattaaaaaacagtttcaggacacttgcaaagtacagaccaaacagtataaagcactcaagaatcaccagttggaagttactccaaagaatgagcacaaaacaatcttaaagacactgaaagatgagcagacaagaaaacttgccattttggcagagcagtatgaacagagtataaatgaaatgatggcctctcaagcgttacggctagatgaggctcaagaagcagaatgccaggccttgaggctacagctccagcaggaaatggagctgctcaacgcctaccagagcaaaatcaagatgcaaacagaggcacaacatgaacgtgagctccagaagctagagcagagagtgtctctgcgcagagcacaccttgagcagaagattgaagaggagctggctgcccttcagaaggaacgcagcgagagaataaagaacctattggaaaggcaagagcgagagattgaaacttttgacatggagagcctcagaatgggatttgggaatttggttacattagattttcctaaggaggactacagatgagattaaattttttgccatttacaaaaaaaaaaaaaaaaaagaaaacagaaaaaaattcagaccctgcaaaaccacattccccattttaacgggcgttgctctcactctctctctctcttactcttactgacatcgtgtcggactagtgcctgtttattcttactccatcaggggcccccttcctccccccgtgtcaactttcagtgctggccaaaacctggccgtctcttctattcacagtacacgtcacagtattgatgtgattcaaaatgtttcagtgaaaactttggagacagttttaacaaaaccaataaaccaacaacaaaaaaagtggatgtatattgctttaagcaatcactcattaccaccaatctgtgaaagtaaagcaaaaaataataataataaatgccaagggggagagagacacaatatccgcagccttacaccttaactagctgctgcattattttattttattttatttttttggtatttattcatcaggaataaaaaaaacaaagttttattaaagattgaaaatttgatacatttta

SEQ ID NO: 21172 - DNA, 777 bp, Homo sapiens
  ENST00000536979
agaggtaggtaatgtgccaaggtgtgacacacacaaagtggatggtgtagctgtaattcaagcccaggagcctacctccaaagcccacaggtgtagccttcctgacgcctgctgctgtggtttcagatcatactgaaaagaatgtgtttggtattgtagcccattgggcagacttgactgtttttgattcccaactctgaatgtacccagagcatctgtgtttttgagggggcaaccaatttcaatccaaatgaggaaacctcttccagtagtcaccaagggctgtaggccaccaagggctgtaggcaagggtgcatgaccgtgtgtgtcttctgtgtccgcagttacggctagatgaggctcaagaagcagaatgccaggccttgaggctacagctccagcaggaaatggagctgctcaacgcctaccagagcaaaatcaagatgcaaacagaggcacaacatgaacgtgagctccagaagctagagcagagagtgtctctgcgcagagcacaccttgagcagaagattgaagaggagctggctgcccttcagaaggaacgcagcgagagaataaagaacctattggaaaggcaagagcgagagattgaaacttttgacatggagagcctcagaatgggatttgggaatttggttacattagattttcctaaggaggactacagatgagattaaattttttgccatttacaaaaaaaaaaaaaaaaaagaaaacagaaaaaaattcagaccctgcaaaaccacattccccatttta

SEQ ID NO: 21173 - DNA, 2147 bp, Homo sapiens
  ENST00000537952
agaaggtgctagaactgtgtacgatcatgactggaaagcaggatccctcagtgactgccgaatcttcccagcacaagatagagaggcagttcagcacaagcctacattggttctaggcagaacgatgatcctaccgaacagatctcaaataaaattaaattgagaaagcagatctttcaagggaatgaggcggaggctcgcttttatgttaaaagccaccagcatcctccttgctagacatggacatgacatttttaaaggaattatctggttacagcgttttaagcaaactgttctaaggagtctgtacattgcattattttttctattctttttttcttttgcatatatgtaattctggaggtaaagaaaaagcctgccagggattcagaaggcatcccactagcgatcagctgacattcctaactgaaggctgcaatgtgttgcttattcattttgtaccgtgggagctgcggggactagcagagagctaaactatgcatttcaaacagcagtgcttgtgcagaaagaggggtgagagagaggcagccggcgaggaaagagcacagctggactttctccttgtttttatccatttctgcaggatcatgtattcataagggatgaggcgggccacggcgatcccaggcctgagccgcggcctacccagtcagttcagagccaggccctccactaccggaacagagagcgctttgccacgatcaaatcagcatctttggttacacgacagatccatgagcatgagcaggagaacgagttgcgggaacagatgtcaggttataagcggatgcggcgccagcaccagaagcagctgatcgccctggagaacaagctgaaggctgagatggacgagcaccgcctcaagctacagaaggaggtggagacgcatgccaacaactcgtccatcgagctggagaagctggccaagaagcaagtggctatcatagaaaaggaggcaaaggtagctgcagcagatgagaagaagttccagcaacagatcttggcccagcagaagaaagatttgacaactttcttagaaagtcagaagaagcagtataagatttgtaaggaaaaaataaaagaggaaatgaatgaggaccatagcacacccaagaaagagaagcaagagcggatctccaaacataaagagaacttgcagcacacacaggctgaagaggaagcccaccttctcactcaacagagactgtactacgacaaaaattgtcgtttcttcaagcggaaaataatgatcaagcggcacgaggtggagcagcagaacattcgggaggaactaaataaaaagaggacccagaaggagatggagcatgccatgctaatccggcacgacgagtccacccgagagctagagtacaggcagctgcacacgttacagaagctacgcatggatctgatccgtttacagcaccagacggaactggaaaaccagctggagtacaataagaggcgagaaagagaactgcacagaaagcatgtcatggaacttcggcaacagccaaaaaacttaaaggccatggaaatgcaaattaaaaaacagtttcaggacacttgcaaagtacagaccaaacagtataaagcactcaagaatcaccagttggaagttactccaaagaatgagcacaaaacaatcttaaagacactgaaagatgagcagacaagaaaacttgccattttggcagagcagtatgaacagagtataaatgaaatgatggcctctcaagcgttacggctagatgaggctcaagaagcagaatgccaggccttgaggctacagctccagcaggaaatggagctgctcaacgcctaccagagcaaaatcaagatgcaaacagaggcacaacatgaacgtgagctccagaagctagagcagagagtgtctctgcgcagagcacaccttgagcagaagattgaagaggagctggctgcccttcagaaggaacgcagcgagagaataaagaacctattggaaaggcaagagcgagagattgaaacttttgacatggagagcctcagaatgggatttgggaatttggttacattagattttcctaaggaggactacagatgagattaaattttttgccatttacaaaaaaaaaaaaaaaaaa

SEQ ID NO: 21174 - DNA, 675 bp, Homo sapiens
  ENST00000537569
tggaaaaccagctggagtacaataagaggcgagaaagagaactgcacagaaagcatgtcatggaacttcggcaacagccaaaaaacttaaaggccatggaaatgcaaattaaaaaacagtttcaggacacttgcaaagtacagaccaaacagtataaagcactcaagaatcaccagttggaagttactccaaagaatgagcacaaaacaatcttaaagacactgaaagatgagcagacaagaaaacttgccattttggcagagcagtatgaacagagtataaatgaaatgatggcctctcaagcggtaagtggttaggtttggtgccacggcttcgagagctttgggaatcaagaaaatccaagatccagcctgttgttcccaagatgattcttgcacaaatttaggatattgatgtttttctgcccaaaggactgaggaaaggacgacgttgaataaagccaagccaatgtggatacttgctggagtgtcttataagatggaactcaaggagtgacatgccacatcagacctgtggcacatagggactttgagggcaaatgtgatagataccacatatgataccatgtgttcatttatgaaagattttactgactgccctccccgcaactaatatcaggcacaaatgaataagagtccctgcccttagggagcc

SEQ ID NO: 21175 - DNA, 580 bp, Homo sapiens
  ENST00000540561
atcatgactggaaagcaggatccctcagtgactgccgaatcttcccagcacaagatagagaggcagttcagcacaagcctacattggttctaggcagaacgatgatcctaccgaacagatctcaaataaaattaaattgagaaagcagatctttcaagggaatgaggcggaggctcgcttttatgttaaaagccaccagcatcctccttgctagacatggacatgacatttttaaaggaattatctggttacagcgttttaagcaaactgttctaaggagatcatgtattcataagggatgaggcgggccacggcgatcccaggcctgagccgcggcctacccagtcagttcagagccaggccctccactaccggaacagagagcgctttgccacgatcaaatcagcatctttggttacacgacagatccatgagcatgagcaggagaacgagttgcgggaacagatgtcaggttataagcggatgcggcgccagcaccagaagcagctgatcgccctggagaacaagctgaaggctgagatggacgagcaccgcctcaagctacagaaggaggtggaga

SEQ ID NO: 21176 - DNA, 597 bp, Homo sapiens
  ENST00000537822
gtagagagaaggtgctagaactgtgtacgatcatgactggaaagcaggatccctcagtgactgccgaatcttcccagcacaagatagagaggcagttcagcacaagcctacattggttctaggcagaacgatgatcctaccgaacagatctcaaataaaattaaattgagaaagcagatctttcaagggaatgaggcggaggctcgcttttatgttaaaagccaccagcatcctccttgctagacatggacatgacatttttaaaggaattatctggttacagcgttttaagcaaactgttctaaggagtctgtacattgcattattttttctattctttttttcttttgcatatatgtaattctggaggatcatgtattcataagggatgaggcgggccacggcgatcccaggcctgagccgcggcctacccagtcagttcagagccaggccctccactaccggaacagagagcgctttgccacgatcaaatcagcatctttggttacacgacagatccatgagcatgagcaggagaacgagttgcgggaacagatgtcaggttataagcggatgcggcgccagcaccagaagcag

SEQ ID NO: 21177 - DNA, 3229 bp, Homo sapiens
  ENST00000536584
atttctctgtctgcctggtttccttcaagaactactttattgtgtttctttcctcttccagcggaacggaagccgccccttttcaacatgaatgcaatgagtgccttatatcacattgcccagaatgactccccaacgttacagtctaatgaatgcatgactttgttcgacgagaccggccactacgtgtcctcattgacctcatacagaggacaaaagatgcagttcgtgagctagataacctacagtaccgaaaaatgaaaaaaatacttttccaagagacacggaatggacccttgaatgagtcacaggaggatgaggaagtaggttcaatttattttagcaggcacttatagaatgcccactatgtgaaaaagttctagactgggcactatgaaaaacttttgaagataaaaattaattgatgctgtccgccttaagaaacatgaagggttgtacaagagacattcataaaataacacttatataaggcaaaatatgaaaagtgctacagaggtgtaaccccattgcaggggtccatcatggggagaaaataagtctgctggtgggattagtgaaggtttcctggaggacatgatgtgggtagtttctgacaaatgggcatagggtgttctagactcagaaaggtgttgtgctttaggaagattatcctagcaacagagtgtaacatggatttgaatgggcaacatcctggctaatagtccatgcaagaggtaataaggtcagtgtcgatgcaaatggggaaaagggagcactttagagaaacatcgtagaggtagatttcataatccatggcttctcattgacagtgacagataaggaggagtttaaggtgactctgagcattggagcctgggtggctaggagtatgtcaataccaagaacagagaaaaagaaccagggagaaagagtagatttaggatgatttcagtttcgtgccttttgagtttaaggtcctggcattataaactcttgccagtatacagatagaagttttcagttagagaatccttgatgaccttagtaaaagcagttttacaggactaggtagaatgaatagtagattactggagttgtataattcatgggagttgataagagggagacaggaaaaaataattatgttaagattcagaaattgggttaagaaggaaaagtaagagtgggcagcatgtagagagatccataaatataaggcaggcttcttcatctttaaatgcagtagagatggagccagggcagagtcagaggcaccgaagatagaagaaagggatatagttaaagaggcaggatttcagaacgtagacataacaagaacaggagtattttagctttttaacagaaaataaaataaacataaaagtattttatcaataattttaaaaatgaagctcggaaagttgcattgaactataaaatttcttgattgcatatatagaaatgatcccctttaattgggaaaataagtctgttaaaaataatgtattatcttccattttatattacccagtaattttttatattgccatggctaagtaacagtttattaaagttatatgtgtaccatatggttttttgagaacaaggtttatttgtagctaaatggatttaattttattattcaatcttatatcaaaagatatcccactgtgatggataaattatatgttctgattattttaccacttttcaaatagtagtctttgggccagtaatgatgaataccagtattatttaacagatatatataataagattacagagataagcatgatagaatcgcttgagggaggcagactttaattacctgtccaggaaagtagaattaatatttctgcttagatatgaagttactcaataatgacttgcagagggagcatattgcttgtcaaatatctgaaaactctttccactctactttttcaagtgaccactgctgtatttgaagatatcctagagctcacctgtttagtggccagcagtcttcctctagctccttgatgttccagaaggtcccttacaaacctggcttgattttgcttactgaatagcaacacgataatatgatagtgtgtatgacaggggaaagccctgggatggcagcatttggagccttatgacccacgtccagaatggcccctggggaaggcataggaagcaaatatgagatgtatgaaaatggtggaggagtagtggagccagtacataaaaagtttgtctttgcagattggcagaaaagcaacttgacactgcaaaattgagtgtgcttgacacttttgtcaatggattgactctttatcttcagtctttttttctaacctcagtgccccatttttacaggacagtgaacatggaaccagcctgaacagggaaatggacagcctgggcagcaaccattccattccaagcatgtccgtgagcacaggcagccagagcagcagtgtgaacagcatgcaggaagtcatggacgagagcagttccgaacttgtcatgatgcacgatgacgaaagcacaatcaattccagctcctccgtcgtgcataagaaagtaggtttcttggtaccctccacagaggtgagctttgtcaatcatagcgaatccagttcaagtcacttagcttccagatgtttcagttacctttttgcaactgcagtgtggtactaaacctggcatgtgacagttttcttacagtcaaaaagtaacaaaggactacacaggctacatctgtgcctatttcttcatctccctctctcattactctgatgtccatcatcatcaataaataagttgaagaatttgataagtccttctctaaaccaataatcttaatactgtagaccttcaagtcttcctgagtgtacctgttggttgtgcccttttagaagtatgctctttcaaaagtatgtttcttggctgggcgtggtggctcacatctgtaatcccagccctttgggaggcctaggcgggtggatcacttgaggtcaggagtttgagaccagcctggccaacatggcgaaaccccgtctttactaaaaatacaaaaaatagccgggcctggtgacatatgcctgtaatcccagctactcgagaggctgaggcaggagaattgcttgaacccaggaggcagaggttgtagtgagccgagatcgcgccattgcactccagcctgggcaacagagtgagactcaaaaaaaaaaaaaaaaaaaaa

SEQ ID NO: 21178 - DNA, 555 bp, Homo sapiens
  ENST00000538601
caaaggctgttacttgaaagaacacactgcttggttcataaaaaaccacttcaggaagtggagatcgctgccattactcatggagccttgcatggactagcctacctacattctcatgcattgattcatagggatattaaagcaggaaatattcttctaacagagccaggtcaggtaaaactagctgattttggatctgcttcaatggcttctcctgccaactccttcgtgggcacaccttactggatggctccagaggtgatcttagctatggatgaaggacagtatgatgggaaagttgatatttggtcacttggcatcacttgtattgaattggcggaacggaagccgccccttttcaacatgaatgcaatgagtgccttatatcacattgcccagaatgactccccaacgttacagtctaatgaatggacagactcctttaggagatttgttgattactgcttgcagaaaatacctcaggaaaggccaacatcagcagaactattaaggcatgactttgttcgacgagaccggccactacgtgtcctcatt

SEQ ID NO: 21179 - DNA, 597 bp, Homo sapiens
  ENST00000535570
caggctggagtgcaatggctcaatctcggctcaccgcaacctcagcctcccgggttcaagcgattctcctgcctcagcctccctagtagctgggattacaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccagtgaggtggtggcaattaagaagatgtcctatagtgggaagcagacccatgagaaatggcaagatattcttaaggaagttaaatttttacgacaattgaagcatcctaatactattgagtacaaaggctgttacttgaaagaacacactgcttggttggtgatggaatattgcttaggctcagcctctgatttattagaagttcataaaaaaccacttcaggaagtggagatcgctgccattactcatggagccttgcatggactagcc

SEQ ID NO: 21180 - DNA, 881 bp, Homo sapiens
  ENST00000541186
tgctgatagcctggggtgttcttataacttaagttcagttttttctttcctgtgaggaagaggcagttttttaaatgaagccatctctggggaaatcgtattgattgttgtagctaaatacggaatttttaaagtctttagtatgttgaactggaaatataggacatgcgtttgagatctactgtgaggcaacttttaccttgatctcttctgatatgactgaggcctatatccatcctttaaaaaattcttattaatcatgcggaagaagaaatctttccaggagcagcaaactcaggaccggagagataagataaatatataaagcttcagggtatgaagccatacacatagtagaaactgaggcaaaggaaagagttcatgtcccgcctgaaggcagtcaaatcaggttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccagtgaggtggtggcaattaagaagatgtcctatagtgggaagcagacccatgagaaatggcaagatattcttaaggaagttaaatttttacgacaattgaagcatcctaatactattgagtacaaaggctgttacttgaaa

SEQ ID NO: 21181 - DNA, 578 bp, Homo sapiens
  ENST00000541878
gttgtaacaggaaatacttcagcttgcaatactgatagtaatgtgtggcacccagatcacgctgtttttatctgcagttcctttttagtattgtacaaagtttcttgaagatttttaaatacataagtttaaaagagaattaactttcaatttgcaaattaaaatgagaatggttgccttttcttcattatcaagagatggttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccagtgaggtggtggcaattaagaagatgtcctatagtgggaagcagac

SEQ ID NO: 21182 - DNA, 613 bp, Homo sapiens
  ENST00000542902
ctctttaagcctcacttaaaaaactaagtgtctgtaataacttcctttctcgggatgaaggtgctgatagcctggggtgttcttataacttaagttcagttttttctttcctgtgaggaagaggcagttttttaaatgaagccatctctggggaaatcgtattgattgttgtagctaaatacggaatttttaaagtctttagtatgttgaactggaaatataggacatgcgtttgagatctactgtgagttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccagtgaggtggtggcaattaagaagatgtcctata

SEQ ID NO: 21183 - DNA, 641 bp, Homo sapiens
  ENST00000542532
agcagcagcggcggcggccgcgggagggtccttgtggcgccgggcggcggggtcctgcgtggagagtgggacgcaacgccgagaccgcgagcagaggctgcgcacagccggatccggcactcagcgaccggacccaaggatccgccggggaacaagccacaggagagcgactcaggaacaagtgtgggagaggaagcggcggcggcggcgccgggcccgggggtggtgacagcaggtctgaggctggagtgcagtggcatgattttggctgactgcaacctctgcctcccaggttcaagcaattctccggcctcagcctcccgaggagctgggactacaggttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttgga

SEQ ID NO: 21184 - DNA, 590 bp, Homo sapiens
  ENST00000541786
gtggcacccagatcacgctgtttttatctgcagttcctttttagtattgtacaaagtttcttgaagatttttaaatacataagtttaaaagagaattaactttcaatttgcaaattaaaatgagaatggttgccttttcttcattatcaagagatggttgcatcataaatacaaaggactgaagttataaaagagaaaagagaagtttgctgctaaaatgaatctgagcaatatggaatattttgtgccacacacaaaaagcatctggcacaatgtttttgtttggtttggtttggtgttgtaaagagagaggatcttgctatgtttgccagactggtctcaaactcctggtctcaagtcatcctctcaccttggcctcccaaagcattaggattacagacatgagacatcacacccagccccagcacaatgttgaatgtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgagg

SEQ ID NO: 21185 - DNA, 594 bp, Homo sapiens
  ENST00000539872
tttctcgggatgaaggtgctgatagcctggggtgttcttataacttaagttcagttttttctttcctgtgaggaagaggcagttttttaaatgaagccatctctggggaaatcgtattgattgttgtagctaaatacggaatttttaaagtctttagtatgttgaactggaaatataggacatgcgtttgagatctactgtgagaaaccaaggcttaaagggatgaagtaataaaaagctagtagaggccgggcacggtggctcacgcctgtaatcccagcactttgggaggctgaggcagacggatcacgaggtcaagagattgagaccatcccggccaacatggttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatga

SEQ ID NO: 21186 - DNA, 588 bp, Homo sapiens
  ENST00000542692
ggacagcagcagcggcggcggccgcgggagggtccttgtggcgccgggcggcggggtcctgcgtggagagtgggacgcaacgccgagaccgcgagcagaggctgcgcacagccggatccggcactcagcgaccggacccaaggatccgccggggaacaagccacaggagagcgactcaggaacaagtgtgggagaggaagcggcggcggcggcgccgggcccgggggtggtgacagcaggtctgaggttgcatcataaatacaaaggactgaagttataaaagagaaaagagaagtttgctgctaaaatgaatctgagcaatatggaatattttgtgccacacacaaaaagcatctggcacaatgtttttgtttggtttggtttggtgttgtaaagagagaggatcttgctatgtttgccagactggtctcaaactcctggtctcaagtcatcctctcaccttggcctcccaaagcattaggattacagacatgagacatcacacccagccccagcacaatgttgaatgtactgaagatttaccccccaaaaaaaattgtcaatgagaaataaagctaactgatatca

SEQ ID NO: 21187 - DNA, 4119 bp, Homo sapiens
  ENST00000508802
ctcttcggctgctgctcctggtgccgccaccgtccgccggtgcctgttgctgccgccgccgcgggacctgctgtgtcctcagctgggtggagaagaggcgggcgccgagccgaggggagccccctccccgtccccccgcggcgggaagagcgcagccagccgggtgcgatggactccccgcccgcccaggccgtccccaggatgcccccaagcacctgcgcgtcccggcccggccccgggctctgagcgcgccgcggcacaggtttctgcatatgaagtgtgtaaaatagattgcttgatccaaaacagaaaaacagtgataactgttttgctgagttcccagacccttcccaagatggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaatgtggatccttcacctgtgggtgagtctaagcaccgcccaggtcagtcttcagctcctgctcctccacctcgtcttaacccctccgcctcctcgccaaacttttttaagtacctaaaacataattccagtggagaacaaagtgggaatgctgtgccaaagagcatctcctaccgtaatgccctgcggaaaaaacttcattcttcttcctctgtgccaaattttctaaaatttctggctcctgtagatgaaaataacacctctgattttatgaacacaaaaagggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgtttt

SEQ ID NO: 21188 - DNA, 5700 bp, Homo sapiens
  ENST00000261439
ctcttcggctgctgctcctggtgccgccaccgtccgccggtgcctgttgctgccgccgccgcgggacctgctgtgtcctcagctgggtggagaagaggcgggcgccgagccgaggggagccccctccccgtccccccgcggcgggaagagcgcagccagccgggtgcgatggactccccgcccgcccaggccgtccccaggatgcccccaagcacctgcgcgtcccggcccggccccgggctctgagcgcgccgcggcacaggtttctgcatatgaagtgtgtaaaatagattgcttgatccaaaacagaaaaacagtgataactgttttgctgagttcccagacccttcccaagatggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgttttcttgttggttcctttttgagtgtcactgtgtttgtaaagagcattcacaatacggtggaatttcaaaagctggaagagctcgagatcatgcctcaggcaaaggcgtgggtccatcgttcttccgagagggtttgtgtggcgactacaccctcagcgtccctggcaaggtgcagttggctctcgcccattcttgttatggaaacctaagatgatcattgggaagatcagtgatcttgggtcattgatccctggctcagaggatagcggtttccatcataaaccaagatgatgagttcagcctttatccctcgtggttccactagatgtaacttaaaggagttaacatttgaggactttgttctacatcagattttactatttgaatgtttaagatcactttattgaatttgaagatcatcaaattaaataaaatgatttatttaatttggatatcctgatcactgtcaagtgaaatggatctctctctttggtatttaaggaagtttgtctttaaaaaaaaaatagagtgttttcatacatttttgcttatcccataagtacagttgatcaaagtcatagtaggtaaatgctttatgggacagctgacaccttttagaccctaccaggtattgctagcatgtgagctgcagttgtggggtctgagatatttctttgtggtagtttcatacccatactatagagtcatgtatttatttttgcctgttgtgtgatgtaatgcaatcatgttcctttgagtctccatcccttggaaatctgacttcttgcagaaggagtaggcacatcaagatattcaggggtgccccaagagtctgggactttcaaaaaaaaaagatcaggctgaaactgcagtcagatttatgacagctgacagtttttcagaggtcgcacacagtgactctcctctctcaggatgacgaggacctgtgccttcaacaagcaaaatgctgctcacggttgtcctgcttgcagccagtcactgtgtaaagcctctctgatgtgcacttaagagtgggttgctttctcacaaagatggggttctgtgcagtcacaggtcacttccttgacaacacaatcatttctgatctttatcactgtaaccacgtcttctattccataggagtttcttttgattctctcagttgcggggggcatctcttaatcctggggtaaaaggagagattgccatacttagactcactgtgagtctccccggccatttcacgaggagaccacagtgctgccaccagtgcctaaacaggtggctggcattcgagacttcctcctgttccctgggtcagaggatagcggtttccatcataaaccaagatgatgagttcagcctttatccctcgtggttccgctagatgtaacttataggagttaacatttgaggactttgttctgcatcagatcttactatttgaatgtttactgttggattttgggcatcttattactgttactcaaaaacattgactctgcatcaagaaagaaacaagaaagcaataaaacaagaaataattcatgctcaca

SEQ ID NO: 21189 - DNA, 1567 bp, Homo sapiens
  ENST00000402522
tgctcctggtgccgccaccgtccgccggtgcctgttgctgccgccgccgcgggacctgctgtgtcctcagctgggtggagaagaggcgggcgccgagccgaggggagccccctccccgtccccccgcggcgggaagagcgcagccagccgggtgcgatggactccccgcccgcccaggccgtccccaggatgcccccaagcacctgcgcgtcccggcccggccccgggctctgagcgcgccgcggcacaggtttctgcatatgaagtgtgtaaaatagattgcttgatccaaaacagaaaaacagtgataactgttttgctgagttcccagacccttcccaagatggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaatgctcatcatcactgtaggggacctttgaaagagctgccggagaaggtgaggaagaaagccctgcctggaaagcaacagtgaaccaccagtgtcagcaacgtgaagcttgctgcaaggcctgcagtcatgatgaacccagcagcttctagttcatcccagtggccctgagactatttatcctgtgacttcacacgcgcttggaagttttgttgtgatcttcgctgagtctgtgcggaaatcacaggctagattttagattttttacttttcagcatgtgacttaaagttctgttgacttggggaaagggctgataatcttgtgctaaatcactgatggaatataaattaaaatctccatctctcagtcaatccaagtgtccatcaatggtagactggataaagaaaatgtggtacatacacaccatggaatactatgcagccataaaaagaaacgagatcacgtcctttctaggaacatggatggagctggaaaccattatcctcagcaaactaacaaaggaagagaaaaccaaacaccacatgttctcatttataagtgggagctgaacaatgagaacacgtggacacagggaggagaacaacacacactggggcctgtcacggggcggggtgaggggagggagagcattaggaaaaacagctaatacatgctaggcttgatatctaggcgatgggttggtaggtgcagcaaaccaccatggcacacatttacctatgtaacaaacctgcacatcctgcacatgtaccctgaaacttagaaataaaaatttttcaaaagggaaaaa

SEQ ID NO: 21190 - DNA, 1987 bp, Homo sapiens
  ENST00000446803
gccccgcgggcgcgacctctcggggcagtgacgaactgggtggagcccgccgccgccgccgccgccgccggggagagcgatgccccggccccgccgctccccaagcccgcccccggccgcccgcgggcccacgggccggcggcgggagtgagcgggagccggcgggcgaagagccgccgcccggcccgcgatgtcaccattgttcagctgggtggccaaggtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctatt

SEQ ID NO: 21191 - DNA, 455 bp, Homo sapiens
  ENST00000491553
cgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggtgagagaggacaagcaattcttaccttggaaccttctttacaaggaattttagctccactgatttttctgtccttagggaaaaccagatggtcattgacatatcattatttgtctttagttatttacttatgactatttagtaagcagctaatacacatctgaagctt

SEQ ID NO: 21192 - DNA, 2977 bp, Homo sapiens
  ENST00000510573
gtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaacatctcctaccgtaatgccctgcggaaaaaacttcattcttcttcctctgtgccaaattttctaaaatttctggctcctgtagatgaaaataacacctctgattttatgaacacaaaaagggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgttttcttgttggttcctttttgagtgtcactgtgtttgtaaagagcattcacaatacggtggaatttcaaaagctggaagagctcgagatcatgcctcaggcaaaggcgtgggtccatcgttcttccg

SEQ ID NO: 21193 - DNA, 530 bp, Homo sapiens
  ENST00000513936
gaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcaggagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggact

SEQ ID NO: 21194 - DNA, 580 bp, Homo sapiens
  ENST00000509761
agacaccaaagggaggttgtattcaccaactttgaaaagccggctctcgccttgtcttccatcactaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccagg

SEQ ID NO: 21195 - DNA, 755 bp, Homo sapiens
  ENST00000443855
aaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaatgtggatccttcacctgtgggtgagtctaagcaccgcccaggtcagtcttcagctcctgctcctccacctcgtcttaacccctccgcctcctcgccaaacttttttaagtacctaaaacataattccagtggagaacaaagtgggaatgctgtgccaaagagggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggcccttt

SEQ ID NO: 21196 - DNA, 679 bp, Homo sapiens
  ENST00000421339
tccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagaacctcactgtggatcgccatcgttggcctgtactgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaag

SEQ ID NO: 21197 - DNA, 627 bp, Homo sapiens
  ENST00000469803
tcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaatgtggatccttcacctgtgggtgagtctaagcaccgcccaggtcagtcttcagctcctgctcctccacctcgtcttaacccctccgcctcctcgccaaacttttttaagtacctaaaacataattccagtggagaacaaagtgggaatgctgtgccaaagagcatctcctaccgtaatgccctgcggaaaaaacttcattcttcttcctctgtgccaaattttctaaaatttctggctcctgtagatgaaaataacacctctgattttatgaacacaaaaagggactttgaatccaaagcaaaccatcttggtgattctggtgggactcctgtgaagacccggaggcattcctggaggcagcagatattcctccgagtagccaccccgcagaaggcgtgcgattcttccagcagatatgaagtctagcattcctagaggaacgtcatgcaccaggtaaattccgccatgttgcctcttaatgcgc

SEQ ID NO: 21198 - DNA, 572 bp, Homo sapiens
  ENST00000511238
attccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatgccttcatcttgtgggatgtggatccgatccgtgtagatccgatcgctcaccatg

SEQ ID NO: 21199 - DNA, 1713 bp, Homo sapiens
  ENST00000401554
agatgggctctgaatagaggaaggcaggacactcttgagatgggatggggtttctcacagcaccgtacagggaccacctgcaagatctcttgaggggcttgtgaaaaacacatccctgaggtcaccattcttgacctgctgcttattgagtttctgatgcctgggatgtgcaggtttaacaagcccccagatgatcctaataggattcctgcctgaaaattgctgggtgaaggctcttccccctccaagtgataaagaaggaaaagattgatcctggaagaacatccgttagatgagcaaaattttgtggagcacttcatgaagaggaattactaggtcatttagaaatatgtttgaattgtggatcatcttgtaggcctttctggcatatttctccacttagatccacaagacacatcgaatgtctttttataaaggggttttttaatgcccatgtttgaccctctccacttaacagtcccattctcattttatatgtgaaggtaatctgctttacagaaaaatgtaaaggacctgcacttctctgctttgtgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcg

SEQ ID NO: 21200 - DNA, 2990 bp, Homo sapiens
  ENST00000407365
acagctgttccccagcctggtagtgaacccagaggcctgtcttgctgtgcagtgggacaggaagttgcatttgggagtctcatagaacacactggaagatgtgttttagcttggccagtttcatgcaggacagattttctgcataaagaaaatcaatgacagtttctgaaactgcatcctggaagccttgaccagtttggggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgttttcttgttggttcctttttgagtgtcactgtgtttgtaaagagcattcacaatacggtggaatttcaaaagctggaagagctcgagatcatgcctcaggcaaaggcgtgggtccatcgttcttccgagagggtttgtgtggcgactacaccctcagcgtccctggcaaggtgcagttggctctcgcccattcttgttatggaaacctaagatgatcattgggaagatcagtgatcttgggtcattgatccctggctcagaggatagcggtttccatcataaaccaagatgatgagttcagcctttatccctcgtggttccactagatgtaacttaaaggagttaacatttgaggactttgttctacatcagattttactatttgaatgtttaagatcactttattgaatttgaagatcatcaaattaaataaaatgatttatttaatttggatatcctgatcactgtcaagtgaaatggatctctctctttggtatttaaggaagtttgtctttaaaaaaaaaatagagtgttttcatacatttttgcttatcccataagtacagttgatcaaagtcatagtaggtaaatgctttatgggacagctgacaccttttagaccctaccaggtattgctagcatgtgagctgcagttgtggggtctgagatatttctttgtggtagtttcatacccatactatagagtcatgtatttatttttgcctgttgtgtgatgtaatgcaatcatgttcctttgagtctccatcccttggaaatctgacttcttgcagaaggagtaggcacatcaagatattcaggggtgccccaagagtctgggactttcaaaaaaaaaagatcaggctgaaactgcagtcagatttatgacagctgacagtttttcagaggtcgcacacagtgactctcctctctcaggatgacgaggacctgtgccttcaacaagcaaaatgctgctcacggttgtcctgcttgcagccagtcactgtgtaaagcctctctgatgtgcacttaagagtgggttgctttctcacaaagatggggttctgtgcagtcacaggtcacttccttgacaacacaatcatttctgatctttatcactgtaaccacgtcttctattccataggagtttcttttgattctctcagttgcggggggcatctcttaatcctggggtaaaaggagagattgccatacttagactcactgtgagtctccccggccatttcacgaggagaccacagtgctgccaccagtgcctaaacaggtggctggcattcgagacttcctcctgttccctgggtcagaggatagcggtttccatcataaaccaagatgatgagttcagcctttatccctcgtggttccgctagatgtaacttataggagttaacatttgaggactttgttctgcatcagatcttactatttgaatgtttactgttggattttgggcatcttattactgttactcaaaaacattgactctgcatcaagaaagaaacaagaaagcaataaaacaagaaataattcatgctcacatt

SEQ ID NO: 21201 - DNA, 608 bp, Homo sapiens
  ENST00000475531
gatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttggtgagcattagtaaatctgtttgccagaaccagccttctcttattagaggggaaacatttcctgtctctccgtggtgattcttatttttatacctgtagctcttaccagaacagggtattgtttgatagtctaagattagtcaggggtgggttttgtgactttggagtcctccttaacttctgataatcacggggcttccctagatgccttcatcttgtgggatgtggatccgatccgtgtagatccgatcgctcaccatgagggtctccctagagcagacatttggaggacttggctgaggagccacaggtgtatgtttctcatgaattgccttcctcagccactctgggttgtgagtattgactgatgctgactgtgggcctctgggccct

SEQ ID NO: 21202 - DNA, 992 bp, Homo sapiens
  ENST00000406664
gagaaatttttccttcggctcataaatgggtaaaaagacgttaacaaacaagcagactccactttggaaatgatagcccttctattgcagagtaatttgaagctctctgaagctcactctaatgacttcataaatcaaagctgcagcttgtaaagatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgttttcttgttgg

SEQ ID NO: 21203 - DNA, 566 bp, Homo sapiens
  ENST00000405444
aacccatagttgatgtatctaacctaacagaattttcagagaaaagaagtgaaataagaactaaaaataaatttttatgtctttaaaaatgagaggttttttttttttttttggcttttggaaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaaga

SEQ ID NO: 21204 - DNA, 613 bp, Homo sapiens
  ENST00000492180
ataagaactaaaaataaatttttatgtctttaaaaatgagaggttttttttttttttttggcttttggaaggtgagtatcaaaaacctgtacttaatgttaccttggaattatttctagatgtttcttatatccttttgtcccaagtaaaattattaccttctcagtgcgtagtttttcttatttattacttctagtaccaagtgtagagctaagcgtagaggagacgcttcacaggtgcgcattgtcgtgattgcagacgcctgcctgtacttgtggggtttttctcagttttagtacgtgatgacttttctttctataacaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgc

SEQ ID NO: 21205 - DNA, 2383 bp, Homo sapiens
  ENST00000615497
cccaggtttctgcatatgaagtgtgtaaaatagattgcttgatccaaaacagaaaaacagtgataactgttttgctgagttcccagacccttcccaagatggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgttttcttgttggttcctttttgagtgtcactgtgtttgtaaagagcattcacaatacggtggaatttcaaaagctggaagagctcgagatcatgcctcaggcaaaggcgtgggtccatcgttcttccg

SEQ ID NO: 21206 - DNA, 6364 bp, Homo sapiens
  ENST00000377636
gcggccgcggggaccctcggcgtggtcctctgaccctgcaaacccgcgacggaggaaggggaggtcctgcccgaggcgccagcccaaggaggaggatgcccatttaacccgccctcgcctgccgggcgcttgcctcggtgcccgccgccggagcctccgagccgcgcccgtggaagtgctgcatggggcagggctgctgaagcgcggagttcggggtcgcgccgctcccaggcaggcgcgggagcccggtgcggcagttggcacagtttcggcggcgccttctgcgcgggagtggggggcgcggtgcgcccggccggcctccgcggtgccctggtgaggcgagagttatggagccgcccagctgcattcaggatgagccgttcccgcaccccctggagcccgagccgggcgtctcagctcagcccggccccgggaagccaagcgataagcggttccggctgtggtacgttggggggtcgtgcctggaccacaggaccacgctgcctatgctgccctggctcatggccgagatccgcaggcgcagccagaagcccgaggcgggcggctgcggggcgccggcggcccgagaggtgatcctggtgctcagcgcgcccttcctgcgttgcgtccccgcgccgggcgctggggcctcggggggcactagtccgtcggccacgcagcccaacccggcggtattcatcttcgagcacaaggcgcagcatatctcgcgcttcatccacaacagccacgacctcacctactttgcctacctgatcaaggcgcagcccgacgaccccgagtcgcagatggcctgccacgttttccgcgccacagaccccagccaggttcctgatgttattagcagcataaggcaattatctaaagcggccatgaaagaggatgccaaacccagcaaagataatgaggacgccttttacaactctcagaagttcgaagtcctgtactgtggaaaggtgaccgtgacccacaagaaggccccctcaagcctcatcgatgactgcatggagaagttcagcctgcacgaacagcagcgcctgaagatccaaggggagcagcgcggtccggacccaggagaggacctggctgacttggaggtggtggtgcccgggtcccccggagactgcctgccggaggaggctgacggcaccgacacccaccttggcttacctgccggggccagccagcctgccctgaccagctctcgggtctgcttccctgagcggattttggaagattctggctttgatgagcagcaggagtttcggtctcggtgcagcagtgtcaccggcgtgcaacggagagttcacgagggcagccagaaatcccagccgcgacggagacacgcgagcgcacccagtcacgtccagccctcggactcggagaagaacaggaccatgctcttccaggttgggcgatttgagattaaccttatcagtccagacactaaatcagttgtgctagaaaagaattttaaagatatctcctcttgttctcagggtataaagcatgtggatcactttggctttatctgccgggagtctccagagcctggacttagccagtatatttgttatgtattccagtgtgccagcgaatctctggttgatgaggtaatgctgactctgaaacaggccttcagtacggcggctgccctgcagagtgccaagacgcagattaaactgtgtgaggcctgcccgatgcactctttgcataagctctgtgaaaggattgaaggtctctacccaccaagagccaagctggtgatacagaggcatctctcatcactgacagataatgagcaagctgacatctttgaaagagttcagaaaatgaagccagtcagtgaccaggaagaaaatgaacttgtgattttacacctgaggcagctgtgtgaagccaagcagaagacacacgtgcacatcggggaaggcccttctactatttcaaatagtacaatcccagaaaatgcaacaagcagtggaaggttcaaacttgacattctgaaaaataaagctaagagatccttaactagctccctggaaaatatcttctcaaggggagctaacagaatgagaggtcggcttggaagtgtggacagttttgaacggtccaacagtcttgcttcagagaaggactactcaccaggggattctccaccagggacaccgccagcgtccccaccgtcctcagcttggcaaacgtttcccgaagaggattccgactccccgcagtttcgaagacgggcacacacgttcagccacccaccttcaagcacaaagagaaagctgaatttgcaggatgggagggctcagggtgtgcgttcccctctgctgaggcagagctccagtgaacagtgcagcaatctttcgtcagttcgacgcatgtacaaggagagtaattcttcctccagtcttccaagtcttcacacttccttctctgccccttccttcactgccccctctttcctgaaaagcttttaccagaattcaggtagactgtccccacagtatgaaaatgaaatcagacaagacactgcttcagaatcaagtgatggagaagggagaaaaaggacctcatctacctgcagcaatgagtccctaagtgtgggaggaacctctgtcactcctcgccggatctcctggcggcagcgcattttcctcagggttgcttctcccatgaacaaatctccctcagcaatgcaacagcaagatggattggacaggaacgagctgctgccactgtcccccctctctccaaccatggaggaggaaccgctggttgtattcctgtctggggaggatgacccagaaaagattgaagaaagaaagaaatcaaaagaactgaggagcttgtggagaaaagctatacaccaacaaatcttgttacttcgaatggaaaaagaaaaccagaaacttgaagcaagcagagatgaactccagtccagaaaagttaaattagactatgaagaagttggtgcatgtcagaaagaggtcttaataacttgggataagaagttgttaaactgcagagctaaaatcagatgtgatatggaagatattcatactcttcttaaagaaggagttcccaaaagtcgacgaggagaaatttggcagtttctggctttacagtaccgactcagacacagattgcctaataaacaacagcctcctgacatatcctataaggaacttttgaagcagctcactgctcagcagcatgcgattctcgtggatttaggaaggacgtttcctactcacccttacttttcagtacagcttgggccaggacagctgtcactgtttaacctcctgaaagcctattctttgctggacaaagaagtgggatactgtcaggggatcagctttgtggctggagtcctgcttctgcacatgagtgaagagcaagcctttgaaatgctgaaattcctcatgtatgacctcggcttccgcaagcagtacagacctgacatgatgtcgctgcagattcaaatgtaccagctgtccaggctccttcatgactatcacagagatctctacaatcaccttgaagaaaatgaaatcagccccagtctttatgctgccccctggttcctcacattgtttgcctctcagttttcattaggatttgtagccagagtttttgatattatttttcttcagggaactgaagttatattcaaggttgcactcagcctactgagcagccaagagacacttataatggaatgtgagagctttgaaaatattgttgagtttcttaaaaacacgctacctgatatgaatacctctgaaatggaaaaaattattacccaggtttttgagatggatatttctaagcagttgcatgcctatgaggtggaatatcatgtgctacaggatgagcttcaggaatcttcatattcctgtgaggatagtgaaactttggagaagctggagagggccaatagccaactgaaaagacaaaacatggacctcctagaaaaattacaggtagctcatactaaaatccaggccttggaatcaaacctggaaaatcttttgacgagagagaccaaaatgaagtctttaatccggaccctggaacaagaaaaaatggcttatcaaaagacagtggagcaactccggaagctgctgcccgcggatgctctagtcaattgtgacctgttgctgagagacctaaactgcaaccctaacaacaaagccaagataggaaataagccataattgaagaggcacggcctcagcagaaagtgctccttagaatactacagagaggaagagcctgcatgtcgctggcccaaggctggaccctgaagctgatggaaccacctaatactggtgctgagcgcctagtcacagcaggtggacctcgtgctcatcagagcatgccaatcctaagccattggacatatgtagactggtttttgttgttgctatgtacatataaatatatatataaaatgaacatagttcatgctttcagataaaatgagtagatgtatatttagattaatttttttagtcagaacttcatgaaatccacaccaaaggaaaggtaaactgaaatttcccttggacatatgtgaaatctttttgtctttatagtgaaacaaagccagagcatctttgtatattgcaatatacttgaaaaaaatgaatgtatttttttctccaaagaacagcatgtttcactcaatggtgaaaaggtggaaacatttatgtaactttatgtgtatctgtcttgatatctactgacattgtctatatgaggaaaatgattactggtcatgctcctgtgagttttttgggaaggtagggtcatttctccctgcctgctttgtgccaactagcatgttgcatctacatgcattatgagtctggttaggcattactttaaacatacataaagagacagtaggacattgtggctgagtctacccagctcaaggtaaaggagaatgttgctaattttttagcaaactagaccagcattattactcaaactaaaaatatcacacctgaaaaatttaatttaggacctaaaatgtctagattagctttctgctttttttatttgaataactcattcagttgtgaatgaattcctctttatttggtgccacagtcaccaaatgacaaggatttgccactttcccaccaaattgtgagtgcttgtaatttaggtctctctaccttaaattcagtataaggaaacgtaattatgattgattttttccaaagatgacaagctgtgttgaaatacattttttcttttgaccaattgacagaatctaataagctttaataatcttccccttttatgtgaaaagttttgagaactgtgaaatgtttaggaacaaactgttgaaatccattggaagggaaaaaagaaagtggtaccagtgttaccagctcaactaaaacctgcaattctgcatttcaactcttcacttcctcagcctacaaatagctcattagatgacattcacgcatgctgggtataggcaaggaaagtaattttcaaagtacatttgcagttctctttttcagagatgattctatgatagtgcctctgaaagttgatgcagcatttttgcctttccaaaaagtatttatcctcactgctttttgcagtacttgtattttcacagatggattatctggggtaattttcttcaaagggagtttgttatacacagtgaaaatgtattatagagtagaatagtaaagctctaggggtttcagaaagctttgatgaacagatgacaaacatctgaaaccccctccgcactgttacccagtgtgtatataatgacttgttatagctcagtgtgcccttgaatccatacagtttcttaaaagacaataaaatcttattaataaagttaatgtaacttctaagttctagaaaatgctgattctgtctgccccattcaattgggggctactaattgatttgttgcttggatttcctgagaatttctctatttgtaggaggggttttttctttttacggtctgttgatgacaattactttatgggtgtgatgcaccgatggtagccaaggaatctgttggggaagttcggaaagaaaccttttctttcttttattcagtttaaagtaaactttatcctggatgtttagaatcaacattaagagttatattatggtgttcagagattaagctgacttggatacaatattttcttttgaaaatgaattttctttttcatttgtgatttttaaaaaatgttgcaccagttatgcttcatgcatcgttacatcttcatcaggttaatgtaatgtctagttcctttgcaataaatatattgctgcagctttc

SEQ ID NO: 21207 - DNA, 759 bp, Homo sapiens
  ENST00000478591
acttcctagccatgtgaacttggggcaattacttcatctctttctgcctcagctttctgtctataaagtggacctaatagtaattgcctaccttatagttgagttgttttctgagtgcatgtgcttagtagctaggcaccctcaataaatgttttattaatgctcagtcagcaacgggtgatgttattgttaatattgtcattatcgagttcccaaaagtcgacgaggagaaatttggcagtttctggctttacagtaccgactcagacacagattgcctaataaacaacagcctcctgacatatcctataaggaacttttgaagcagctcactgctcagcagcatgcgattctcgtggatttaggaaggacgtttcctactcacccttacttttcagtacagcttgggccaggacagctgtcactgtttaacctcctgaaagcctattctttgctggacaaagaagtgggatactgtcaggggatcagctttgtggctggagtcctgcttctgcacatgagtgaagagcaagcctttgaaatgctgaaattcctcatgtatgacctcggcttccgcaagcagtacagacctgacatgatgtcgctgcagattcaaatgtaccagctgtccaggctccttcatgactatcacagagatctctacaatcaccttgaagaaaatgaaatcagccccagtctttatgctgccccctggttcctcacattgtttgcctctcagttttcattaggatttgtagc

SEQ ID NO: 21208 - DNA, 458 bp, Homo sapiens
  ENST00000493487
gcttttgccatatctcagcaaccaactactttttcaagatgtcgatttttagtacaagataaagggtcaatggtttgttattgatggagaagggagaaaaaggacctcatctacctgcagcaatgagtccctaagtgtgggaggaacctctgtcactcctcgccggatctcctggcggcagcgcattttcctcagggttgcttctcccatgaacaaatctccctcagcaatgcaacagcaagatggattggacaggaacgagctgctgccactgtcccccctctctccaaccatggaggaggaaccgctggttgtattcctgtctggggaggatgacccagaaaagattgaagaaagaaagaaatcaaaagaactgaggagcttgtggagaaaagctatacaccaacaaatcttgttacttcgaatggaaaaagaaaaccagaaacttgaagcaagca

SEQ ID NO: 21209 - DNA, 847 bp, Homo sapiens
  ENST00000413735
gataatgagcaagctgacatctttgaaagagttcagaaaatgaagccagtcagtgaccaggaagaaaatgaacttgtgattttacacctgaggcagctgtgtgaagccaagcagaagacacacgtgcacatcggggaaggcccttctactatttcaaatagtacaatcccagaaaatgcaacaagcagtggaaggttcaaacttgacattctgaaaaataaagctaagagatccttaactagctccctggaaaatatcttctcaaggggagctaacagaatgagaggtcggcttggaagtgtggacagttttgaacggtccaacagtcttgcttcagagaaggactactcaccaggggattctccaccagggacaccgccagcgtccccaccgtcctcagcttggcaaacgtttcccgaagaggattccgactccccgcagtttcgaagacgggcacacacgttcagccacccaccttcaagcacaaagagaaagctgaatttgcaggatgggagggctcagggtgtgcgttcccctctgctgaggcagagctccagtgaacagtgcagtgatggagaagggagaaaaaggacctcatctacctgcagcaatgagtccctaagtgtgggaggaacctctgtcactcctcgccggatctcctggcggcagcgcattttcctcagggttgcttctcccatgaacaaatctccctcagcaatgcaacagcaagatggattggacaggaacgagctgctgccactgtcccccctctctccaaccatggaggaggaaccgctggttgtattcctgtctggggaggatgacccagaaaagattgaagaaagaa

SEQ ID NO: 21210 - DNA, 336 bp, Homo sapiens
  ENST00000488955
ggctcagggtgtgcgttcccctctgctgaggcagagctccagtgaacagtgcagcaatctttcgtcagttcgacgcatgtacaaggagagtaattcttcctccagtcttccaagtcttcacacttccttctctgccccttccttcactgccccctctttcctgaaaagcttttaccagaattcaggtagactgtccccacagtatgaaaatgaaatcagtgatggagaagggagaaaaaggacctcatctacctgcagcaatgagtccctaagtgtgggaggaacctctgtcactcctcgccggatctcctggcggcagcgcattttcctcagggt

SEQ ID NO: 21211 - DNA, 6182 bp, Homo sapiens
  ENST00000377625
gcggccgcggggaccctcggcgtggtcctctgaccctgcaaacccgcgacggaggaaggggaggtcctgcccgaggcgccagcccaaggaggaggatgcccatttaacccgccctcgcctgccgggcgcttgcctcggtgcccgccgccggagcctccgagccgcgcccgtggaagtgctgcatggggcagggctgctgaagcgcggagttcggggtcgcgccgctcccaggcaggcgcgggagcccggtgcggcagttggcacagtttcggcggcgccttctgcgcgggagtggggggcgcggtgcgcccggccggcctccgcggtgccctggtgaggcgagagttatggagccgcccagctgcattcaggatgagccgttcccgcaccccctggagcccgagccgggcgtctcagctcagcccggccccgggaagccaagcgataagcggttccggctgtggtacgttggggggtcgtgcctggaccacaggaccacgctgcctatgctgccctggctcatggccgagatccgcaggcgcagccagaagcccgaggcgggcggctgcggggcgccggcggcccgagaggtgatcctggtgctcagcgcgcccttcctgcgttgcgtccccgcgccgggcgctggggcctcggggggcactagtccgtcggccacgcagcccaacccggcggtattcatcttcgagcacaaggcgcagcatatctcgcgcttcatccacaacagccacgacctcacctactttgcctacctgatcaaggcgcagcccgacgaccccgagtcgcagatggcctgccacgttttccgcgccacagaccccagccaggttcctgatgttattagcagcataaggcaattatctaaagcggccatgaaagaggatgccaaacccagcaaagataatgaggacgccttttacaactctcagaagttcgaagtcctgtactgtggaaaggtgaccgtgacccacaagaaggccccctcaagcctcatcgatgactgcatggagaagttcagcctgcacgaacagcagcgcctgaagatccaaggggagcagcgcggtccggacccaggagaggacctggctgacttggaggtggtggtgcccgggtcccccggagactgcctgccggaggaggctgacggcaccgacacccaccttggcttacctgccggggccagccagcctgccctgaccagctctcgggtctgcttccctgagcggattttggaagattctggctttgatgagcagcaggagtttcggtctcggtgcagcagtgtcaccggcgtgcaacggagagttcacgagggcagccagaaatcccagccgcgacggagacacgcgagcgcacccagtcacgtccagccctcggactcggagaagaacaggaccatgctcttccaggttgggcgatttgagattaaccttatcagtccagacactaaatcagttgtgctagaaaagaattttaaagatatctcctcttgttctcagggtataaagcatgtggatcactttggctttatctgccgggagtctccagagcctggacttagccagtatatttgttatgtattccagtgtgccagcgaatctctggttgatgaggtaatgctgactctgaaacaggccttcagtacggcggctgccctgcagagtgccaagacgcagattaaactgtgtgaggcctgcccgatgcactctttgcataagctctgtgaaaggattgaaggtctctacccaccaagagccaagctggtgatacagaggcatctctcatcactgacagataatgagcaagctgacatctttgaaagagttcagaaaatgaagccagtcagtgaccaggaagaaaatgaacttgtgattttacacctgaggcagctgtgtgaagccaagcagaagacacacgtgcacatcggggaaggcccttctactatttcaaatagtacaatcccagaaaatgcaacaagcagtggaaggttcaaacttgacattctgaaaaataaagctaagagatccttaactagctccctggaaaatatcttctcaaggggagctaacagaatgagaggtcggcttggaagtgtggacagttttgaacggtccaacagtcttgcttcagagaaggactactcaccaggggattctccaccagggacaccgccagcgtccccaccgtcctcagcttggcaaacgtttcccgaagaggattccgactccccgcagtttcgaagacgggcacacacgttcagccacccaccttcaagcacaaagagaaagctgaatttgcaggatgggagggctcagggtgtgcgttcccctctgctgaggcagagctccagtgaacagtgcagtgatggagaagggagaaaaaggacctcatctacctgcagcaatgagtccctaagtgtgggaggaacctctgtcactcctcgccggatctcctggcggcagcgcattttcctcagggttgcttctcccatgaacaaatctccctcagcaatgcaacagcaagatggattggacaggaacgagctgctgccactgtcccccctctctccaaccatggaggaggaaccgctggttgtattcctgtctggggaggatgacccagaaaagattgaagaaagaaagaaatcaaaagaactgaggagcttgtggagaaaagctatacaccaacaaatcttgttacttcgaatggaaaaagaaaaccagaaacttgaagcaagcagagatgaactccagtccagaaaagttaaattagactatgaagaagttggtgcatgtcagaaagaggtcttaataacttgggataagaagttgttaaactgcagagctaaaatcagatgtgatatggaagatattcatactcttcttaaagaaggagttcccaaaagtcgacgaggagaaatttggcagtttctggctttacagtaccgactcagacacagattgcctaataaacaacagcctcctgacatatcctataaggaacttttgaagcagctcactgctcagcagcatgcgattctcgtggatttaggaaggacgtttcctactcacccttacttttcagtacagcttgggccaggacagctgtcactgtttaacctcctgaaagcctattctttgctggacaaagaagtgggatactgtcaggggatcagctttgtggctggagtcctgcttctgcacatgagtgaagagcaagcctttgaaatgctgaaattcctcatgtatgacctcggcttccgcaagcagtacagacctgacatgatgtcgctgcagattcaaatgtaccagctgtccaggctccttcatgactatcacagagatctctacaatcaccttgaagaaaatgaaatcagccccagtctttatgctgccccctggttcctcacattgtttgcctctcagttttcattaggatttgtagccagagtttttgatattatttttcttcagggaactgaagttatattcaaggttgcactcagcctactgagcagccaagagacacttataatggaatgtgagagctttgaaaatattgttgagtttcttaaaaacacgctacctgatatgaatacctctgaaatggaaaaaattattacccaggtttttgagatggatatttctaagcagttgcatgcctatgaggtggaatatcatgtgctacaggatgagcttcaggaatcttcatattcctgtgaggatagtgaaactttggagaagctggagagggccaatagccaactgaaaagacaaaacatggacctcctagaaaaattacaggtagctcatactaaaatccaggccttggaatcaaacctggaaaatcttttgacgagagagaccaaaatgaagtctttaatccggaccctggaacaagaaaaaatggcttatcaaaagacagtggagcaactccggaagctgctgcccgcggatgctctagtcaattgtgacctgttgctgagagacctaaactgcaaccctaacaacaaagccaagataggaaataagccataattgaagaggcacggcctcagcagaaagtgctccttagaatactacagagaggaagagcctgcatgtcgctggcccaaggctggaccctgaagctgatggaaccacctaatactggtgctgagcgcctagtcacagcaggtggacctcgtgctcatcagagcatgccaatcctaagccattggacatatgtagactggtttttgttgttgctatgtacatataaatatatatataaaatgaacatagttcatgctttcagataaaatgagtagatgtatatttagattaatttttttagtcagaacttcatgaaatccacaccaaaggaaaggtaaactgaaatttcccttggacatatgtgaaatctttttgtctttatagtgaaacaaagccagagcatctttgtatattgcaatatacttgaaaaaaatgaatgtatttttttctccaaagaacagcatgtttcactcaatggtgaaaaggtggaaacatttatgtaactttatgtgtatctgtcttgatatctactgacattgtctatatgaggaaaatgattactggtcatgctcctgtgagttttttgggaaggtagggtcatttctccctgcctgctttgtgccaactagcatgttgcatctacatgcattatgagtctggttaggcattactttaaacatacataaagagacagtaggacattgtggctgagtctacccagctcaaggtaaaggagaatgttgctaattttttagcaaactagaccagcattattactcaaactaaaaatatcacacctgaaaaatttaatttaggacctaaaatgtctagattagctttctgctttttttatttgaataactcattcagttgtgaatgaattcctctttatttggtgccacagtcaccaaatgacaaggatttgccactttcccaccaaattgtgagtgcttgtaatttaggtctctctaccttaaattcagtataaggaaacgtaattatgattgattttttccaaagatgacaagctgtgttgaaatacattttttcttttgaccaattgacagaatctaataagctttaataatcttccccttttatgtgaaaagttttgagaactgtgaaatgtttaggaacaaactgttgaaatccattggaagggaaaaaagaaagtggtaccagtgttaccagctcaactaaaacctgcaattctgcatttcaactcttcacttcctcagcctacaaatagctcattagatgacattcacgcatgctgggtataggcaaggaaagtaattttcaaagtacatttgcagttctctttttcagagatgattctatgatagtgcctctgaaagttgatgcagcatttttgcctttccaaaaagtatttatcctcactgctttttgcagtacttgtattttcacagatggattatctggggtaattttcttcaaagggagtttgttatacacagtgaaaatgtattatagagtagaatagtaaagctctaggggtttcagaaagctttgatgaacagatgacaaacatctgaaaccccctccgcactgttacccagtgtgtatataatgacttgttatagctcagtgtgcccttgaatccatacagtttcttaaaagacaataaaatcttattaataaagttaatgtaacttctaagttctagaaaatgctgattctgtctgccccattcaattgggggctactaattgatttgttgcttggatttcctgagaatttctctatttgtaggaggggttttttctttttacggtctgttgatgacaattactttatgggtgtgatgcaccgatggtagccaaggaatctgttggggaagttcggaaagaaaccttttctttcttttattcagtttaaagtaaactttatcctggatgtttagaatcaacattaagagttatattatggtgttcagagattaagctgacttggatacaatattttcttttgaaaatgaattttctttttcatttgtgatttttaaaaaatgttgcaccagttatgcttcatgcatcgttacatcttcatcaggttaatgtaatgtctagttcctttgcaataaatatattgctgcagctttcttgacgt

SEQ ID NO: 21212 - DNA, 6347 bp, Homo sapiens
  ENST00000431480
gcggccgcggggaccctcggcgtggtcctctgaccctgcaaacccgcgacggaggaaggggaggtcctgcccgaggcgccagcccaaggaggaggatgcccatttaacccgccctcgcctgccgggcgcttgcctcggtgcccgccgccggagcctccgagccgcgcccgtggaagtgctgcatggggcagggctgctgaagcgcggagttcggggtcgcgccgctcccaggcaggcgcgggagcccggtgcggcagttggcacagtttcggcggcgccttctgcgcgggagtggggggcgcggtgcgcccggccggcctccgcggtgccctggtgaggcgagagttatggagccgcccagctgcattcaggatgagccgttcccgcaccccctggagcccgagccgggcgtctcagctcagcccggccccgggaagccaagcgataagcggttccggctgtggtacgttggggggtcgtgcctggaccacaggaccacgctgcctatgctgccctggctcatggccgagatccgcaggcgcagccagaagcccgaggcgggcggctgcggggcgccggcggcccgagaggtgatcctggtgctcagcgcgcccttcctgcgttgcgtccccgcgccgggcgctggggcctcggggggcactagtccgtcggccacgcagcccaacccggcggtattcatcttcgagcacaaggcgcagcatatctcgcgcttcatccacaacagccacgacctcacctactttgcctacctgatcaaggcgcagcccgacgaccccgagtcgcagatggcctgccacgttttccgcgccacagaccccagccaggttcctgatgttattagcagcataaggcaattatctaaagcggccatgaaagaggatgccaaacccagcaaagataatgaggacgccttttacaactctcagaagttcgaagtcctgtactgtggaaaggtgaccgtgacccacaagaaggccccctcaagcctcatcgatgactgcatggagaagttcagcctgcacgaacagcagcgcctgaagatccaaggggagcagcgcggtccggacccaggagaggacctggctgacttggaggtggtggtgcccgggtcccccggagactgcctgccggaggaggctgacggcaccgacacccaccttggcttacctgccggggccagccagcctgccctgaccagctctcgggtctgcttccctgagcggattttggaagattctggctttgatgagcagcaggagtttcggtctcggtgcagcagtgtcaccggcgtgcaacggagagttcacgagggcagccagaaatcccagccgcgacggagacacgcgagcgcacccagtcacgtccagccctcggactcggagaagaacaggaccatgctcttccaggttgggcgatttgagattaaccttatcagtccagacactaaatcagttgtgctagaaaagaattttaaagatatctcctcttgttctcagggtataaagcatgtggatcactttggctttatctgccgggagtctccagagcctggacttagccagtatatttgttatgtattccagtgtgccagcgaatctctggttgatgaggtaatgctgactctgaaacaggccttcagtacggcggctgccctgcagagtgccaagacgcagattaaactgtgtgaggcctgcccgatgcactctttgcataagctctgtgaaaggattgaaggtctctacccaccaagagccaagctggtgatacagaggcatctctcatcactgacagataatgagcaagctgacatctttgaaagagttcagaaaatgaagccagtcagtgaccaggaagaaaatgaacttgtgattttacacctgaggcagctgtgtgaagccaagcagaagacacacgtgcacatcggggaaggcccttctactatttcaaatagtacaatcccagaaaatgcaacaagcagtggaaggttcaaacttgacattctgaaaaataaagctaagagatccttaactagctccctggaaaatatcttctcaaggggagctaacagaatgagaggtcggcttggaagtgtggacagttttgaacggtccaacagtcttgcttcagagaaggactactcaccaggggattctccaccagggacaccgccagcgtccccaccgtcctcagcttggcaaacgtttcccgaagaggattccgactccccgcagtttcgaagacgggcacacacgttcagccacccaccttcaagcacaaagagaaagctgaatttgcaggatgggagggctcagggtgtgcgttcccctctgctgaggcagagctccagtgaacagtgcagcaatctttcgtcagttcgacgcatgtacaaggagagtaattcttcctccagtcttccaagtcttcacacttccttctctgccccttccttcactgccccctctttcctgaaaagcttttaccagaattcaggtagactgtccccacagtatgaaaatgaaatcagtgatggagaagggagaaaaaggacctcatctacctgcagcaatgagtccctaagtgtgggaggaacctctgtcactcctcgccggatctcctggcggcagcgcattttcctcagggttgcttctcccatgaacaaatctccctcagcaatgcaacagcaagatggattggacaggaacgagctgctgccactgtcccccctctctccaaccatggaggaggaaccgctggttgtattcctgtctggggaggatgacccagaaaagattgaagaaagaaagaaatcaaaagaactgaggagcttgtggagaaaagctatacaccaacaaatcttgttacttcgaatggaaaaagaaaaccagaaacttgaagcaagcagagatgaactccagtccagaaaagttaaattagactatgaagaagttggtgcatgtcagaaagaggtcttaataacttgggataagaagttgttaaactgcagagctaaaatcagatgtgatatggaagatattcatactcttcttaaagaaggagttcccaaaagtcgacgaggagaaatttggcagtttctggctttacagtaccgactcagacacagattgcctaataaacaacagcctcctgacatatcctataaggaacttttgaagcagctcactgctcagcagcatgcgattctcgtggatttaggaaggacgtttcctactcacccttacttttcagtacagcttgggccaggacagctgtcactgtttaacctcctgaaagcctattctttgctggacaaagaagtgggatactgtcaggggatcagctttgtggctggagtcctgcttctgcacatgagtgaagagcaagcctttgaaatgctgaaattcctcatgtatgacctcggcttccgcaagcagtacagacctgacatgatgtcgctgcagattcaaatgtaccagctgtccaggctccttcatgactatcacagagatctctacaatcaccttgaagaaaatgaaatcagccccagtctttatgctgccccctggttcctcacattgtttgcctctcagttttcattaggatttgtagccagagtttttgatattatttttcttcagggaactgaagttatattcaaggttgcactcagcctactgagcagccaagagacacttataatggaatgtgagagctttgaaaatattgttgagtttcttaaaaacacgctacctgatatgaatacctctgaaatggaaaaaattattacccaggtttttgagatggatatttctaagcagttgcatgcctatgaggtggaatatcatgtgctacaggatgagcttcaggaatcttcatattcctgtgaggatagtgaaactttggagaagctggagagggccaatagccaactgaaaagacaaaacatggacctcctagaaaaattacaggtagctcatactaaaatccaggccttggaatcaaacctggaaaatcttttgacgagagagaccaaaatgaagtctttaatccggaccctggaacaagaaaaaatggcttatcaaaagacagtggagcaactccggaagctgctgcccgcggatgctctagtcaattgtgacctgttgctgagagacctaaactgcaaccctaacaacaaagccaagataggaaataagccataattgaagaggcacggcctcagcagaaagtgctccttagaatactacagagaggaagagcctgcatgtcgctggcccaaggctggaccctgaagctgatggaaccacctaatactggtgctgagcgcctagtcacagcaggtggacctcgtgctcatcagagcatgccaatcctaagccattggacatatgtagactggtttttgttgttgctatgtacatataaatatatatataaaatgaacatagttcatgctttcagataaaatgagtagatgtatatttagattaatttttttagtcagaacttcatgaaatccacaccaaaggaaaggtaaactgaaatttcccttggacatatgtgaaatctttttgtctttatagtgaaacaaagccagagcatctttgtatattgcaatatacttgaaaaaaatgaatgtatttttttctccaaagaacagcatgtttcactcaatggtgaaaaggtggaaacatttatgtaactttatgtgtatctgtcttgatatctactgacattgtctatatgaggaaaatgattactggtcatgctcctgtgagttttttgggaaggtagggtcatttctccctgcctgctttgtgccaactagcatgttgcatctacatgcattatgagtctggttaggcattactttaaacatacataaagagacagtaggacattgtggctgagtctacccagctcaaggtaaaggagaatgttgctaattttttagcaaactagaccagcattattactcaaactaaaaatatcacacctgaaaaatttaatttaggacctaaaatgtctagattagctttctgctttttttatttgaataactcattcagttgtgaatgaattcctctttatttggtgccacagtcaccaaatgacaaggatttgccactttcccaccaaattgtgagtgcttgtaatttaggtctctctaccttaaattcagtataaggaaacgtaattatgattgattttttccaaagatgacaagctgtgttgaaatacattttttcttttgaccaattgacagaatctaataagctttaataatcttccccttttatgtgaaaagttttgagaactgtgaaatgtttaggaacaaactgttgaaatccattggaagggaaaaaagaaagtggtaccagtgttaccagctcaactaaaacctgcaattctgcatttcaactcttcacttcctcagcctacaaatagctcattagatgacattcacgcatgctgggtataggcaaggaaagtaattttcaaagtacatttgcagttctctttttcagagatgattctatgatagtgcctctgaaagttgatgcagcatttttgcctttccaaaaagtatttatcctcactgctttttgcagtacttgtattttcacagatggattatctggggtaattttcttcaaagggagtttgttatacacagtgaaaatgtattatagagtagaatagtaaagctctaggggtttcagaaagctttgatgaacagatgacaaacatctgaaaccccctccgcactgttacccagtgtgtatataatgacttgttatagctcagtgtgcccttgaatccatacagtttcttaaaagacaataaaatcttattaataaagttaatgtaacttctaagttctagaaaatgctgattctgtctgccccattcaattgggggctactaattgatttgttgcttggatttcctgagaatttctctatttgtaggaggggttttttctttttacggtctgttgatgacaattactttatgggtgtgatgcaccgatggtagccaaggaatctgttggggaagttcggaaagaaaccttttctttcttttattcagtttaaagtaaactttatcctggatgtttagaatcaacattaagagttatattatggtgttcagagattaagctgacttggatacaatattttcttttgaaaatgaattttctttttcatttgtgatttttaaaaaatgttgcaccagttatgcttcatgcatcgttacatcttcatcaggttaatgtaatgtctagttcctttgcaataaatatattgctgcagctttcttgacgt

SEQ ID NO: 21213 - DNA, 7854 bp, Homo sapiens
  ENST00000253692
tgactgcatcacctggtctgtgaattttccattagaagcttggtgtgctgttaggtgaaagacttgctcagctatgcgtcattgggttttatcaacatataggcgaaaaaaatcctggtctctgagtgtacagctgagatgaaaatttcttttattggaggaagtattgagtgtgtgctctcaaatgcggcctcagttgagtagtgcattcctgagttttggaagcaaatttgcaaacaattgagagtcgtacagtgggtgttctaactggattcaggttttttctaatgtaattttttcacacgtaaattaaaaagtttagaaatgtcacacataacttcataacactttatggagaaatggttgtacttttaatttttttctttttatttatactccaactgactgagcagaggttgtacttctaaataactttgtggaagtttttagtaccataatttttataattttcattccagtcctttgatatttatgacagtacttctgaagcgcttactgagtgccggacactgttgtaagtgctttacggaacttgacttttttttttttttgagacggactctcgctctgtcgcccaggctggagtgcagtggtgcagtggctcgatctcggctcactgccacctctccctcatggtttcaaacacttctcctgcctcagcctcccaggtagccaggattatagccgcccgccaccactcccgactaattttattttgtatgttcttttttagtagagacggaggagtttcaccatgttggccaggctggtatcgacctcctgacctcaagtgatgtgtccatctcggcctcccaaggtgctggaattacaggtgtgagccactgtgctcggcctacctttttttttttgttttttgtttttttgaaaaggagtttcgctcttgtccaggctggagtataatggtgcgatctcagctcaccgcaatctccgcctcccagattcaagcgattctcctgcctcagcctcctcaggagctgggattacaggcgcccaccgccatgcccggctaatttttgtatttttagtagagacggggtttcactatattggccaggctggtctcgaactgctgacctcaagtaatccgcctgcctcagcctcccaaagtgctgggattacagacgtgatccaccaggatcacaccaggccgcgcctggcctgctttcattttaaaagtcaaatttgtcatccgcctcagtgcttgtaatcttttctgagtgagatactgaaatttgcagtttcgttttgcttgcacttgttcactggaccagtagtcactgttaaatgtaaaagtatctacttcctctgaaagttttttattcctttatttcctgcctgggcttgtcctccaccctacatgtatgcgtagtagatttagtgtttgttatcctaacctttaggtttagggattgactgggtttctgactttttatttggccaatgaggacgatacagaaaatgaagcattggtcattatcacattttaacgctgaaaaagtaagaaggacaaccccggaataaaatgatatcagtatcaagataaaagtttggaatgggagaaaaattctcaaagcctgaaagaaaatctgtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaagaattaagagcatggtatagcaacattaaagaaatacatattaccaacccgaggaaggttgttggccaacaagatttgatgatcaataatcctctttcacaggatgaagggagtctttggaacaaattcttccaagataaagaacttcgatcaatgattgaacaagatgtcaaaagaacgtttcctgaaatgcagtttttccagcaagaaaatgtgagaaaaattcttacagatgttcttttctgttatgccagagaaaacgagcagttgctttataaacagggcatgcacgaactgttagcacctatagtctttgtccttcactgtgaccaccaagcttttctacatgccagtgagtctgcacagcccagtgaggaaatgaaaactgtcttgaaccctgagtatctggaacatgatgcctatgcagtgttctcacaacttatggaaactgctgaaccttggttttcaacttttgagcatgatggtcagaaggggaaagaaacactgatgactcccattccctttgctagaccacaagatttagggccaacaattgctattgttactaaagtcaaccagatccaggatcatctactgaagaagcatgatattgagctttacatgcacttgaacagactagaaattgcaccacagatatatgggttaaggtgggtgcggctgctatttggacgagagttccccctgcaggaccttctggtggtctgggatgccttgtttgcagacggcctcagcctgggtttagtagattatatcttcgtagccatgttactttacatccgagatgctttgatctctagtaactaccagacctgtctcggccttctgatgcattacccattcatcggggatgtacactcactgattcttaaggctctgttccttagagatccaaagagaaatccaagaccagtgacttatcaattccatccaaatttagattattacaaagcacgaggagcagacctcatgaataaaagccggaccaatgccaaaggtgctcccctgaatataaataaggtctctaatagcctgattaattttggaagaaagttgatttccccagcaatggctccaggcagtgcaggtggccctgtacctggaggcaacagcagtagctcctcctctgttgtaattcctaccaggacctcagcagaggccccaagccatcacttgcaacagcaacagcagcagcagaggctgatgaaatcagaaagcatgcctgtgcaattgaacaaagggctaagttctaaaaacatcagttcatctccaagcgttgagagtttgcctggaggaagagaattcactggctctccaccttcatctgctactaaaaaagattccttttttagcaacatctcacgttctcgctcacacagcaaaactatgggcagaaaagaatctgaagaagaattagaagcccaaatttccttccttcaagggcagttgaatgacctggatgccatgtgcaaatactgtgcaaaggtgatggacactcatcttgtaaatattcaagatgtgatattacaagaaaatttggaaaaagaagatcaaattctggtttccctggcaggattaaaacagatcaaagacattctaaaaggttccctgcgttttaaccagagccagctagaggccgaagagaacgaacagatcaccattgcggacaaccactactgctccagcggccagggccagggccgaggccaaggccagagcgttcaaatgtcaggggccattaaacaggcctcttcagaaacgccagggtgcactgatagagggaattccgatgacttcatcctgatttccaaagatgatgatgggagcagtgccaggggctccttctccggccaggcccagcctcttcgcaccctcagaagcacctctgggaaaagccaggccccagtctgctccccactggtgttctcagatccactgatgggcccagcctcagcttcctccagcaaccccagctccagtcctgatgacgacagcagcaaggactctggcttcaccattgtgagtcccctggacatctgaccacagtgcccagtcctgccccacagggatctagccacccttcagtggccccaaggccagactgaggctcatccagtggagaaccttcttaaaccactgcttccttcccggcatgcattttgcattggtccagccctttgaaaccccttagagagaagcatatatggccacaaagcacagaggcttaggtttgccacatgcagacagggctttctgggcccttacctaatccccacccgactcttgctctgagttagagctgagttacgtacccagtatcacactcacagttagaaaagaccgaatcacaatttagaatcacttttcctctgtccccttctccccagctaagaatgtgtggcacctccatcagttatacttagaaggagcagaaatagttattttcgtatcttctatccctcaaagcatcagacatgggaaaattggtttataccaagaaagcttcctctgtggaaatctgtctcagcctactttattcctgcattgggaagccatatcgcagagctaaatgcaatagaatgaaccagaactagtggattccagggctgggggaaaaaaaaaaagaaaaaacctcattactgacctctcaaagttataaggatctctgcaaacaggatctaagcttaggaataatatttaggtgtgatatagtgttagatttttttgatgtattaaagaatgcatctccaatccttaggccatatcaactttggccatcaatatctctccttaaacaattatatttcaccttttagaatctttcatagccagaaaacaagattactgtaagccagttttagctgcactgatttcaaaagatataagaatattactatccttcaaatggaaaatgcgaccttgactttatgggataaacatctttcagacagtcagttttctagtcaggtttctctggtttcagagctgtatatacctgtcaactgaggaataaagggaaaaacccaagttcattcccacccaaagtcagaatccctcattggccttaaggtagcagtcataagacagagaattggacctagagtcccttctgtggggaataaggatacctagagaacattccacatgccaagaggatgcaggatttctacacaaccccttcccttcttggaagtcaagtgtaggtactgcagggcctgtgctcagctgtgaaccccgtatcctgggccccactgccgggaccgggtctgacatgccagtgccttcctgggctgagcacagattagagactctcccccttgtcagtcagcaccttaggaaaccatgatgggcacagagcatcacatgagctgtttctctccttaaagaagatccctggaaaggatgcttttcctctcctttgcctgcgcaggaattctaacaggagtgggtgaggatggcagagggacacagtgcctgtctcgcctccatcagggagagcagccatgccagggatgactagctctttgagcctgtcctcagaggatggcgaggcagccgggcagtggaggccttcatggtaacaaatgaaagctcagtatagaggaacagacactgtttacgtccctcccactgctaaccttatatatctctatagacaaatgtgataatgacatgatttcccacctgccctccaagaaaatggtgactcactctcaagtcagctactgtagagagggttctaattggttctgcaatttgctcttaaactctagcagggaactctcctcttaccacatcagcatgtaaggtgaataataactggttttgccagacagcaggttgtctgaccttcaaccactgggcaattgcctggcagatgcacacagtagctccctggcttctggctctgagtgttcctctcagcacctctgagtaagctgctgccaagcacatatccctatgacaacactttgtaaaagccgcggggcccccatacagcgagtgaccttgcaactgtgcagggttgccattggtcactttctcaccttgggaaggtgtcagtgttttcagttctaaggtaagaggtgtagagctgttcccaccagggctctgggacagactggaaaggaccacagacctggccatccctgggcagcagggccagtgtcacctgctgacctctagtatttcctttgccctagagctagagtcatgatagctgagggtcactcgccctgcaagagtcactaggcacccaccatgccaataaggctctccgctggctccctgcagttggctgggtgtttaatagtcactgaaaactcccagccctgctgcacactagaggcaggtcctctcggtcctctccatcctgtgcttctgtggcccccagcaagctcaccacctccttggaggagagagacatacaaggacagtgggtcatgggtagtaccagcctcaaattcccacaggctcatactcagacaattgtattactgccttatgttttttaagtgtttttttaaattcttcatagttgagtattatttgcaattttattagttacagtgctattaaagaatatgtgctcctttttattatattatcagatacttatgtttaattgtacattttttaaatcctgaatatattgtgttttgttaacaaatgtaatcagtggaacccttcttacgttttgattattagcagttaaatacattttgtatacatgaagcttagattaattcccatcatcatcatctcctgtttttatatgtgtccctatgtgtttcatgcattcctctttgatcagattggaatttgagttaaaatttagctttgtacattacgtgtgagagttacagactagcaagtctaattactttgccttaccttgagtgtatgccacagggtcagataacacattaaacatttagttacactggattactcttccaaagctgacctcctgctaatgttcagaggtaactgcaatccggaaagaaataatatcactgcagaaagaatgtgactctaaaaataaaccaggacctccctgtgatttgccttgcctgcagatgaccagttgactcttgtgctgtcagccctggggttgctaaggaagctgcttcagggagttgggggttagttgcccgctctcaacaggaatgcctcctctactttgtcagagatgctgaacaaatatcaaactctgtggcagtcatgctggcctcctaagaataacctgtgagtcagagttgatgcacattatttttgtttttattttatttttttaaggaactgctccaagggttcattatagaacaggagtgtgtacggaggacttaggtccccacatagagtggccgttctgtggcggctccaaccaattccatccctcctttcctgcggacacacacctggcccctggcccctgccctgtgtgtctggaggaggggcactggggaggctgtggagcagagagaagaggccggatacattgaggatggcacctggcaagccaggcttccttctcaaaggccagactgctttctcagtgttacttactaaagctctctttttatactgttaaaaagatatataaagttcgtataaacaggcttgagaccactttgatgtaaaagctgtcatagtagtttttctcacagtggcacaattcatttgattgatggaatattcagtgacgccatgtatgccctatcgcttttttctcatccatctttatgctataactcatactgatttaagaaatgatttctccttttggcaaagcgaccccattcaatatggttataataaaagactaatgtcaaactgaga

SEQ ID NO: 21214 - DNA, 3156 bp, Homo sapiens
  ENST00000429383
agcccttctgcgccacagagatggggtctcactctgtcatccaggctggaatatagtggcacaatcatagcccattgtagcctccatctcaaggactcaggggatcctcccttctaggcctcccaagtagctgggattacaggtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaagaattaagagcatggtatagcaacattaaagaaatacatattaccaacccgaggaaggttgttggccaacaagatttgatgatcaataatcctctttcacaggatgaagggagtctttggaacaaattcttccaagataaagaacttcgatcaatgattgaacaagatgtcaaaagaacgtttcctgaaatgcagtttttccagcaagaaaatgtgagaaaaattcttacagatgttcttttctgttatgccagagaaaacgagcagttgctttataaacagggcatgcacgaactgttagcacctatagtctttgtccttcactgtgaccaccaagcttttctacatgccagtgagtctgcacagcccagtgaggaaatgaaaactgtcttgaaccctgagtatctggaacatgatgcctatgcagtgttctcacaacttatggaaactgctgaaccttggttttcaacttttgagcatgatggtcagaaggggaaagaaacactgatgactcccattccctttgctagaccacaagatttagggccaacaattgctattgttactaaagtcaaccagatccaggatcatctactgaagaagcatgatattgagctttacatgcacttgaacagactagaaattgcaccacagatatatgggttaaggtgggtgcggctgctatttggacgagagttccccctgcaggaccttctggtggtctgggatgccttgtttgcagacggcctcagcctgggtttagtagattatatcttcgtagccatgttactttacatccgagatgctttgatctctagtaactaccagacctgtctcggccttctgatgcattacccattcatcggggatgtacactcactgattcttaaggctctgttccttagagatccaaagagaaatccaagaccagtgacttatcaattccatccaaatttagattattacaaagcacgaggagcagacctcatgaataaaagccggaccaatgccaaaggtgctcccctgaatataaataaggtctctaatagcctgattaattttggaagaaagttgatttccccagcaatggctccaggcagtgcaggtggccctgtacctggaggcaacagcagtagctcctcctctgttgtaattcctaccaggacctcagcagaggccccaagccatcacttgcaacagcaacagcagcagcagaggctgatgaaatcagaaagcatgcctgtgcaattgaacaaagggctaagttctaaaaacatcagttcatctccaagcgttgagagtttgcctggaggaagagaattcactggctctccaccttcatctgctactaaaaaagattccttttttagcaacatctcacgttctcgctcacacagcaaaactatgggcagaaaagaatctgaagaagaattagaagcccaaatttccttccttcaagggcagttgaatgacctggatgccatgtgcaaatactgtgcaaaggtgatggacactcatcttgtaaatattcaagatgtgatattacaagaaaatttggaaaaagaagatcaaattctggtttccctggcaggattaaaacagatcaaagacattctaaaaggttccctgcgttttaaccagagccagctagaggccgaagagaacgaacagatcaccattgcggacaaccactactgctccagcggccagggccagggccgaggccaaggccagagcgttcaaatgtcaggggccattaaacaggcctcttcagaaacgccagggtgcactgatagagggaattccgatgacttcatcctgatttccaaagatgatgatgggagcagtgccaggggctccttctccggccaggcccagcctcttcgcaccctcagaagcacctctgggaaaagccaggccccagtctgctccccactggtgttctcagatccactgatgggcccagcctcagcttcctccagcaaccccagctccagtcctgatgacgacagcagcaaggactctggcttcaccattgtgagtcccctggacatctgaccacagtgcccagtcctgccccacagggatctagccacccttcagtggccccaaggccagactgaggctcatccagtggagaaccttcttaaaccactgcttccttcccggcatgcattttgcattggtccagccctttgaaaccccttagagagaagcatatatggccacaaagcacagaggcttaggtttgccacatgcagacagggctttctgggcccttacctaatccccacccgactcttgctctgagttagagctgagttacgtacccagtatcacactcacagttagaaaagaccgaatcacaatttagaatcacttttcctctgtccccttctccccagctaagaatgtgtggcacctccatcagttatacttagaaggagcagaaatagttattttcgtatcttctatccctcaaagcatcagacatgggaaaattggtttataccaagaaagcttcctctgtggaaatctgtctcagcctactttattcctgcattgggaagccatatcgcagagctaaatgcaatagaatgaaccagaactagtggattccagggctgggggaaaaaaaaaaagaaaaaa

SEQ ID NO: 21215 - DNA, 2088 bp, Homo sapiens
  ENST00000414318
aaacgcccacttcgtatggggaaagaggacaacttgaagtcaagttgcaattaacttccgcggcagccgcagctccggcggcggcggcggcggcaggagaggcagaagccgccgcctcggaagtccgacgccggcgcgcccgcccggggagccgttcttggtttcaggcccgcactcgacagccaccgccgcccccaacgtccatgcctgaaaggtgggtgcggctgctatttggacgagagttccccctgcaggaccttctggtggtctgggatgccttgtttgcagacggcctcagcctgggtttagtagattatatcttcgtagccatgttactttacatccgagatgcttagaaatccaagaccagtgacttatcaattccatccaaatttagattattacaaagcacgaggagcagacctcatgaataaaagccggaccaatgccaaaggtgctcccctgaatataaataaggtctctaatagcctgattaattttggaagaaagttgatttccccagcaatggctccaggcagtgcaggtggccctgtacctggaggcaacagcagtagctcctcctctgttgtaattcctaccaggacctcagcagaggccccaagccatcacttgcaacagcaacagcagcagcagaggctgatgaaatcagaaagcatgcctgtgcaattgaacaaagggctaagttctaaaaacatcagttcatctccaagcgttgagagtttgcctggaggaagagaattcactggctctccaccttcatctgctactaaaaaagattccttttttagcaacatctcacgttctcgctcacacagcaaaactatgggcagaaaagaatctgaagaagaattagaagcccaaatttccttccttcaagggcagttgaatgacctggatgccatgtgcaaatactgtgcaaaggtgatggacactcatcttgtaaatattcaagatgtgatattacaagaaaatttggaaaaagaagatcaaattctggtttccctggcaggattaaaacagatcaaagacattctaaaaggttccctgcgttttaaccagagccagctagaggccgaagagaacgaacagatcaccattgcggacaaccactactgctccagcggccagggccagggccgaggccaaggccagagcgttcaaatgtcaggggccattaaacaggcctcttcagaaacgccagggtgcactgatagagggaattccgatgacttcatcctgatttccaaagatgatgatgggagcagtgccaggggctccttctccggccaggcccagcctcttcgcaccctcagaagcacctctgggaaaagccaggccccagtctgctccccactggtgttctcagatccactgatgggcccagcctcagcttcctccagcaaccccagctccagtcctgatgacgacagcagcaaggactctggcttcaccattgtgagtcccctggacatctgaccacagtgcccagtcctgccccacagggatctagccacccttcagtggccccaaggccagactgaggctcatccagtggagaaccttcttaaaccactgcttccttcccggcatgcattttgcattggtccagccctttgaaaccccttagagagaagcatatatggccacaaagcacagaggcttaggtttgccacatgcagacagggctttctgggcccttacctaatccccacccgactcttgctctgagttagagctgagttacgtacccagtatcacactcacagttagaaaagaccgaatcacaatttagaatcacttttcctctgtccccttctccccagctaagaatgtgtggcacctccatcagttatacttagaaggagcagaaatagttattttcgtatcttctatccctcaaagcatcagacatgggaaaattggtttataccaagaaagcttcctctgtggaaatctgtctcagcctactttattcctgcattgggaagccatatcgcagagctaaatgcaatagaatgaaccagaactagtggattccagggctgggggaaaaaaaaaaagaaaaaa

SEQ ID NO: 21216 - DNA, 3124 bp, Homo sapiens
  ENST00000446818
gtattgagtcaccataagtggacaaggaaggagcttctaacagacctcattgtacatacaaaattacaatcatgaatgtaaaggaaagcacactggaactgcttgcagctgactgcgaccttgagtctcagcttctgcatctgtgaaatgaagatactggtctgtgatatcagtatcaagataaaagtttggaatgggagaaaaattctcaaagcctgaaagaaaatctgtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaagaattaagagcatggtatagcaacattaaagaaatacatattaccaacccgaggaaggttgttggccaacaagatttgatgatcaataatcctctttcacaggatgaagggagtctttggaacaaattcttccaagataaagaacttcgatcaatgattgaacaagatgtcaaaagaacgtttcctgaaatgcagtttttccagcaagaaaatgtgagaaaaattcttacagatgttcttttctgttatgccagagaaaacgagcagttgctttataaacagggcatgcacgaactgttagcacctatagtctttgtccttcactgtgaccaccaagcttttctacatgccagtgagtctgcacagcccagtgaggaaatgaaaactgtcttgaaccctgagtatctggaacatgatgcctatgcagtgttctcacaacttatggaaactgctgaaccttggttttcaacttttgagcatgatggtcagaaggggaaagaaacactgatgactcccattccctttgctagaccacaagatttagggccaacaattgctattgttactaaagtcaaccagatccaggatcatctactgaagaagcatgatattgagctttacatgcacttgaacagactagaaattgcaccacagatatatgggttaaggtgggtgcggctgctatttggacgagagttccccctgcaggaccttctggtggtctgggatgccttgtttgcagacggcctcagcctgggtttagtagattatatcttcgtagccatgttactttacatccgagatgctttgatctctagtaactaccagacctgtctcggccttctgatgcattacccattcatcggggatgtacactcactgattcttaaggctctgttccttagagatccaaagagaaatccaagaccagtgacttatcaattccatccaaatttagattattacaaagcacgaggagcagacctcatgaataaaagccggaccaatgccaaaggtgctcccctgaatataaataaggtctctaatagcctgattaattttggaagaaagttgatttccccagcaatggctccaggcagtgcaggtggccctgtacctggaggcaacagcagtagctcctcctctgttgtaattcctaccaggacctcagcagaggccccaagccatcacttgcaacagcaacagcagcagcagaggctgatgaaatcagaaagcatgcctgtgcaattgaacaaaggcgatgtagttacaggaagcgatgctcaggtttctgttcctgtccagactctaactgacctccaagggctaagttctaaaaacatcagttcatctccaagcgttgagagtttgcctggaggaagagaattcactggctctccaccttcatctgctactaaaaaagattccttttttagcaacatctcacgttctcgctcacacagcaaaactatgggcagaaaagaatctgaagaagaattagaagcccaaatttccttccttcaagggcagttgaatgacctggatgccatgtgcaaatactgtgcaaaggtgatggacactcatcttgtaaatattcaagatgtgatattacaagaaaatttggaaaaagaagatcaaattctggtttccctggcaggattaaaacagatcaaagacattctaaaaggttccctgcgttttaaccagagccagctagaggccgaagagaacgaacagatcaccattgcggacaaccactactgctccagcggccagggccagggccgaggccaaggccagagcgttcaaatgtcaggggccattaaacaggcctcttcagaaacgccagggtgcactgatagagggaattccgatgacttcatcctgatttccaaagatgatgatgggagcagtgccaggggctccttctccggccaggcccagcctcttcgcaccctcagaagcacctctgggaaaagccaggccccagtctgctccccactggtgttctcagatccactgatgggcccagcctcagcttcctccagcaaccccagctccagtcctgatgacgacagcagcaaggactctggcttcaccattgtgagtcccctggacatctgaccacagtgcccagtcctgccccacagggatctagccacccttcagtggccccaaggccagactgaggctcatccagtggagaaccttcttaaaccactgcttccttcccggcatgcattttgcattggtccagccctttgaaaccccttagagagaagcatatatggccacaaagcacagaggcttaggtttgccacatgcagacagggctttctgggcccttacctaatccccacccgactcttgctctgagttagagctgagttacgtacccagtatcacactcacagttagaaaagaccgaatcacaatttagaatcacttttcctctgtccccttctccccagctaagaatgtgtggcacctccatcagttatacttagaaggagcagaaatagttattttc

SEQ ID NO: 21217 - DNA, 2477 bp, Homo sapiens
  ENST00000429924
acatattcattaaatctacggaagaactgtgtccaaaaagacagccatgcgttcagaaacagtacacaactaaatatatatgttttaaaagttgcattttttagacttacttaaaattaatttcccgtagaacttctctccaagcagaggaattttaacaaaaggattctcatgctttggtttctttcatataggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaagaattaagagcatggtatagcaacattaaagaaatacatattaccaacccgaggaaggttgttggccaacaagatttgatgatcaataatcctctttcacaggatgaagggagtctttggaacaaattcttccaagataaagaacttcgatcaatgattgaacaagatgtcaaaagaacgtttcctgaaatgcagtttttccagcaagaaaatgtgagaaaaattcttacagatgttcttttctgttatgccagagaaaacgagcagttgctttataaacagggcatgcacgaactgttagcacctatagtctttgtccttcactgtgaccaccaagcttttctacatgccagtgagtctgcacagcccagtgaggaaatgaaaactgtcttgaaccctgagtatctggaacatgatgcctatgcagtgttctcacaacttatggaaactgctgaaccttggttttcaacttttgagcatgatggtcagaaggggaaagaaacactgatgactcccattccctttgctagaccacaagatttagggccaacaattgctattgttactaaagtcaaccagatccaggatcatctactgaagaagcatgatattgagctttacatgcacttgaacagactagaaattgcaccacagatatatgggttaaggtgggtgcggctgctatttggacgagagttccccctgcaggaccttctggtggtctgggatgccttgtttgcagacggcctcagcctgggtttagtagattatatcttcgtagccatgttactttacatccgagatgctttgatctctagtaactaccagacctgtctcggccttctgatgcattacccattcatcggggatgtacactcactgattcttaaggctctgttccttagagatccaaagagaaatccaagaccagtgacttatcaattccatccaaatttagattattacaaagcacgaggagcagacctcatgaataaaagccggaccaatgccaaaggtgctcccctgaatataaataaggtctctaatagcctgattaattttggaagaaagttgatttccccagcaatggctccaggcagtgcaggtggccctgtacctggaggcaacagcagtagctcctcctctgttgtaattcctaccaggacctcagcagaggccccaagccatcacttgcaacagcaacagcagcagcagaggctgatgaaatcagaaagcatgcctgtgcaattgaacaaaggcgatgtagttacaggaagcgatgctcaggtttctgttcctgtccagactctaactgacctccaagggctaagttctaaaaacatcagttcatctccaagcgttgagagtttgcctggaggaagagaattcactggctctccaccttcatctgctactaaaaaagattccttttttagcaacatctcacgttctcgctcacacagcaaaactatgggcagaaaagaatctgaagaagaattagaagcccaaatttccttccttcaagggcagttgaatgacctggatgccatgtgcaaatactgtgcaaaggtgatggacactcatcttggtaagtgaattactttggccctgggaacgatgagactcatcacaataatagccactagcaatactttgttctaggccttgtgctaagctgtttacatgaattaccttatttaatccttacaacagctatataatagaagtactcttactctcactctctacattatatagatgaagaaaccaaggcatagagggattaagaaaatgccccaagattatatcattagtaaatcgagtggaaattcaaaatcaagcaatccgattataagctggatgccgtggctcacagctgtaatcccagcactgtggaaagccaaggtgggaagatttgaggccaggaatttgagaccagcctgagcaacatactgagaccctgtctctaccaacacaaaacaacaaatttttttttttttaattagctgggcatggtggcacgtgcctgtagtcccagctgcccaagaggctgagatggaaatattgcttaaacccaggggtttgaggttgcagcaagttgtgattgtgccactatattc

SEQ ID NO: 21218 - DNA, 476 bp, Homo sapiens
  ENST00000465884
tgatattgagctttacatgcacttgaacagactagaaattgcaccacagatatatgggttctgcccttggaagaatttggaaactccaagggacaacactttagtgaaatgagaatttatttgtgcttggcacagtgttctaatgaagagggtttcttgggctgctttgttttgtgaggaggtggccagtgaggaaagagaagattgatgatagccagcaccttggaggatgcttttgattacaagcttcagaatatcttgcctcaaactagctgaagtctggaggtactgtgacacaagaggctcaattaaggatccaagattttcgccatatttccgctgtgttaacttcatcatcagtttcttaagacatactctcttgtaatcacaaagtgattgacaatgattttggagctataggctttcttgttctagccaaactggtgagacagaataaaaccgttcaccaagtacaa

SEQ ID NO: 21219 - DNA, 852 bp, Homo sapiens
  ENST00000415814
acgtggccgctggtcaccgccgccaccccctcccgccctgttctctttcaggtcgggccgggcccggccgcttccgcgagcgccctgcagactgagggagagagagagaaagaggaggggaggaggaggaggattcagggaataggagctggggagcccttctgcgccacaggagggagcctgcgagcaaacgaggtggaaactggagtgcacaagtgctggaatgggctgtctgccttccacccctcacgggagggagcgcgcaggtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaagaattaagagcatggtatagcaacattaaagaaatacatattaccaacccgaggaaggttgttggccaacaagatttgatgatcaataatcctctttcacaggatgaagggagtctttggaacaaattcttccaagataaagaacttcgatcaatgattgaacaagatgtcaaaagaacgtttcctgaaatgcagtttttccagcaagaaaatgtgagaaa

SEQ ID NO: 21220 - DNA, 581 bp, Homo sapiens
  ENST00000452492
tttcaggtcgggccgggcccggccgcttccgcgagcgccctgcagactgagggagagagagagaaagaggaggggaggaggaggaggattcagggaataggagctggggagcccttctgcgccacaggtagttacttttggtgacgctgtccagttcccacaatgtatcattccttatctgaaactagacatcctctgcagccagaagaacaagaagtaggcattgaccccttgtccagttactctaacaagtctggaggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaagaattaagagcatggtatagcaacattaaagaaatacatattaccaacccgaggaaggttgttggccaacaagatttgatgatcaataatcctctttcacaggatgaagggagtctttggaacaaattcttccaagataaagaacttcgatcaatgatt

SEQ ID NO: 21221 - DNA, 592 bp, Homo sapiens
  ENST00000412981
gtcgggccgggcccggccgcttccgcgagcgccctgcagactgagggagagagagagaaagaggaggggaggaggaggaggattcagggaataggagctggggagcccttctgcgccacagtgatatcagtatcaagataaaagtttggaatgggagaaaaattctcaaagcctgaaagaaaatctgtagttacttttggtgacgctgtccagttcccacaatgtatcattccttatctgaaactagacatcctctgcagccagaagaacaagaagtaggcattgaccccttgtccagttactctaacaagtctggaggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaagaattaagagcatggtatagcaacattaaagaaatacatattaccaacccgaggaaggttgttggccaacaagatttgatgatcaataatcctctttcacaggatgaaggg

SEQ ID NO: 21222 - DNA, 757 bp, Homo sapiens
  ENST00000428355
ctgttctctttcaggtcgggccgggcccggccgcttccgcgagcgccctgcagactgagggagagagagagaaagaggaggggaggaggaggaggattcagggaataggagctggggagcccttctgcgccacagtgatatcagtatcaagataaaagtttggaatgggagaaaaattctcaaagcctgaaagaaaatctgagggagcctgcgagcaaacgaggtggaaactggagtgcacaagtgctggaatgggctgtctgccttccacccctcacgggagggagcgcgcaggtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaagaattaagagcatggtatagcaacattaaagaaatacatattaccaacccgaggaaggttgttggccaacaagatttgatgatcaataatcctctttc

SEQ ID NO: 21223 - DNA, 591 bp, Homo sapiens
  ENST00000425944
ctgttctctttcaggtcgggccgggcccggccgcttccgcgagcgccctgcagactgagggagagagagagaaagaggaggggaggaggaggaggattcagggaataggagctggggagcccttctgcgccacaggtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaagaattaagagcatggtatagcaacattaaagaaatacatattaccaacccgaggaaggttgttggccaacaagatttgatgatcaataatc

SEQ ID NO: 21224 - DNA, 492 bp, Homo sapiens
  ENST00000430169
caggtcgggccgggcccggccgcttccgcgagcgccctgcagactgagggagagagagagaaagaggaggggaggaggaggaggattcagggaataggagctggggagcccttctgcgccacaggtagttacttttggtgacgctgtccagttcccacaatgtatcattccttatctgaaactagacatcctctgcagccagaagaacaagaagtaggcattgaccccttgtccagttactctaacaagtctggaggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaagaattaagagcatggtatagcaacattaaagaaatacatattaccaacccgaggaaggttgttggccaacaag

SEQ ID NO: 21225 - DNA, 623 bp, Homo sapiens
  ENST00000445294
ctgttctctttcaggtcgggccgggcccggccgcttccgcgagcgccctgcagactgagggagagagagagaaagaggaggggaggaggaggaggattcagggaataggagctggggagcccttctgcgccacagtgatatcagtatcaagataaaagtttggaatgggagaaaaattctcaaagcctgaaagaaaatctgtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaagaattaagagcatggtatagcaacattaaagaaatacatattaccaacccgaggaagg

SEQ ID NO: 21226 - DNA, 687 bp, Homo sapiens
  ENST00000414349
cgggcccggccgcttccgcgagcgccctgcagactgagggagagagagagaaagaggaggggaggaggaggaggattcagggaataggagctggggagcccttctgcgccacagttttggagtccagaacatgtaaagttttttcacccattataaacaatttggacaaaatactgcatgttctacttaaaattgggagctaagcagtggtagagatggggcttcaccatgttgaccaggctggtcttgaactccttacctcaggtgatctcccaggcttggccttccaaggatttgtgcacatataaacttctgtccatgtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaaga

SEQ ID NO: 21227 - DNA, 681 bp, Homo sapiens
  ENST00000443499
ctgttctctttcaggtcgggccgggcccggccgcttccgcgagcgccctgcagactgagggagagagagagaaagaggaggggaggaggaggaggattcagggaataggagctggggagcccttctgcgccacagtgatatcagtatcaagataaaagtttggaatgggagaaaaattctcaaagcctgaaagaaaatctgagatgcttggagtgtaaagatcccatggtcacataaatccggaaagcactgaatactttgtttcccataagagaatcccattatatgttgatgtattaaaagacctgagaacctggtgtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattg

SEQ ID NO: 21228 - DNA, 561 bp, Homo sapiens
  ENST00000443386
atcctaacctttaggtttagggattgactgggtttctgactttttatttggccaatgaggacgatacagaaaatgaagcattggtcattatcacattttaacgctgaaaaagtaagaaggacaaccccggaataaaatgatatcagtatcaagataaaagtttggaatgggagaaaaattctcaaagcctgaaagaaaatctgagatgcttggagtgtaaagatcccatggtcacataaatccggaaagcactgaatactttgtttcccataagagaatcccattatatgttgatgtattaaaagacctgagaacctggtgtagttacttttggtgacgctgtccagttcccacaatgtatcattccttatctgaaactagacatcctctgcagccagaagaacaagaagtaggcattgaccccttgtccagttactctaacaagtctggaggaaagaatgggaagaactatttgtaaacaacaattacttggcaacaataaggcagaaggggattaatgggcagctgagaagcagcaggttccgcagcatttgctggaag

SEQ ID NO: 21229 - DNA, 672 bp, Homo sapiens
  ENST00000497531
agactgagggagagagagagaaagaggaggggaggaggaggaggattcagggaataggagctggggagcccttctgcgccacagtgatatcagtatcaagataaaagtttggaatgggagaaaaattctcaaagcctgaaagaaaatctgagatgcttggagtgtaaagatcccatggtcacataaatccggaaagcactgaatactttgtttcccataagagaatcccattatatgttgatgtattaaaagacctgagaacctggtgagggagcctgcgagcaaacgaggtggaaactggagtgcacaagtgctggaatgggctgtctgccttccacccctcacgggagggagcgcgcaggtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggcagctgagaagcagcaggttccgcagcatttgctggaag

SEQ ID NO: 21230 - DNA, 545 bp, Homo sapiens
  ENST00000444756
gtcgggccgggcccggccgcttccgcgagcgccctgcagactgagggagagagagagaaagaggaggggaggaggaggaggattcagggaataggagctggggagcccttctgcgccacagtgatatcagtatcaagataaaagtttggaatgggagaaaaattctcaaagcctgaaagaaaatctgagatgcttggagtgtaaagatcccatggtcacataaatccggaaagcactgaatactttgtttcccataagagaatcccattatatgttgatgtattaaaagacctgagaacctggtgtagttacttttggtgacgctgtccagttcccacaatgtatcattccttatctgaaactagacatcctctgcagccagaagaacaagaagtaggcattgaccccttgtccagttactctaacaagtctggaggaaagaatgggaagaactatttgtaaacaacaattacttggcaacaataaggcagaaggggattaatgggcagctgagaagcagcaggttccgcagcatttgctggaag

SEQ ID NO: 21231 - DNA, 578 bp, Homo sapiens
  ENST00000507877
taagtggacaaggaaggagcttctaacagacttgtgtttggagaactctattgtactgagcctaagtcatttttgatctataacaagaacatgcattttcacatgtcaaccggatttgtggaccagtaaagttctcccacaagaaatcttctatgatattgtctcagggaccacctgcagcaggagcccacaaattgaataaatgcaacataaggagaggattttttttttctgttgttgcttgtttcaaaaatgctactatccagattctctattaaggtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggcagctgagaagcagcaggttccgcagc

SEQ ID NO: 21232 - DNA, 557 bp, Homo sapiens
  ENST00000446863
gagcgccctgcagactgagggagagagagagaaagaggaggggaggaggaggaggattcagggaataggagctggggagcccttctgcgccacagtgatatcagtatcaagataaaagtttggaatgggagaaaaattctcaaagcctgaaagaaaatctagatggggtctcactctgtcatccaggctggaatatagtggcacaatcatagcccattgtagcctccatctcaaggactcaggggatcctcccttctaggcctcccaagtagctgggattacaggtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggc

SEQ ID NO: 21233 - DNA, 386 bp, Homo sapiens
  ENST00000434420
cagtgatatcagtatcaagataaaagtttggaatgggagaaaaattctcaaagcctgaaagaaaatctccccctgctgctgttgattacacctagatctgctactgattggaactgttaaaaggcaaaggtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcag

SEQ ID NO: 21234 - DNA, 526 bp, Homo sapiens
  ENST00000486224
tgatatcagtatcaagataaaagtttggaatgggagaaaaattctcaaagcctgaaagaaaatctggagatgctgtttttccagcagctcagttaagggagaacttagtttgtctctgtttcttgattcctcttcaatttctgtttgcaaaccaagacttgtgtttggagaactctattgtactgagcctaagtcatttttgatctataacaagaacatgcattttcacatgtcaaccggatttgtggaccagtaaagttctcccacaagagatggggtctcactctgtcatccaggctggaatatagtggcacaatcatagcccattgtagcctccatctcaaggactcaggggatcctcccttctaggcctcccaagtagctgggattacaggtagttacttttggtgacgctgtccagttcccacaatgtatcattccttatctgaaactagacatcctctgcagccagaagaacaagaagtaggcattgaccccttgtccagttactctaacaagtctggag

SEQ ID NO: 21235 - DNA, 680 bp, Homo sapiens
  ENST00000444471
ctgttctctttcaggtcgggccgggcccggccgcttccgcgagcgccctgcagactgagggagagagagagaaagaggaggggaggaggaggaggattcagggaataggagctggggagcccttctgcgccacagtgatatcagtatcaagataaaagtttggaatgggagaaaaattctcaaagcctgaaagaaaatctgagatgcttggagtgtaaagatcccatggtcacataaatccggaaagcactgaatactttgtttcccataagagaatcccattatatgttgatgtattaaaagacctgagaacctggtaaatcttctatgatattgtctcagggaccacctgcagcaggagcccacaaattgaataaatgcaacataaggagaggattttttttttctgttgttgcttgtttcaaaaatgctactatccagattctctattaaggagggagcctgcgagcaaacgaggtggaaactggagtgcacaagtgctggaatgggctgtctgccttccacccctcacgggagggagcgcgcaggtagttacttttggtgacgctgtccagttcccacaatgtatcattccttatctgaaactagacatcctctgcagccagaagaacaagaagtaggcattgaccccttgtccagttactctaacaagtctggag

SEQ ID NO: 21236 - DNA, 471 bp, Homo sapiens
  ENST00000433533
tattagttatgattctgttttaggaggtgtaatgccataatttcatagttttactaagtaagtttgaatttacatttgatttcttctggaagtcttagcagggtcttttaaatgaactgcatttaaaagtaaaagaatctgttgtgcttggaagatttgacagtgatatcagtatcaagataaaagtttggaatgggagaaaaattctcaaagcctgaaagaaaatctgagatgcttggagtgtaaagatcccatggtcacataaatccggaaagcactgaatactttgtttcccataagagaatcccattatatgttgatgtattaaaagacctgagaacctggtgtagttacttttggtgacgctgtccagttcccacaatgtatcattccttatctgaaactagacatcctctgcagccagaagaacaagaagtaggcattgaccccttgtccagttactctaacaag

SEQ ID NO: 21237 - DNA, 609 bp, Homo sapiens
  ENST00000481396
gctggtcaccgccgccaccccctcccgccctgttctctttcaggtcgggccgggcccggccgcttccgcgagcgccctgcagactgagggagagagagagaaagaggaggggaggaggaggaggattcagggaataggagctggggagcccttctgcgccacagtgatatcagtatcaagataaaagtttggaatgggagaaaaattctcaaagcctgaaagaaaatctgagatgcttggagtgtaaagatcccatggtcacataaatccggaaagcactgaatactttgtttcccataagagaatcccattatatgttgatgtattaaaagacctgagaacctggtggagatgctgtttttccagcagctcagttaagggagaacttagtttgtctctgtttcttgattcctcttcaatttctgtttgcaaaccaagacttgtgtttggagaactctattgtactgagcctaagtcatttttgatctataacaagaacatgcattttcacatgtcaaccggatttgtggaccagtaaagttctcccacaaggtagttacttttggtgacgctgtccagttcccacaatgtatcattccttatctgaaa

SEQ ID NO: 21238 - DNA, 560 bp, Homo sapiens
  ENST00000480435
agtcaccataagtggacaaggaaggagcttctaacagttttggagtccagaacatgtaaagttttttcacccattataaacaatttggacaaaatactgcatgttctacttaaaattgggagctaagcagtggtgatatcagtatcaagataaaagtttggaatgggagaaaaattctcaaagcctgaaagaaaatctgagatgcttggagtgtaaagatcccatggtcacataaatccggaaagcactgaatactttgtttcccataagagaatcccattatatgttgatgtattaaaagacctgagaacctggtaaatcttctatgatattgtctcagggaccacctgcagcaggagcccacaaattgaataaatgcaacataaggagaggattttttttttctgttgttgcttgtttcaaaaatgctactatccagattctctattaaggcaatattcactctgtcgccaagactggagtgcatggtgtgattaaggctcactgcagcatcaacctccaggtctcaaaccatcctcccacctcagcccccactacag

SEQ ID NO: 21239 - DNA, 588 bp, Homo sapiens
  ENST00000423331
ttctctttcaggtcgggccgggcccggccgcttccgcgagcgccctgcagactgagggagagagagagaaagaggaggggaggaggaggaggattcagggaataggagctggggagcccttctgcgccacagtgatatcagtatcaagataaaagtttggaatgggagaaaaattctcaaagcctgaaagaaaatctgagatgcttggagtgtaaagatcccatggtcacataaatccggaaagcactgaatactttgtttcccataagagaatcccattatatgttgatgtattaaaagacctgagaacctggtggagatgctgtttttccagcagctcagttaagggagaacttagtttgtctctgtttcttgattcctcttcaatttctgtttgcaaaccaagacttgtgtttggagaactctattgtactgagcctaagtcatttttgatctataacaagaacatgcattttcacatgtcaaccggatttgtggaccagtaaagttctcccacaagaaatcttctatgatattgtctcagggaccacctgcagcaggagcccacaaattgaataaatgcaacat

SEQ ID NO: 21240 - DNA, 566 bp, Homo sapiens
  ENST00000485432
gagcttcccaggcgcgcgggccgcgaggttattagaggtggagcgcggggagggcgcgcggcgggaggcggccgccgttacggcgcgagcgtggtcacgtggccgctggtcaccgccgccaccccctcccgccctgttctctttcaggtcgggccgggcccggccgcttccgcgagcgccctgcagactgagggagagagagagaaagaggaggggaggaggaggaggattcagggaataggagctggggagcccttctgcgccacagtgatatcagtatcaagataaaagtttggaatgggagaaaaattctcaaagcctgaaagaaaatctgagatgcttggagtgtaaagatcccatggtcacataaatccggaaagcactgaatactttgtttcccataagagaatcccattatatgttgatgtattaaaagacctgagaacctggtacttgtgtttggagaactctattgtactgagcctaagtcatttttgatctataacaagaacatgcattttcacatgtcaaccggatttgtggaccagtaaagttctcccacaagg

SEQ ID NO: 21241 - DNA, 330 bp, Homo sapiens
  ENST00000473612
aagcctgcagacaacactgtcatgcttttcttttcaacagatgtcctctgactcctcccaacctcctagtacaaaaaaacataaaaatctttgtatgttttgcatctgtttgaaaaagatgcctttaaaaatgatatcagtatcaagataaaagtttggaatgggagaaaaattctcaaagcctgaaagaaaatctgtaagaataaaattcttgaatgattttgatcagctgtcatgtatgcccaacacagcagttggtttaatcaattttatgttttgggatggttttattaaaatgagctgctgctttcagtaaatcattgagaaaga

SEQ ID NO: 21242 - DNA, 435 bp, Homo sapiens
  ENST00000471679
aggcgcgcgggccgcgaggttattagaggtggagcgcggggagggcgcgcggcgggaggcggccgccgttacggcgcgagcgtggtcacgtggccgctggtcaccgccgccaccccctcccgccctgttctctttcaggtcgggccgggcccggccgcttccgcgagcgccctgcagactgagggagagagagagaaagaggaggggaggaggaggaggattcagggaataggagctggggagcccttctgcgccacagttttggagtccagaacatgtaaagttttttcacccattataaacaatttggacaaaatactgcatgttctacttaaaattgggagctaagcagtgggtcctcatcctgtcataggaataatagtcttgaaaattggagctctggaattcaccattctgagagatatctccttactg

SEQ ID NO: 21243 - DNA, 1375 bp, Homo sapiens
  ENST00000529397
gtcacgtgttgttgttgggccgggaaagctgcttccgggtcaatgcaggacactgggctccggcggccagagtgggggactagcattttaagaaagaaagatggatcaacctagtggaagaagtttcatgcaagtattatgtgaaaaatatagtcctgaaaattttccttatcgccgtggcccggggatgggagtccatgtcccagccacacctcagggctctcctatgaaagatcgcctcaacctcccaagtgtactagtgttgaacagctgtggaataacctgtgcaggagatgaaaaagaaattgctgctttctgcgctcatgtgtcggaactagatctttctgacaacaaactcgaagactggcatgaggtcagtaaaattgtgtcaaatgttcctcagttggagtttctaaacctgagttccaaccctctgaatttgtcggttttagaaagaacatgtgctgggtccttctctggggttcgcaaacttgtcctcaacaacagcaaagcttcttgggagacggtccacatgatactacaggagttaccagatttggaggagctcttcctgtgccttaatgactatgaaacagtgtcttgtccttctatttgctgtcattctcttaagctactacatataacagacaataacctccaagactggactgaaatacgaaagttaggagttatgtttccttcactggataccctcgtcctggccaacaatcatttgaatgctattgaggagcctgatgattcattggccaggttgtttcctaatcttcgatccatcagcctccacaagtcaggtttgcagtcctgggaagacattgataaactaaattcatttcccaaactggaagaagtgagattgttaggaattcctcttctgcagccatataccaccgaggagcgaaggaaattggtaatagccagattgccatcagtttccaaacttaatggcagcgttgttactgatggtgaacgagaagattctgagagattttttattcgttactatgtggatgttccacaggaagaagtgccattcaggtatcatgaactgatcactaaatatgggaagttggagcctttggcagaagtggacctaagaccccagagcagtgcaaaagtagaagtccactttaacgatcaggtggaagaaatgagcattcgtctggaccaaacagtggcagaactaaagaaacagttaaaaactctagtacaattacccacaagcaacatgcttctctactattttgaccatgaagcaccctttggcccagaggaaatgaagtacagctctcgggcattgcattcctttggcattagggatggagataaaatttacgtggaatccaaaacaaaataa

SEQ ID NO: 21244 - DNA, 3923 bp, Homo sapiens
  ENST00000284259
gggaaagctgcttccgggtcaatgcaggacactgggctccggcggccagagtgggggactaggtgaagcggcgccgggccggggctggccgggaccaggcccgaggctgagcggcggcgacagcggtggccgggaggggggaggagaggcgcagccagaggagccgccgcagtagctcccccgcctcccgggctgagggcattttaagaaagaaagatggatcaacctagtggaagaagtttcatgcaagtattatgtgaaaaatatagtcctgaaaattttccttatcgccgtggcccggggatgggagtccatgtcccagccacacctcagggctctcctatgaaagatcgcctcaacctcccaagtgtactagtgttgaacagctgtggaataacctgtgcaggagatgaaaaagaaattgctgctttctgcgctcatgtgtcggaactagatctttctgacaacaaactcgaagactggcatgagaaagaacatgtgctgggtccttctctggggttcgcaaacttgtcctcaacaacagcaaagcttcttgggagacggtccacatgatactacaggagttaccagatttggaggagctcttcctgtgccttaatgactatgaaacagtgtcttgtccttctatttgctgtcattctcttaagctactacatataacagacaataacctccaagactggactgaaatacgaaagttaggagttatgtttccttcactggataccctcgtcctggccaacaatcatttgaatgctattgaggagcctgatgattcattggccaggttgtttcctaatcttcgatccatcagcctccacaagtcaggtttgcagtcctgggaagacattgataaactaaattcatttcccaaactggaagaagtgagattgttaggaattcctcttctgcagccatataccaccgaggagcgaaggaaattggtaatagccagattgccatcagtttccaaacttaatggcagcgttgttactgatggtgaacgagaagattctgagagattttttattcgttactatgtggatgttccacaggaagaagtgccattcaggtatcatgaactgatcactaaatatgggaagttggagcctttggcagaagtggacctaagaccccagagcagtgcaaaagtagaagtccactttaacgatcaggtggaagaaatgagcattcgtctggaccaaacagtggcagaactaaagaaacagttaaaaactctagtacaattacccacaagcaacatgcttctctactattttgaccatgaagcaccctttggcccagaggaaatgaagtacagctctcgggcattgcattcctttggcattagggatggagataaaatttacgtggaatccaaaacaaaataacctctaccagccttgtgaaaaacatacacataaggacttgttgcagggcatttgtttttaatgtggttttctttaggagggagaggttgtttttgttttgttttgttctgtttaggtttgggaaggattttgtatatttttccccctggagtgagtaggggccatttttgggtgttttctaccacagattgatttggctcagccagcggaattggccacatttccagtgtatgtgccctctctaaggaaagatgacaaagaaatcaccgacttcttactgtgttcactgggatttgcctgccacttggttatcattactgttgggtgaacctgtgaagataacatgaacactgtagccccttagaagggtctcatagagaatttaaacagggtgacaaggaatcttcacaggaagggccagaacttctctctcccagttcttccttccgctaccctccctccttggcttttttggttcagttccatttttttttcattttgacatgtggtttacctaatagttttgttctgttcataattcttatttctcaacctgggtgatttttttgttctcatttctcccttttgaaataattgaaagtgttttaagcatttttaacctgattctaatctcaggtacgcagtaagaagctataactctgttagaacctcgaagagtagatgtagaatgaaaactccaggaaaacttgcagttattctggaagcaccggcagaacagtctgatctctttgtatgttactaactcacttttaatgtccctgtacattatgtcagccattactttcataacatgaaatatgtcagattccagagttcttttatttttgcttattgaatgtatttcctcatatctttctttttcattactttaaactattgggaattgaggcctgacttcataaataattcaatagagtcctggatacgtgcaccaggagagttgagaattagctcataaactatctgtggtgtgtgtggggaatgaagttgggggatgtgggggaagagcttatgactttcccacctgtgtcatccattggaagcccttgctcttgcactttgcattaaaagtgggaaacattaatcaaagggagattttattcccaggttttccctgggactttgtgatatcataattgaacagttcttttgttttacatttcaatttagttgcctcatagaagtataactgcccaatctatgagtaaagtgtaagtgtcaaaactttacaattgcctccaagtcatattttttgcagaagcacatttaaagcacttttctgtaaaagctagttccttacctgcttggaaatctttttgtttgttcttctattcctttgttaatcagatgtaatccctttctttaatgtgtatttttcttggtccaccatgtttacagatgggagacttgagagatacttagcataactggggcagaaagtgtgtaagtgaagtatttttcaaagaatgcagttattatctgattgcatttgaccttttgacctttgttacataattctacccctcctacaaatttaatttttttatgaaatttttaggtgacttgtaaattcttcatgtatgaggagttgtgtttattaatgctactttttaaattttcctgtgccatgtggcagatgtttattctcttaatgcacttcaggtttgctatctgtaaagcctttgacccaggcctactgagtcaaatctacattcagtgtaacattaaaggtggaaaccaaagggtttgagaaagacgaataaggcctattctccttctgctgcagactttatctttcaaaatcataaaaatgagcaatggagatccaggctgggtatagacaagaataattattttgcaaacacattttcctgacagatttttggaagtaggaaaaaagtatggcaacagtgtcatgaagattgaaactgtaggtgctttgtgtatgtatgcatgagtgcagatgagtttgagagagaaaaagtgtaattgagccctttgcttttgtcagcctgggaaacagatgcgttcttattttttgaagttgtgtgaccctggactgtcccacagcagaaggcagaacaaacacttatgttatgctttaatcataagtggaatggtcacaattaataagatattttatatatggcaaagttttatgaaatgcttttttactattagagacctgtttcttctgttattacagaacacagtgtttatcaactgcggacataattcttttattatacagttgcatgtaaagggagcttctcatttaattcagcggatgtgggtatttttagggcattgtaattgatggttttaataattgctgaataatttttgattaagagaaaaatgtaatacaattactggtctgagttacagaacagaagttaatgaaaaaggctatttgagcatgtgtacttatagattcatttgggtggctgagaaaagatgctgcttttgaaataaaattggtgctgtgta

SEQ ID NO: 21245 - DNA, 553 bp, Homo sapiens
  ENST00000528512
aatgcaggacactgggctccggcggccagagtgggggactaggtgaagcggcgccgggccggggctggccgggaccaggcccgaggctgagcggcggcgacagcggtggccgggaggggggaggagaggcgcagccagaggagccgccgcagtagctcccccgcctcccgggctgagggaatgtctaatttaatagggatatagacagttggtttaaaccaacatttttggacgaggagaggctatggaaatgaagaaagaagtgtttagaaatatcacacaaacagcattttaagaaagaaagatggatcaacctagtggaagaagtttcatgcaagtattatgtgaaaaatatagtcctgaaaattttccttatcgccgtggcccggggatgggagtccatgtcccagccacacctcagggctctcctatgaaagatcgcctcaacctcccaagtgtactagtgttgaacagctgtggaataacctgtgcaggagatgaaaaagaaattgctgctttctgcgctcatgtgtcggaactagatctttctgac

SEQ ID NO: 21246 - DNA, 2593 bp, Homo sapiens
  ENST00000531148
acactgggctccggcggccagagtgggggactaggtgaagcggcgccgggccggggctggccgggaccaggcccgaggctgagcggcggcgacagcggtggccgggaggggggaggagaggcgcagccagaggagccgccgcagtagctcccccgcctcccgggctgagggcggaaagaaaacatgcatatatgattttcttctgatgaaacctaatgtattcaagaaaaagaatcttgctttttggaaggatggaaaaattgggaataattttttcccctttgataattagaccactcagtactgttgcttagttttttggttcagttactttgatgtggttacaagaggaattttggctgtaatggatttcatacatttttaatgtctaatttaatagggatatagacagttggtttaaaccaacatttttggacgaggagaggctatggaaatgaagaaagaagtgtttagaaatatcacacaaacagcattttaagaaagaaagatggatcaacctagtggaagaagtttcatgcaagtattatgtgaaaaatatagtcctgaaaattttccttatcgccgtggcccggggatgggagtccatgtcccagccacacctcagggctctcctatgaaagatcgcctcaacctcccaagtgtactagtgttgaacagctgtggaataacctgtgcaggagatgaaaaagaaattgctgctttctgcgctcatgtgtcggaactagatctttctgacaacaaactcgaagactggcatgaggtttgcagtcctgggaagacattgataaactaaattcatttcccaaactggaagaagtgagattgttaggaattcctcttctgcagccatataccaccgaggagcgaaggaaattggtaatagccagattgccatcagtttccaaacttaatggcagcgttgttactgatggtgaacgagaagattctgagagattttttattcgttactatgtggatgttccacaggaagaagtgccattcaggtatcatgaactgatcactaaatatgggaagttggagcctttggcagaagtggacctaagaccccagagcagtgcaaaagtagaagtccactttaacgatcaggtggaagaaatgagcattcgtctggaccaaacagtggcagaactaaagaaacagttaaaaactctagtacaattacccacaagcaacatgcttctctactattttgaccatgaagcaccctttggcccagaggaaatgaagtacagctctcgggcattgcattcctttggcattagggatggagataaaatttacgtggaatccaaaacaaaataacctctaccagccttgtgaaaaacatacacataaggacttgttgcagggcatttgtttttaatgtggttttctttaggagggagaggttgtttttgttttgttttgttctgtttaggtttgggaaggattttgtatatttttccccctggagtgagtaggggccatttttgggtgttttctaccacagattgatttggctcagccagcggaattggccacatttccagtgtatgtgccctctctaaggaaagatgacaaagaaatcaccgacttcttactgtgttcactgggatttgcctgccacttggttatcattactgttgggtgaacctgtgaagataacatgaacactgtagccccttagaagggtctcatagagaatttaaacagggtgacaaggaatcttcacaggaagggccagaacttctctctcccagttcttccttccgctaccctccctccttggcttttttggttcagttccatttttttttcattttgacatgtggtttacctaatagttttgttctgttcataattcttatttctcaacctgggtgatttttttgttctcatttctcccttttgaaataattgaaagtgttttaagcatttttaacctgattctaatctcaggtacgcagtaagaagctataactctgttagaacctcgaagagtagatgtagaatgaaaactccaggaaaacttgcagttattctggaagcaccggcagaacagtctgatctctttgtatgttactaactcacttttaatgtccctgtacattatgtcagccattactttcataacatgaaatatgtcagattccagagttcttttatttttgcttattgaatgtatttcctcatatctttctttttcattactttaaactattgggaattgaggcctgacttcataaataattcaatagagtcctggatacgtgcaccaggagagttgagaattagctcataaactatctgtggtgtgtgtggggaatgaagttgggggatgtgggggaagagcttatgactttcccacctgtgtcatccattggaagcccttgctcttgcactttgcattaaaagtgggaaacattaatcaaagggagattttattcccaggttttccctgggactttgtgatatcataattgaacagttcttttgttttacatttcaatttagttgcctcatagaagtataactgcccaatctatgagtaaagtgtaagtgtcaaaacttt

SEQ ID NO: 21247 - DNA, 5142 bp, Homo sapiens
  ENST00000422003
acactgggctccggcggccagagtgggggactaggtgaagcggcgccgggccggggctggccgggaccaggcccgaggctgagcggcggcgacagcggtggccgggaggggggaggagaggcgcagccagaggagccgccgcagtagctcccccgcctcccgggctgagggcattttaagaaagaaagatggatcaacctagtggaagaagtttcatgcaagtattatgtgaaaaatatagtcctgaaaattttccttatcgccgtggcccggggatgggagtccatgtcccagccacacctcagggctctcctatgaaagatcgcctcaacctcccaagtgtactagtgttgaacagctgtggaataacctgtgcaggagatgaaaaagaaattgctgctttctgcgctcatgtgtcggaactagatctttctgacaacaaactcgaagactggcatgaggtcagtaaaattgtgtcaaatgttcctcagttggagtttctaaacctgagttccaaccctctgaatttgtcggttttagaaagaacatgtgctgggtccttctctggggttcgcaaacttgtcctcaacaacagcaaagcttcttgggagacggtccacatgatactacaggagttaccagatttggaggagctcttcctgtgccttaatgactatgaaacagtgtcttgtccttctatttgctgtcattctcttaagctactacatataacagacaataacctccaagactggactgaaatacgaaagttaggagttatgtttccttcactggataccctcgtcctggccaacaatcatttgaatgctattgaggagcctgatgattcattggccaggttgtttcctaatcttcgatccatcagcctccacaagtcaggtttgcagtcctgggaagacattgataaactaaattcatttcccaaactggaagaagtgagattgttaggaattcctcttctgcagccatataccaccgaggagcgaaggaaattggtaatagccagattgccatcagtttccaaacttaatggcagcgttgttactgatggtgaacgagaagattctgagagattttttattcgttactatgtggatgttccacaggaagaagtgccattcaggtatcatgaactgatcactaaatatgggaagttggagcctttggcagaagtggacctaagaccccagagcagtgcaaaagtagaagtccactttaacgatcaggtggaagaaatgagcattcgtctggaccaaacagtggcagaactaaagaaacagttaaaaactctagtacaattacccacaagcaacatgcttctctactattttgaccatgaagcaccctttggcccagaggaaatgaagtacagctctcgggcattgcattcctttggcattagggatggagataaaatttacgtggaatccaaaacaaaataacctctaccagccttgtgaaaaacatacacataaggacttgttgcagggcatttgtttttaatgtggttttctttaggagggagaggttgtttttgttttgttttgttctgtttaggtttgggaaggattttgtatatttttccccctggagtgagtaggggccatttttgggtgttttctaccacagattgatttggctcagccagcggaattggccacatttccagtgtatgtgccctctctaaggaaagatgacaaagaaatcaccgacttcttactgtgttcactgggatttgcctgccacttggttatcattactgttgggtgaacctgtgaagataacatgaacactgtagccccttagaagggtctcatagagaatttaaacagggtgacaaggaatcttcacaggaagggccagaacttctctctcccagttcttccttccgctaccctccctccttggcttttttggttcagttccatttttttttcattttgacatgtggtttacctaatagttttgttctgttcataattcttatttctcaacctgggtgatttttttgttctcatttctcccttttgaaataattgaaagtgttttaagcatttttaacctgattctaatctcaggtacgcagtaagaagctataactctgttagaacctcgaagagtagatgtagaatgaaaactccaggaaaacttgcagttattctggaagcaccggcagaacagtctgatctctttgtatgttactaactcacttttaatgtccctgtacattatgtcagccattactttcataacatgaaatatgtcagattccagagttcttttatttttgcttattgaatgtatttcctcatatctttctttttcattactttaaactattgggaattgaggcctgacttcataaataattcaatagagtcctggatacgtgcaccaggagagttgagaattagctcataaactatctgtggtgtgtgtggggaatgaagttgggggatgtgggggaagagcttatgactttcccacctgtgtcatccattggaagcccttgctcttgcactttgcattaaaagtgggaaacattaatcaaagggagattttattcccaggttttccctgggactttgtgatatcataattgaacagttcttttgttttacatttcaatttagttgcctcatagaagtataactgcccaatctatgagtaaagtgtaagtgtcaaaactttacaattgcctccaagtcatattttttgcagaagcacatttaaagcacttttctgtaaaagctagttccttacctgcttggaaatctttttgtttgttcttctattcctttgttaatcagatgtaatccctttctttaatgtgtatttttcttggtccaccatgtttacagatgggagacttgagagatacttagcataactggggcagaaagtgtgtaagtgaagtatttttcaaagaatgcagttattatctgattgcatttgaccttttgacctttgttacataattctacccctcctacaaatttaatttttttatgaaatttttaggtgacttgtaaattcttcatgtatgaggagttgtgtttattaatgctactttttaaattttcctgtgccatgtggcagatgtttattctcttaatgcacttcaggtttgctatctgtaaagcctttgacccaggcctactgagtcaaatctacattcagtgtaacattaaaggtggaaaccaaagggtttgagaaagacgaataaggcctattctccttctgctgcagactttatctttcaaaatcataaaaatgagcaatggagatccaggctgggtatagacaagaataattattttgcaaacacattttcctgacagatttttggaagtaggaaaaaagtatggcaacagtgtcatgaagattgaaactgtaggtgctttgtgtatgtatgcatgagtgcagatgagtttgagagagaaaaagtgtaattgagccctttgcttttgtcagcctgggaaacagatgcgttcttattttttgaagttgtgtgaccctggactgtcccacagcagaaggcagaacaaacacttatgttatgctttaatcataagtggaatggtcacaattaataagatattttatatatggcaaagttttatgaaatgcttttttactattagagacctgtttcttctgttattacagaacacagtgtttatcaactgcggacataattcttttattatacagttgcatgtaaagggagcttctcatttaattcagcggatgtgggtatttttagggcattgtaattgatggttttaataattgctgaataatttttgattaagagaaaaatgtaatacaattactggtctgagttacagaacagaagttaatgaaaaaggctatttgagcatgtgtacttatagattcatttgggtggctgagaaaagatgctgcttttgaaataaaattggtgctgtgtagacacttgtaaccaaaattatttttataacagaactaaaagaaggagagaagaggccatggacctttgagtttacatgttatacctaattgattgtctgcagcttatctgtattttaatattgactttgtccagattcagtgagaacatagtattgacattatgaggcaaaatgctgtcatagccagtattactgatatgttgctacagacacaatgtatagaacataccttttctaaaataggaattatttccagttatgaaaaaggaaaagagtaataaagaaaaccaaatcaaaaccaagggatcctttctacatgtgggtgaacggctgctaaagccacagtagaaaccaatttttgaatttgaattgttgaaatatcctagattgctttaatggaaaaaatccagagtcacatatcttttttattatcaagtttttgcagccttttgccagcattgccataaatacgtaagaaagcagcagatagtataagcccctagttattaagacttctcagttaatattaaggccaaaatataacttgagctaggtataacagggctgaatgctacagtgttgtttttaaagattttgcttatttttaaagacaggaaaattcagttctaaccagatgttccagctatgttactcaaccagcagtggtaggagcagagagcacttgcactaagagctgatcaccatttgagatacgcggcttaacgcacatgtgagtgtagcttgctacatgaaaatgctaggctctagggcatgtaaaacatgaatacagaatactagattgttctaagtaatgtcatttcggtttgtgaatttgatttttcccttcatttcatgtcatattgaaaatgcaaacaaactgctctcaagaacacccagaagctatctgtgttaccagatgtgttgtgaacactctactatttttcataggtgcttccttgaaatatatgtccattgtagtggtggagagggactggactctctcaggctctttacttgccagttgtctcccgcagttaatggaaatatatatacatatatatatatattttatttagaatataatttaaacatgaaggtctattctttgcactttttattaatatatatatagataatctttaaaaaaattaaaattcaagtccatttt

SEQ ID NO: 21248 - DNA, 947 bp, Homo sapiens
  ENST00000533712
tgggggactaggtgaagcggcgccgggccggggctggccgggaccaggcccgaggctgagcggcggcgacagcggtggccgggaggggggaggagaggcgcagccagaggagccgccgcagtagctcccccgcctcccgggctgagggcattttaagaaagaaagatggatcaacctagtggaagaagtttcatgcaagtattatgtgaaaaatatagtcctgaaaattttccttatcgccgtggcccggggatgggagtccatgtcccagccacacctcagggctctcctatgaaagatcgcctcaacctcccaagtgtactagtgttgaacagctgtggaataacctgtgcaggagatgaaaaagaaattgctgctttctgcgctcatgtgtcggaactagatctttctgacaacaaactcgaagactggcatgagaaagaacatgtgctgggtccttctctggggttcgcaaacttgtcctcaacaacagcaaagcttcttgggagacggtccacatgatactacaggagttaccagagtttgcagtcctgggaagacattgataaactaaattcatttcccaaactggaagaagtgagattgttaggaattcctcttctgcagccatataccaccgaggagcgaaggaaattggtaatagccagattgccatcagtttccaaacttaatggcagcgttgttactgatggtgaacgagaagattctgagagattttttattcgttactatgtggatgttccacaggaagaagtgccattcaggtatcatgaactgatcactaaatatgggaagttggagcctttggcagaagtggacctaagaccccagagcagtgcaaaagtagaagtccactttaacgatcaggtggaagaaatgagcattcgtctggaccaaacagtggcagaactaaagaaacagttaaa

SEQ ID NO: 21249 - DNA, 1913 bp, Homo sapiens
  ENST00000524726
gtaaccctatgagctaggagttacaggctactaccccttcctgtgagtgaagaggggtagacttagagaacttaagtaacttgcccacagttacacagagtagtggaatcagtcaggatttacatacccagggcgtttagttttagaaccagtacttactaccattgggcagtattgccatagcactaaatgtaggaggagctagtgaaaaaaaaaacaaaaacaaacgtggatttttttttttttaatgacctgcagacttttgcaacctttatgcgtgattgatgtttcaacattctggcaatccctggttattagccagggtggtttgtaaactgctctggaaggctgtagagtgatgaactagtggtctgttcctaatgaggcttttccttaacatgatggcttctgtagctgctcaagagcacagataatgggggtaatctgttctgtaaacagctaagtaatgaccttaaacttgtgtgttcacagcggaaagaaaacatgcatatatgattttcttctgatgaaacctaatgtattcaagaaaaagaatcttgctttttggaaggatggaaaaattgggaataattttttcccctttgataattagaccactcagtactgttgcttagttttttggttcagttactttgatgtggttacaagaggaattttggctgtaatggatttcatacatttttgtaagttatgtttccatgtctcgtgtgtgatgttgtgtactgttgacatgaaatactccttttttggtaaagatggattggcttaacagattagagctacagaaagtatgacttagcacgctggtaaggccacaaaaacccaagcaagttcccccagtttcgtatcctgtaaatagagataagttagtttttctgtttcagagagtggttatggaaaactactaggctttaaaatgattgttaatctcagtgtggggacatttggtttggggacatcagttcaggagtaaatgtatctgatcctgctttgaataaatgcaacttgaaagccttggaattttaccagatcgaatctgggccaaatagaaagaatgtctaatttaatagggatatagacagttggtttaaaccaacatttttggacgaggagaggctatggaaatgaagaaagaagtgtttagaaatatcacacaaacagcattttaagaaagaaagatggatcaacctagtggaagaagtttcatgcaagtattatgtgaaaaatatagtcctgaaaattttccttatcgccgtggcccggggatgggagtccatgtcccagccacacctcagggctctcctatgaaagatcgcctcaacctcccaagtgtactagtgttgaacagctgtggaataacctgtgcaggagatgaaaaagaaattgctgctttctgcgctcatgtgtcggaactagatctttctgacaacaaactcgaagactggcatgaggtcagtaaaattgtgtcaaatgttcctcagttggagtttctaaacctgagttccaaccctctgaatttgtcggttttagaaagaacatgtgctgggtccttctctggggttcgcaaacttgtcctcaacaacagcaaagcttcttgggagacggtccacatgatactacaggagttaccagatttggaggagctcttcctgtgccttaatgactatgaaacagtgtcttgtccttctatttgctgtcattctcttaagctactacatataacagacaataacctccaagactggactgaaatacgaaagttaggagttatgtttccttcactggataccctcgtcctggccaacaatcatttgaatgctattgaggagcctgatgattcattggccaggttgtttcctaatcttcgatccatcagcctccacaagtcaggt

SEQ ID NO: 21250 - DNA, 437 bp, Homo sapiens
  ENST00000530362
atcgccgtggcccggggatgggagtccatgtcccagccacacctcagggctctcctatgaaagatcgcctcaacctcccaagtgtactagtgttgaacagctgtggaataacctgtgcaggagatgaaaaagaaattgctgctttctgcgctcatgtgtcggaactagatctttctgacaacaaactcgaagactggcatgaggtgaagtttttatattgctacattttagtgaaaagcagcaataaccattgtgtcattgtttatgttattatatgttctgctaaattctgttctcacttgatgtctgtatgacttcttgttgtctgtatatcttattgtctgtatgtctttatatcaagataaataaggcctataatcccagtgctaaggaggctgaggcaggaggatcacttgagcccaggaattcaagaccag

SEQ ID NO: 21251 - DNA, 966 bp, Homo sapiens
  ENST00000533134
ggagtccatgtcccagccacacctcagggctctcctatgaaagatcgcctcaacctcccaagtgtactagtgttgaacagctgtggaataacctgtgcaggagatgaaaaagaaattgctgctttctgcgctcatgtgtcggaactagatctttctgacaacaaactcgaagactggcatgagaaagaacatgtgctgggtccttctctggggttcgcaaacttgtcctcaacaacagcaaagcttcttgggagacggtccacatgatactacaggagttaccagatttggaggagctcttcctgtgccttaatgactatgaaacagtgtcttgtccttctatttgctgtcattctcttaagctactacatataacagacaataacctccaagactggactgaaatacgaaagttaggagttatgtttccttcactggataccctcgtcctggccaacaatcatttgaatgctattgaggagcctgatgattcattggccaggttgtttcctaatcttcgatccatcagcctccacaagtcagatccatctctcctgtcaccaaattgataatacagtcaaccctccatattcatggacttcatccatgcattcaaccaactgcagattgaaaatacatggggaagaagggtttgcagtcctgggaagacattgataaactaaattcatttcccaaactggaagaagtgagattgttaggaattcctcttctgcagccatataccaccgaggagcgaaggaaattggtaatagccagattgccatcagtttccaaacttaatggcagcgttgttactgatggtgaacgagaagattctgagagattttttattcgttactatgtggatgttccacaggaagaagtgccattcaggtatcatgaactgatcactaaatatgggaagttggagcctttggcagaagtggacctaagaccccagagcag

SEQ ID NO: 21252 - DNA, 1210 bp, Homo sapiens
  ENST00000533169
cattcttatgtgaatggctattatacttacagtcagtactgcttaatttagtacttaattatttaagcacaaaagtaatttcgcactaccttatatcattcttcgctatttcagtgtgtacttcaggttttgtcttcccagctatattttgaacttcaggaagacatcttggtattttctccacaattcctagcagagtctcacatatagtaggcacttacttatttattgaatgaatgaaaataggtgtaaagtagaaattaaactgctttaaacaatgaaatatttccttttttctctgcagtttggaggagctcttcctgtgccttaatgactatgaaacagtgtcttgtccttctatttgctgtcattctcttaagctactacatataacagacaataacctccaagactggactgaaatacgaaagttaggagttatgtttccttcactggataccctcgtcctggccaacaatcatttgaatgctattgaggagcctgatgattcattggccaggttgtttcctaatcttcgatccatcagcctccacaagtcaggtttgcagtcctgggaagacattgataaactaaattcatttcccaaactggaagaagtgagattgttaggaattcctcttctgcagccatataccaccgaggagcgaaggaaattggtaatagccagattgccatcagtttccaaacttaatggcagcgttgttactgatggtgaacgagaagattctgagagattttttattcgttactatgtggatgttccacaggaagaagtgccattcaggtatcatgaactgatcactaaatatgggaagttggagcctttggcagaagtggacctaagaccccagagcagtgcaaaagtagaagtccactttaacgatcaggtggaagaaatgagcattcgtctggaccaaacagtggcagaactaaagaaacagttaaaaactctagtacaattacccacaagcaacatgcttctctactattttgaccatgaagcaccctttggcccagaggaaatgaagtacagctctcgggcattgcattcctttggcattagggatggagataaaatttacgtggaatccaaaacaaaataacctctaccagccttgtgaaaaacatacacataaggacttgttgcagggcatttgtttttaatgtggttttctttaggagggagagg

SEQ ID NO: 21253 - DNA, 520 bp, Homo sapiens
  ENST00000441088
tctgcacaagcccagggagcccaggagcaacgaagggcaggctcaagggaaggccccaccatgtccttctggggggccttgaatggcaactgatacataataagacacaatctattctgctgattcacaattatggagactgtatttccgtgagggtggaagaaaatcataccatatcagatgcctcgcagagcaccaggcccaccgtgaaaggctggtccctgcagacggcttcccatttttatgaccggatgctgggaagcctgctggtccacaggtccatacatgaagtcaccataaggagccctggcctccttgcagaaacatcgaggtgacatgtagcatgaccgagctcgctggcgcctcttcatcgtgctgccaccgccctgcaggaagaggggccatgcagtcagtcttgcaccactttcaacgtttgcgagggagagagggtggttcccacttcatcaacacctcatcgccgcgaggtgaggctaagatgagcataaccagtgacgaggtg

SEQ ID NO: 21254 - DNA, 4674 bp, Homo sapiens
  ENST00000380961
gcccagggagcccaggagcaacgaagggcaggctcaagggaaggccccaccatgtccttctggggggccttgaatggcaactgatacataataagacacaatctattctgctgattcacaattatggagactgtatttccgtgagggtggaagaaaatcataccatatcagatgcctcgcagagcaccaggcccaccgtgaaagctcctggcaaccactattccactccctgcttctttgaatttcacaacttgaggtagcttgtgtaagtggaattattttaaaagctggttcatgttaaagtgcttagaacagagcttggtgagcatccggtcaacagctggtccctgcagacggcttcccatttttatgaccggatgctgggaagcctgctggtccacaggtccatacatgaagtcaccataagagggtggttcccacttcatcaacacctcatcgccgcgaggtgaggctaagatgagcataaccagtgacgaggtgaactttctggtgtatcggtatctccaggagtcaggtttttcccactcggctttcacgtttgggattgagagccacatcagccagtccaacatcaatgggacgctagtgccaccggccgccctcatctccattctccagaagggcctgcagtatgtagaggccgagatcagtatcaacgaggatggcacagtgttcgacggccgccccatagagtccctgtcactgatagacgccgtgatgcccgacgtggtgcagacgcggcagcaggcattccgagagaagctcgctcagcagcaagccagtgcggcggcggcggcggctgcggccacggcagcagcgacagcagccaccacgacctcagccggcgtttcccaccaaaatccatcgaagaacagagaggccacggtgaatggggaagagaacagagcacattcagtcaataatcacgcgaagccaatggaaatagatggagaggttgagattccatccagcaaagccacagtccttcggggccatgagtctgaggtgttcatttgtgcctggaatcctgtcagtgatttgctagcctccggatctggagactcaactgcaaggatatggaacctgaatgagaatagcaacgggggctccacccagctcgtgttgaggcactgtatacgagaggggggccatgacgtcccgagtaacaaagacgtcacctcactggactggaataccaatggaacactcttggctacgggttcatatgacggttttgcaagaatatggacggaagatggtaacctggccagcaccttaggccaacataaaggccccatctttgccttgaaatggaaccgaaaggggaattacattttgagtgctggtgtagacaaaacaacaataatttgggatgcccacacaggagaagccaaacagcagtttccttttcattcagcccctgcccttgatgtggactggcagaacaacacgacctttgcctcctgtagcacagacatgtgtatccatgtgtgcaggctcggctgtgaccgcccagtcaaaaccttccagggacacacaaacgaggtcaacgccatcaaatgggatccgtctggaatgttgctggcatcctgctcggatgacatgacattgaagatctggagcatgaaacaggaggtgtgcatccatgatcttcaggctcacaataaagagatctacaccatcaagtggagccccactgggcccgccaccagcaacccaaactccaacatcatgttggcaagtgcttcgtttgattctacggtgcgactgtgggacatagaacgaggcgtctgcacccacacgctcacgaagcatcaggagcctgtctatagcgtagctttcagccctgatgggaagtacttggccagtggatccttcgacaagtgcgtccatatctggaatactcagagtggaaatcttgtccacagctaccgaggcactggcggcatcttcgaggtgtgctggaacgcccgaggagacaaagtgggtgccagcgcgtccgacggctctgtgtgtgttttggatctgcggaagtaaccacaaaatattatcgaaaaaagaaaagaattctaatgaccagccgtgaatgtgtagggttgcagctctattctccaaaactgtaggaacttgacttgcgttagagtgtactctgaaaccaactcgtctctggccgcaggagtctatatgttttcgtaatcttcatcaagaagtttttaaaaggcaagcaaaaacagaagcaaatcatatcaaacggggatagaatggtttccactgaggacattcagcctgggaaggaggaagtcaccagctcgaggcgtgtggattggtttccacccggaacaggctctgtgatggctgaatggaaagaaacgtaaaaagctgtgccaaaaaaaaagcaaaatgctgtgataaaccaaacagggaagggggaaaaaccctcctccttgggattttttttttttgttttccctaacaatttggacactacaattgctctcacaaaggaggttcaaagaccagtttgtaccgatgaaacgcgcaactttgtaatcccaacactttctattttctagaatcttctttgttcattgggtggtttttcagtcggctggaattctatcttctgggggccttccgtctgagatggaagctgtcttgggcttgttgtctcttccttctgttgctccctgcccctccccctgcctttccactctgtctggtgagctctgctttttcagtgcaccatcaagagatgcagccccgtggacatgaagacacaatctcccacggacagctttcccccttccgccctctcccaccctctcctccccttgcgctcgcgctcgcgctcgctttctcactggcgtgctctctttctctctctctctccctctgtacctttctcatagttgcttcagatcttaggtctcaagggcactttggcgcgtagtaagtgctttatgtaagaaggcagggcaggggggctttttacaggagaaaaaaaaatgacttataagagaaagagcctggagtatttttggaaaaaaaaataatatttttatgttaaaacaattttaaaatcttaaaatggccatcagacatagagagctttgtgtgattcatgttttaaaaagaaccgaagaagccacaggcagggcctgagggagcccctggctttcccctcagcctcaggaaaggtggtcaggaaaactctggctggacaagggtcagtcttcggggtcagcagcgagattgctctgcagccagtgagggaggtccccgccatgccggctggaagaagaacctcgcatcttttggtgtgtatgcaccttggcagccagcaggaaagcagcgaagagccgcgcgccctctggcctcaagggagcattggcagaaccataaggtactgcagaagccgtcgaaaccgactgctcggctggattaggcgtgttggctacatctttcccacaaccgtataacgaccgatggtcatttctccaagagcaggcttggcgagtccttgcagagctgacatagaggcgcccgcatgtcacttagtctaacgctgacagaaatgaatgcagaaggaagattttcagtcctgaacgtgaattatagaggtagaacgtcgctaataatttctgccatctttataatttctttgtctcacagaagactaggagaaagatcttttttaaataatctttttgctgtttttaaaaaattaaacaaggctttgtgttcctagaagagcttcatttcagtgaatctggtgacctccatctgcttgctgtcataacccgacacggacttatttttgtcattagcaagggggaaaaggccaaaggacaagggcctcttctcccattggttttcctgtgggcagaagggctgaggaagatggcccagcccgtgggggctgctgggtcaccagcagtgggtagggtgcaatctggtgtgtgttccagcagtgagacggtgttattgtgaaggtggcattcatctgcggagccaaaacccagccatcggggaagggtcagggcttctgtggaacttggaacgtgccaggaccacctgcaaaagccagggtgcgttgatcattctcagatcattgattggcctccacttgggtatgtgaattattcatgtcccagaagaccaaaaagtgctctggttctgagatgagtattttattcgtgttctgtttccgaaacacttagcaaagaaggtcacagtgatgtggagtcgccgcacccatctttgaagatagccagtgtccctggatgaggtgatgatttcccgtcccaaggactctgtgaagtttagagtacagtttgttggggtccaaaagacaccatctctaccccacccaaataaaaatgcactcatctctgtagaacatctgctgtcaaaggccagcctgtcgttagggcatggcttatgcttgacaaaccagtaacaactgtgggatggcgatggtgggatgtgtcgcaagcaattcactagacaatcttcacatgaatgtcggtagccagggtctctcccgagggatggctttagtcttgatgaatgtgaaccatgtcggaattgttaggtagaaacctgggctgggaggcctcggaccccaggctccatccctggcttccccagcct

SEQ ID NO: 21255 - DNA, 565 bp, Homo sapiens
  ENST00000415293
ccagggagcccaggagcaacgaagggcaggctcaagggaaggccccaccatgtccttctggggggccttgaatggcaactgatacataataagacacaatctattctgctgattcacaattatggagactgtatttccgtgagggtggaagaaaatcataccatatcagatgcctcgcagagcaccaggcccaccgtgaaaggctggtccctgcagacggcttcccatttttatgaccggatgctgggaagcctgctggtccacaggtccatacatgaagtcaccataagagggtggttcccacttcatcaacacctcatcgccgcgaggtgaggctaagatgagcataaccagtgacgaggtgaactttctggtgtatcggtatctccaggagtcaggtttttcccactcggctttcacgtttgggattgagagccacatcagccagtccaacatcaatgggacgctagtgccaccggccgccctcatctccattctccagaagggcctgcagtatgtagaggccgagatcagtatcaacgaggatggcacagtgttcgacggc

SEQ ID NO: 21256 - DNA, 5871 bp, Homo sapiens
  ENST00000217964
gggccggcggcgggggcggacccctggcggtcctcctggctggggtccgcgcgctcgcggcagctccccgtggaggtcactgtccgtgccagtccctcccgctgtcccgccctctcccgctgccgccgccgccgccgccgcgcccgcctcagcgcccccactccgcgcttgggagcgaggagccgccagcgcccccgccccgccgccgccgcagcgccctcaggccgccattcgccaccgaaactttccagcgcccgcgctctctccgggactcggcggcggcggggcgggggcggcccgggggcggcgcgcggctgctccggggcgccgggccctcttcggccgccgcacggccgggactcggaggctgccggctggagggaggttcggagcgcggccgggcgcgcggcgccgccacaagttgcgctgctcgcgacgagatttccgtgagggtggaagaaaatcataccatatcagatgcctcgcagagcaccaggcccaccgtgaaaggctggtccctgcagacggcttcccatttttatgaccggatgctgggaagcctgctggtccacaggtccatacatgaagtcaccataaggagccctggcctccttgcagaaacatcgaggtgacatgtagcatgaccgagctcgctggcgcctcttcatcgtgctgccaccgccctgcaggaagaggggccatgcagtcagtcttgcaccactttcaacgtttgcgagggagagagggtggttcccacttcatcaacacctcatcgccgcgaggtgaggctaagatgagcataaccagtgacgaggtgaactttctggtgtatcggtatctccaggagtcaggtttttcccactcggctttcacgtttgggattgagagccacatcagccagtccaacatcaatgggacgctagtgccaccggccgccctcatctccattctccagaagggcctgcagtatgtagaggccgagatcagtatcaacgaggatggcacagtgttcgacggccgccccatagagtccctgtcactgatagacgccgtgatgcccgacgtggtgcagacgcggcagcaggcattccgagagaagctcgctcagcagcaagccagtgcggcggcggcggcggctgcggccacggcagcagcgacagcagccaccacgacctcagccggcgtttcccaccaaaatccatcgaagaacagagaggccacggtgaatggggaagagaacagagcacattcagtcaataatcacgcgaagccaatggaaatagatggagaggttgagattccatccagcaaagccacagtccttcggggccatgagtctgaggtgttcatttgtgcctggaatcctgtcagtgatttgctagcctccggatctggagactcaactgcaaggatatggaacctgaatgagaatagcaacgggggctccacccagctcgtgttgaggcactgtatacgagaggggggccatgacgtcccgagtaacaaagacgtcacctcactggactggaataccaatggaacactcttggctacgggttcatatgacggttttgcaagaatatggacggaagatggtaacctggccagcaccttaggccaacataaaggccccatctttgccttgaaatggaaccgaaaggggaattacattttgagtgctggtgtagacaaaacaacaataatttgggatgcccacacaggagaagccaaacagcagtttccttttcattcagcccctgcccttgatgtggactggcagaacaacacgacctttgcctcctgtagcacagacatgtgtatccatgtgtgcaggctcggctgtgaccgcccagtcaaaaccttccagggacacacaaacgaggtcaacgccatcaaatgggatccgtctggaatgttgctggcatcctgctcggatgacatgacattgaagatctggagcatgaaacaggaggtgtgcatccatgatcttcaggctcacaataaagagatctacaccatcaagtggagccccactgggcccgccaccagcaacccaaactccaacatcatgttggcaagtgcttcgtttgattctacggtgcgactgtgggacatagaacgaggcgtctgcacccacacgctcacgaagcatcaggagcctgtctatagcgtagctttcagccctgatgggaagtacttggccagtggatccttcgacaagtgcgtccatatctggaatactcagagtggaaatcttgtccacagctaccgaggcactggcggcatcttcgaggtgtgctggaacgcccgaggagacaaagtgggtgccagcgcgtccgacggctctgtgtgtgttttggatctgcggaagtaaccacaaaatattatcgaaaaaagaaaagaattctaatgaccagccgtgaatgtgtagggttgcagctctattctccaaaactgtaggaacttgacttgcgttagagtgtactctgaaaccaactcgtctctggccgcaggagtctatatgttttcgtaatcttcatcaagaagtttttaaaaggcaagcaaaaacagaagcaaatcatatcaaacggggatagaatggtttccactgaggacattcagcctgggaaggaggaagtcaccagctcgaggcgtgtggattggtttccacccggaacaggctctgtgatggctgaatggaaagaaacgtaaaaagctgtgccaaaaaaaaagcaaaatgctgtgataaaccaaacagggaagggggaaaaaccctcctccttgggattttttttttttgttttccctaacaatttggacactacaattgctctcacaaaggaggttcaaagaccagtttgtaccgatgaaacgcgcaactttgtaatcccaacactttctattttctagaatcttctttgttcattgggtggtttttcagtcggctggaattctatcttctgggggccttccgtctgagatggaagctgtcttgggcttgttgtctcttccttctgttgctccctgcccctccccctgcctttccactctgtctggtgagctctgctttttcagtgcaccatcaagagatgcagccccgtggacatgaagacacaatctcccacggacagctttcccccttccgccctctcccaccctctcctccccttgcgctcgcgctcgcgctcgctttctcactggcgtgctctctttctctctctctctccctctgtacctttctcatagttgcttcagatcttaggtctcaagggcactttggcgcgtagtaagtgctttatgtaagaaggcagggcaggggggctttttacaggagaaaaaaaaatgacttataagagaaagagcctggagtatttttggaaaaaaaaataatatttttatgttaaaacaattttaaaatcttaaaatggccatcagacatagagagctttgtgtgattcatgttttaaaaagaaccgaagaagccacaggcagggcctgagggagcccctggctttcccctcagcctcaggaaaggtggtcaggaaaactctggctggacaagggtcagtcttcggggtcagcagcgagattgctctgcagccagtgagggaggtccccgccatgccggctggaagaagaacctcgcatcttttggtgtgtatgcaccttggcagccagcaggaaagcagcgaagagccgcgcgccctctggcctcaagggagcattggcagaaccataaggtactgcagaagccgtcgaaaccgactgctcggctggattaggcgtgttggctacatctttcccacaaccgtataacgaccgatggtcatttctccaagagcaggcttggcgagtccttgcagagctgacatagaggcgcccgcatgtcacttagtctaacgctgacagaaatgaatgcagaaggaagattttcagtcctgaacgtgaattatagaggtagaacgtcgctaataatttctgccatctttataatttctttgtctcacagaagactaggagaaagatcttttttaaataatctttttgctgtttttaaaaaattaaacaaggctttgtgttcctagaagagcttcatttcagtgaatctggtgacctccatctgcttgctgtcataacccgacacggacttatttttgtcattagcaagggggaaaaggccaaaggacaagggcctcttctcccattggttttcctgtgggcagaagggctgaggaagatggcccagcccgtgggggctgctgggtcaccagcagtgggtagggtgcaatctggtgtgtgttccagcagtgagacggtgttattgtgaaggtggcattcatctgcggagccaaaacccagccatcggggaagggtcagggcttctgtggaacttggaacgtgccaggaccacctgcaaaagccagggtgcgttgatcattctcagatcattgattggcctccacttgggtatgtgaattattcatgtcccagaagaccaaaaagtgctctggttctgagatgagtattttattcgtgttctgtttccgaaacacttagcaaagaaggtcacagtgatgtggagtcgccgcacccatctttgaagatagccagtgtccctggatgaggtgatgatttcccgtcccaaggactctgtgaagtttagagtacagtttgttggggtccaaaagacaccatctctaccccacccaaataaaaatgcactcatctctgtagaacatctgctgtcaaaggccagcctgtcgttagggcatggcttatgcttgacaaaccagtaacaactgtgggatggcgatggtgggatgtgtcgcaagcaattcactagacaatcttcacatgaatgtcggtagccagggtctctcccgagggatggctttagtcttgatgaatgtgaaccatgtcggaattgttaggtagaaacctgggctgggaggcctcggaccccaggctccatccctggcttccccagcctgcggccgcaagcaaaaccaagcgcgagatgcagctagcacccttcatatccatccccgttctcagcgggacaacaccatggacagccgttttcagagcctccagcatttgcacaccactactcaccctctctgctgctggcatgttggtagagtcatccctgtaatcaagaaatggcctgtggaatgttattgttcaacgttgtttacagctcttaaaacatggtgaggaatgcctaagtcttagtgaccaaacgtgaccttgaaagcagacatagcatgacagaccttcctagagtgtttggtcgggttcacagtgaccgagagtcaggtccagcacacacctgggaaagggatgctgccccaagggggaccaaaagggccggacgttacagggtgaaaccctctgacccctcgcgacaccgtaggacttgacttttgtttagtctttctaagaaatagatcatggagccaagtgaagtgcactttgtcaaatgtaagggtctgctttgttcttgttgcttttctgttttttaaccttttgttccgccatttaaaaaaagaaaaaaaaaaagcttatgtttcttgtcaaatgcagaaatgttccttccgccactcactgaagttttgcattctggcttgtgcagtttttattgtctgtgtcagacgtacagccagacatgttctctattggcatttttccgattctgttcagatgacagcgaccgccttttcattccccccgccacctgtactcaccctcacgctctttgaagaaaaaaaaaaaaatcaccttgtgtgttgtagctcatttgtttcaagagagaatcaacagatcatattcagtgtcttgaataaattgctctattttgatattagagaa

SEQ ID NO: 21257 - DNA, 496 bp, Homo sapiens
  ENST00000422314
gcgggggcggcccgggggcggcgcgcggctgctccggggcgccgggccctcttcggccgccgcacggccgggactcggaggctgccggctggagggaggttcggagcgcggccgggcgcgcggcgccgccacaagttgcgctgctcgcgacgagatttccgtgagggtggaagaaaatcataccatatcagatgcctcgcagagcaccaggcccaccgtgaaaggctggtccctgcagacggcttcccatttttatgaccggatgctgggaagcctgctggtccacaggtccatacatgaagtcaccataagagggtggttcccacttcatcaacacctcatcgccgcgaggtgaggctaagatgagcataaccagtgacgaggtgaactttctggtgtatcggtatctccaggagtcaggtttttcccactcggctttcacgtttgggattgagagccacatcagccagtccaacatcaatgggacgctagtgcc

SEQ ID NO: 21258 - DNA, 387 bp, Homo sapiens
  ENST00000452824
caacttgaggtagcttgtgctggtccctgcagacggcttcccatttttatgaccggatgctgggaagcctgctggtccacaggtccatacatgaagtcaccataaggagccctggcctccttgcagaaacatcgaggtgacatgtagcatgaccgagctcgctggcgcctcttcatcgtgctgccaccgccctgcaggaagaggggccatgcagtcagtcttgcaccactttcaacgtttgcgagggagagagggtggttcccacttcatcaacacctcatcgccgcgaggtgaggctaagatgagcataaccagtgacgaggtgaactttctggtgtatcggtatctccaggagtcaggtttttcccactcggctttcacgtttgg

SEQ ID NO: 21259 - DNA, 923 bp, Homo sapiens
  ENST00000497555
agctaaagcgtgttgtcttctcccgagggtgtgcacaggttcatgtatcagctgaataaggccctgttccaaaaactgatatttcaagggaaccttaatttatctttaaatttaatgctggtccctgcagacggcttcccatttttatgaccggatgctgggaagcctgctggtccacaggtccatacatgaagtcaccataagatggaggctcgctctgtcatcctggctgcagtgcagtggcacaatcttgggtcgctgcaacctccatttcccaggttcaagtgattctcctgcttcagcctcctgagtagctgggattacaggcgtgcgccacaacgcccagttaatttttttgtatttttagtagacatggggttttgctatgttggccagtctggtctcaaactcctggcctcaagtaatcagcccgcctcagcctcccaaagtgctgggattaacaggcgtgagccaccatgtcccgtcagggatgattttattctgtgaaaagcggcattccttttctaacacaaaacctctcctctgctctgccctcccaaccctgtagcctcatttcctatatagttgttttcatactgattatctctgaagacattgccaggtcgtttttgtttgttttgagacaaggtcttgctctgttacccaggctggagtacagtggcacgatgtcggctcactgcagcctccacctcccagggtcaagcgattgtcgtgcctcagactcccaaatagctgggaatacaggggcatgcctccacacctagctaatttttgtattttttgtagagatgggtttcactgtgttgcccaggctggtctcaaactcctggactcaagtgagcgaccacgcccagccgacattcccaggttttctttacgttttaataaatatgagtagtcca

SEQ ID NO: 21260 - DNA, 5451 bp, Homo sapiens
  ENST00000424279
attgcatgtaatacctcagcatcagtctgcacaagcccagggagcccaggagcaacgaagggcaggctcaagggaaggccccaccatgtccttctggggggccttgaatggcaactgatacataataagacacaatctattctgctgattcacaattatggagactgtatttccgtgagggtggaagaaaatcataccatatcagatgcctcgcagagcaccaggcccaccgtgaaaggctggtccctgcagacggcttcccatttttatgaccggatgctgggaagcctgctggtccacaggtccatacatgaagtcaccataagagggtggttcccacttcatcaacacctcatcgccgcgaggtgaggctaagatgagcataaccagtgacgaggtgaactttctggtgtatcggtatctccaggagtcaggtttttcccactcggctttcacgtttgggattgagagccacatcagccagtccaacatcaatgggacgctagtgccaccggccgccctcatctccattctccagaagggcctgcagtatgtagaggccgagatcagtatcaacgaggatggcacagtgttcgacggccgccccatagagtccctgtcactgatagacgccgtgatgcccgacgtggtgcagacgcggcagcaggcattccgagagaagctcgctcagcagcaagccagtgcggcggcggcggcggctgcggccacggcagcagcgacagcagccaccacgacctcagccggcgtttcccaccaaaatccatcgaagaacagagaggccacggtgaatggggaagagaacagagcacattcagtcaataatcacgcgaagccaatggaaatagatggagaggttgagattccatccagcaaagccacagtccttcggggccatgagtctgaggtgttcatttgtgcctggaatcctgtcagtgatttgctagcctccggatctggagactcaactgcaaggatatggaacctgaatgagaatagcaacgggggctccacccagctcgtgttgaggcactgtatacgagaggggggccatgacgtcccgagtaacaaagacgtcacctcactggactggaataccaatggaacactcttggctacgggttcatatgacggttttgcaagaatatggacggaagatggtaacctggccagcaccttaggccaacataaaggccccatctttgccttgaaatggaaccgaaaggggaattacattttgagtgctggtgtagacaaaacaacaataatttgggatgcccacacaggagaagccaaacagcagtttccttttcattcagcccctgcccttgatgtggactggcagaacaacacgacctttgcctcctgtagcacagacatgtgtatccatgtgtgcaggctcggctgtgaccgcccagtcaaaaccttccagggacacacaaacgaggtcaacgccatcaaatgggatccgtctggaatgttgctggcatcctgctcggatgacatgacattgaagatctggagcatgaaacaggaggtgtgcatccatgatcttcaggctcacaataaagagatctacaccatcaagtggagccccactgggcccgccaccagcaacccaaactccaacatcatgttggcaagtgcttcgtttgattctacggtgcgactgtgggacatagaacgaggcgtctgcacccacacgctcacgaagcatcaggagcctgtctatagcgtagctttcagccctgatgggaagtacttggccagtggatccttcgacaagtgcgtccatatctggaatactcagagtggaaatcttgtccacagctaccgaggcactggcggcatcttcgaggtgtgctggaacgcccgaggagacaaagtgggtgccagcgcgtccgacggctctgtgtgtgttttggatctgcggaagtaaccacaaaatattatcgaaaaaagaaaagaattctaatgaccagccgtgaatgtgtagggttgcagctctattctccaaaactgtaggaacttgacttgcgttagagtgtactctgaaaccaactcgtctctggccgcaggagtctatatgttttcgtaatcttcatcaagaagtttttaaaaggcaagcaaaaacagaagcaaatcatatcaaacggggatagaatggtttccactgaggacattcagcctgggaaggaggaagtcaccagctcgaggcgtgtggattggtttccacccggaacaggctctgtgatggctgaatggaaagaaacgtaaaaagctgtgccaaaaaaaaagcaaaatgctgtgataaaccaaacagggaagggggaaaaaccctcctccttgggattttttttttttgttttccctaacaatttggacactacaattgctctcacaaaggaggttcaaagaccagtttgtaccgatgaaacgcgcaactttgtaatcccaacactttctattttctagaatcttctttgttcattgggtggtttttcagtcggctggaattctatcttctgggggccttccgtctgagatggaagctgtcttgggcttgttgtctcttccttctgttgctccctgcccctccccctgcctttccactctgtctggtgagctctgctttttcagtgcaccatcaagagatgcagccccgtggacatgaagacacaatctcccacggacagctttcccccttccgccctctcccaccctctcctccccttgcgctcgcgctcgcgctcgctttctcactggcgtgctctctttctctctctctctccctctgtacctttctcatagttgcttcagatcttaggtctcaagggcactttggcgcgtagtaagtgctttatgtaagaaggcagggcaggggggctttttacaggagaaaaaaaaatgacttataagagaaagagcctggagtatttttggaaaaaaaaataatatttttatgttaaaacaattttaaaatcttaaaatggccatcagacatagagagctttgtgtgattcatgttttaaaaagaaccgaagaagccacaggcagggcctgagggagcccctggctttcccctcagcctcaggaaaggtggtcaggaaaactctggctggacaagggtcagtcttcggggtcagcagcgagattgctctgcagccagtgagggaggtccccgccatgccggctggaagaagaacctcgcatcttttggtgtgtatgcaccttggcagccagcaggaaagcagcgaagagccgcgcgccctctggcctcaagggagcattggcagaaccataaggtactgcagaagccgtcgaaaccgactgctcggctggattaggcgtgttggctacatctttcccacaaccgtataacgaccgatggtcatttctccaagagcaggcttggcgagtccttgcagagctgacatagaggcgcccgcatgtcacttagtctaacgctgacagaaatgaatgcagaaggaagattttcagtcctgaacgtgaattatagaggtagaacgtcgctaataatttctgccatctttataatttctttgtctcacagaagactaggagaaagatcttttttaaataatctttttgctgtttttaaaaaattaaacaaggctttgtgttcctagaagagcttcatttcagtgaatctggtgacctccatctgcttgctgtcataacccgacacggacttatttttgtcattagcaagggggaaaaggccaaaggacaagggcctcttctcccattggttttcctgtgggcagaagggctgaggaagatggcccagcccgtgggggctgctgggtcaccagcagtgggtagggtgcaatctggtgtgtgttccagcagtgagacggtgttattgtgaaggtggcattcatctgcggagccaaaacccagccatcggggaagggtcagggcttctgtggaacttggaacgtgccaggaccacctgcaaaagccagggtgcgttgatcattctcagatcattgattggcctccacttgggtatgtgaattattcatgtcccagaagaccaaaaagtgctctggttctgagatgagtattttattcgtgttctgtttccgaaacacttagcaaagaaggtcacagtgatgtggagtcgccgcacccatctttgaagatagccagtgtccctggatgaggtgatgatttcccgtcccaaggactctgtgaagtttagagtacagtttgttggggtccaaaagacaccatctctaccccacccaaataaaaatgcactcatctctgtagaacatctgctgtcaaaggccagcctgtcgttagggcatggcttatgcttgacaaaccagtaacaactgtgggatggcgatggtgggatgtgtcgcaagcaattcactagacaatcttcacatgaatgtcggtagccagggtctctcccgagggatggctttagtcttgatgaatgtgaaccatgtcggaattgttaggtagaaacctgggctgggaggcctcggaccccaggctccatccctggcttccccagcctgcggccgcaagcaaaaccaagcgcgagatgcagctagcacccttcatatccatccccgttctcagcgggacaacaccatggacagccgttttcagagcctccagcatttgcacaccactactcaccctctctgctgctggcatgttggtagagtcatccctgtaatcaagaaatggcctgtggaatgttattgttcaacgttgtttacagctcttaaaacatggtgaggaatgcctaagtcttagtgaccaaacgtgaccttgaaagcagacatagcatgacagaccttcctagagtgtttggtcgggttcacagtgaccgagagtcaggtccagcacacacctgggaaagggatgctgccccaagggggaccaaaagggccggacgttacagggtgaaaccctctgacccctcgcgacaccgtaggacttgacttttgtttagtctttctaagaaatagatcatggagccaagtgaagtgcactttgtcaaatgtaagggtctgctttgttcttgttgcttttctgttttttaaccttttgttccgccatttaaaaaaagaaaaaaaaaaagcttatgtttcttgtcaaatgcagaaatgttccttccgccactcactgaagttttgcattctggcttgtgcagtttttattgtctgtgtcagacgtacagccagacatgttctctattggcatttttccgattctgttcagatgacagcgaccgccttttcattccccccgccacctgtactcaccctcacgctctttgaagaaaaaaaaaaaaatcaccttgtgtgttgtagctcatttgtttcaagagagaatcaacagatcatattcagtgtcttgaataaattgctctattttgatattaga

SEQ ID NO: 21261 - DNA, 5596 bp, Homo sapiens
  ENST00000407597
attgcatgtaatacctcagcatcagtctgcacaagcccagggagcccaggagcaacgaagggcaggctcaagggaaggccccaccatgtccttctggggggccttgaatggcaactgatacataataagacacaatctattctgctgattcacaattatggagactgtatttccgtgagggtggaagaaaatcataccatatcagatgcctcgcagagcaccaggcccaccgtgaaaggctggtccctgcagacggcttcccatttttatgaccggatgctgggaagcctgctggtccacaggtccatacatgaagtcaccataaggagccctggcctccttgcagaaacatcgaggtgacatgtagcatgaccgagctcgctggcgcctcttcatcgtgctgccaccgccctgcaggaagaggggccatgcagtcagtcttgcaccactttcaacgtttgcgagggagagagggtggttcccacttcatcaacacctcatcgccgcgaggtgaggctaagatgagcataaccagtgacgaggtgaactttctggtgtatcggtatctccaggagtcaggtttttcccactcggctttcacgtttgggattgagagccacatcagccagtccaacatcaatgggacgctagtgccaccggccgccctcatctccattctccagaagggcctgcagtatgtagaggccgagatcagtatcaacgaggatggcacagtgttcgacggccgccccatagagtccctgtcactgatagacgccgtgatgcccgacgtggtgcagacgcggcagcaggcattccgagagaagctcgctcagcagcaagccagtgcggcggcggcggcggctgcggccacggcagcagcgacagcagccaccacgacctcagccggcgtttcccaccaaaatccatcgaagaacagagaggccacggtgaatggggaagagaacagagcacattcagtcaataatcacgcgaagccaatggaaatagatggagaggttgagattccatccagcaaagccacagtccttcggggccatgagtctgaggtgttcatttgtgcctggaatcctgtcagtgatttgctagcctccggatctggagactcaactgcaaggatatggaacctgaatgagaatagcaacgggggctccacccagctcgtgttgaggcactgtatacgagaggggggccatgacgtcccgagtaacaaagacgtcacctcactggactggaataccaatggaacactcttggctacgggttcatatgacggttttgcaagaatatggacggaagatggtaacctggccagcaccttaggccaacataaaggccccatctttgccttgaaatggaaccgaaaggggaattacattttgagtgctggtgtagacaaaacaacaataatttgggatgcccacacaggagaagccaaacagcagtttccttttcattcagcccctgcccttgatgtggactggcagaacaacacgacctttgcctcctgtagcacagacatgtgtatccatgtgtgcaggctcggctgtgaccgcccagtcaaaaccttccagggacacacaaacgaggtcaacgccatcaaatgggatccgtctggaatgttgctggcatcctgctcggatgacatgacattgaagatctggagcatgaaacaggaggtgtgcatccatgatcttcaggctcacaataaagagatctacaccatcaagtggagccccactgggcccgccaccagcaacccaaactccaacatcatgttggcaagtgcttcgtttgattctacggtgcgactgtgggacatagaacgaggcgtctgcacccacacgctcacgaagcatcaggagcctgtctatagcgtagctttcagccctgatgggaagtacttggccagtggatccttcgacaagtgcgtccatatctggaatactcagagtggaaatcttgtccacagctaccgaggcactggcggcatcttcgaggtgtgctggaacgcccgaggagacaaagtgggtgccagcgcgtccgacggctctgtgtgtgttttggatctgcggaagtaaccacaaaatattatcgaaaaaagaaaagaattctaatgaccagccgtgaatgtgtagggttgcagctctattctccaaaactgtaggaacttgacttgcgttagagtgtactctgaaaccaactcgtctctggccgcaggagtctatatgttttcgtaatcttcatcaagaagtttttaaaaggcaagcaaaaacagaagcaaatcatatcaaacggggatagaatggtttccactgaggacattcagcctgggaaggaggaagtcaccagctcgaggcgtgtggattggtttccacccggaacaggctctgtgatggctgaatggaaagaaacgtaaaaagctgtgccaaaaaaaaagcaaaatgctgtgataaaccaaacagggaagggggaaaaaccctcctccttgggattttttttttttgttttccctaacaatttggacactacaattgctctcacaaaggaggttcaaagaccagtttgtaccgatgaaacgcgcaactttgtaatcccaacactttctattttctagaatcttctttgttcattgggtggtttttcagtcggctggaattctatcttctgggggccttccgtctgagatggaagctgtcttgggcttgttgtctcttccttctgttgctccctgcccctccccctgcctttccactctgtctggtgagctctgctttttcagtgcaccatcaagagatgcagccccgtggacatgaagacacaatctcccacggacagctttcccccttccgccctctcccaccctctcctccccttgcgctcgcgctcgcgctcgctttctcactggcgtgctctctttctctctctctctccctctgtacctttctcatagttgcttcagatcttaggtctcaagggcactttggcgcgtagtaagtgctttatgtaagaaggcagggcaggggggctttttacaggagaaaaaaaaatgacttataagagaaagagcctggagtatttttggaaaaaaaaataatatttttatgttaaaacaattttaaaatcttaaaatggccatcagacatagagagctttgtgtgattcatgttttaaaaagaaccgaagaagccacaggcagggcctgagggagcccctggctttcccctcagcctcaggaaaggtggtcaggaaaactctggctggacaagggtcagtcttcggggtcagcagcgagattgctctgcagccagtgagggaggtccccgccatgccggctggaagaagaacctcgcatcttttggtgtgtatgcaccttggcagccagcaggaaagcagcgaagagccgcgcgccctctggcctcaagggagcattggcagaaccataaggtactgcagaagccgtcgaaaccgactgctcggctggattaggcgtgttggctacatctttcccacaaccgtataacgaccgatggtcatttctccaagagcaggcttggcgagtccttgcagagctgacatagaggcgcccgcatgtcacttagtctaacgctgacagaaatgaatgcagaaggaagattttcagtcctgaacgtgaattatagaggtagaacgtcgctaataatttctgccatctttataatttctttgtctcacagaagactaggagaaagatcttttttaaataatctttttgctgtttttaaaaaattaaacaaggctttgtgttcctagaagagcttcatttcagtgaatctggtgacctccatctgcttgctgtcataacccgacacggacttatttttgtcattagcaagggggaaaaggccaaaggacaagggcctcttctcccattggttttcctgtgggcagaagggctgaggaagatggcccagcccgtgggggctgctgggtcaccagcagtgggtagggtgcaatctggtgtgtgttccagcagtgagacggtgttattgtgaaggtggcattcatctgcggagccaaaacccagccatcggggaagggtcagggcttctgtggaacttggaacgtgccaggaccacctgcaaaagccagggtgcgttgatcattctcagatcattgattggcctccacttgggtatgtgaattattcatgtcccagaagaccaaaaagtgctctggttctgagatgagtattttattcgtgttctgtttccgaaacacttagcaaagaaggtcacagtgatgtggagtcgccgcacccatctttgaagatagccagtgtccctggatgaggtgatgatttcccgtcccaaggactctgtgaagtttagagtacagtttgttggggtccaaaagacaccatctctaccccacccaaataaaaatgcactcatctctgtagaacatctgctgtcaaaggccagcctgtcgttagggcatggcttatgcttgacaaaccagtaacaactgtgggatggcgatggtgggatgtgtcgcaagcaattcactagacaatcttcacatgaatgtcggtagccagggtctctcccgagggatggctttagtcttgatgaatgtgaaccatgtcggaattgttaggtagaaacctgggctgggaggcctcggaccccaggctccatccctggcttccccagcctgcggccgcaagcaaaaccaagcgcgagatgcagctagcacccttcatatccatccccgttctcagcgggacaacaccatggacagccgttttcagagcctccagcatttgcacaccactactcaccctctctgctgctggcatgttggtagagtcatccctgtaatcaagaaatggcctgtggaatgttattgttcaacgttgtttacagctcttaaaacatggtgaggaatgcctaagtcttagtgaccaaacgtgaccttgaaagcagacatagcatgacagaccttcctagagtgtttggtcgggttcacagtgaccgagagtcaggtccagcacacacctgggaaagggatgctgccccaagggggaccaaaagggccggacgttacagggtgaaaccctctgacccctcgcgacaccgtaggacttgacttttgtttagtctttctaagaaatagatcatggagccaagtgaagtgcactttgtcaaatgtaagggtctgctttgttcttgttgcttttctgttttttaaccttttgttccgccatttaaaaaaagaaaaaaaaaaagcttatgtttcttgtcaaatgcagaaatgttccttccgccactcactgaagttttgcattctggcttgtgcagtttttattgtctgtgtcagacgtacagccagacatgttctctattggcatttttccgattctgttcagatgacagcgaccgccttttcattccccccgccacctgtactcaccctcacgctctttgaagaaaaaaaaaaaaatcaccttgtgtgttgtagctcatttgtttcaagagagaatcaacagatcatattcagtgtcttgaataaattgctctattttgatattaga

SEQ ID NO: 21262 - DNA, 4009 bp, Homo sapiens
  ENST00000389554
gtcgctaccaggagccaggtgattatcctaattaatgtctatctaattaaattactgtcagcagctaaccaatggcaggagccgtttcatcggctgcacaagcagcaagatcaaaagtgagccttttctgattgctgcatagtgtcaattggccaatctcttctcccagggaaaaaaaaaagtaaatcaaacctttgagaagcatttgctggttgaagtgctttctgtctagtgagggggtctgtggatttctagtttatgataaataggactttaaaaaccagggacgggagggcgagtgttcaggttctagagctatgcagctggagcactgcctttctccttctatcatgctctccaagaaatttctcaatgtgagcagcagctacccacattcaggcggatccgagcttgtcttgcacgatcatcccattatctcgaccactgacaacctggagagaagttcacctttgaaaaaaattaccagggggatgacgaatcagtcagatacagacaattttcctgactccaaggactcaccaggggacgtccagagaagtaaactctctcctgtcttggacggggtctctgagcttcgtcacagtttcgatggctctgctgcagatcgctacctcctctctcagtccagccagccacagtctgcggccactgctcccagtgccatgttcccgtaccccggccagcacggaccggcgcaccccgccttctccatcggcagccctagccgctacatggcccaccacccggtcatcaccaacggagcctacaacagcctcctgtccaactcctcgccgcagggataccccacggccggctacccctacccacagcagtacggccactcctaccaaggagctccgttctaccagttctcctccacccagccggggctggtgcccggcaaagcacaggtgtacctgtgcaacaggcccctttggctgaaatttcaccggcaccaaacggagatgatcatcaccaaacagggaaggcgcatgtttccttttttaagttttaacatttctggtctcgatcccacggctcattacaatatttttgtggatgtgattttggcggatcccaatcactggaggtttcaaggaggcaaatgggttccttgcggcaaagcggacaccaatgtgcaaggaaatcgggtctatatgcatccggattcccccaacactggggctcactggatgcgccaagaaatctcttttggaaaattaaaacttacgaacaacaaaggagcttcaaataacaatgggcagatggtggttttacagtccttgcacaagtaccagccccgcctgcatgtggtggaagtgaacgaggacggcacggaggacactagccagcccggccgcgtgcagacgttcactttccctgagactcagttcatcgccgtcaccgcctaccagaacacggatattacacaactgaaaatagatcacaacccttttgcaaaaggatttcgggataattatgacacgatctacaccggctgtgacatggaccgcctgaccccctcgcccaacgactcgccgcgctcgcagatcgtgcccggggcccgctacgccatggccggctctttcctgcaggaccagttcgtgagcaactacgccaaggcccgcttccacccgggcgcgggcgcgggccccgggccgggtacggaccgcagcgtgccgcacaccaacgggctgctgtcgccgcagcaggccgaggacccgggcgcgccctcgccgcaacgctggtttgtgacgccggccaacaaccggctggacttcgcggcctcggcctatgacacggccacggacttcgcgggcaacgcggccacgctgctctcttacgcggcggcgggcgtgaaggcgctgccgctgcaggctgcaggctgcactggccgcccgctcggctactacgccgacccgtcgggctggggcgcccgcagtcccccgcagtactgcggcaccaagtcgggctcggtgctgccctgctggcccaacagcgccgcggccgccgcgcgcatggccggcgccaatccctacctgggcgaggaggccgagggcctggccgccgagcgctcgccgctgccgcccggcgccgccgaggacgccaagcccaaggacctgtccgattccagctggatcgagacgccctcctcgatcaagtccatcgactccagcgactcggggatttacgagcaggccaagcggaggcggatctcgccggccgacacgcccgtgtccgagagttcgtccccgctcaagagcgaggtgctggcccagcgggactgcgagaagaactgcgccaaggacattagcggctactatggcttctactcgcacagctaggccgcccctgcccgcccggccccgccgcggcccggacccccagccagcccctcacagctcttccccagctccgcctccccacactcctccttgcgcacccactcattttatttgaccctcgatggccgtctgcagcgaataagtgcaggtctccgagcgtgattttaaccttttttgcacagcagtctctgcaattagctcaccgaccttcaactttgctgtaaaccttttggttttcctacttactcttcttctgtggagttatcctcctacaattcccctccccctcgtctttctcttacctcctacttctctttcttgtaatgaaactcttcacctttaggagacctgggcagtcctgtcaggcagcagcgattccgacccgccaagtctcggcctccacattaaccataggatgttgactctagaacctggacccacccagcgcgtcctttcttatccccgagtggatggatggatggatggatggtagggatgttaataattttagtggaacaaagcctgtgaaatgattgtacatagtgttaatttattgtaacgaatggctagtttttattctcgtcaaggcacaaaaccagttcatgcttaacctttttttcctttcctttctttgcttttctttctctcctctcatactttctcttctctctcttttaattttcttgtgagataatattctaagaggctctagaaacatgaaatactcagtagtgatgggtttcccacttctcctcaatccgttgcatgaaataattactatgtgccctaatgcacacaaatagctaaggagaatccacccaaacacctttaaaggataggtgtctgttcataggcaagtcgattaagtggcatgatgcctgcaaagcaaagtcaactggagttgtatgttccccccaccttctaaatagaatagctcgacatcagcaatattattttgccttatttgtttttccccaaagtgccaaatccattactggtctgtgcaggtgccaaatatgctgacaaactgtttctgaatatctttcagtaccccttcacctttatatgctgtaaatctttgtaatgaatactctattaatgatatagatgactgaattgttggtaactatagtgtagtctagtgaagatgaattgtgtgagttgtatattttactgcattttagttttgaaaatgacttccccaccacctagaaacagctgaaatttgacttccttgggagaacactagcattaatgcaagtaagactgattttcccctaagtcttgttatatttgataaggagcattaatccccctggaaatagattagtaggatttctaatgttgtgtagcaaacctatacttttttgtatttaaaaattaatgtgaaatatgcatcatacacaatattcaatctagattccagtccatggggggatttttcctaataggaattcagggtctaaacgtgtgtatattttggctcttctgtaaatctaatgttgtgatttttatatttgtttcgttttgtctgtgaactgaataatttatacaagaacacactccattgagaaacgttttgttttttgctcgtttgtatcgtctgtgtataacaagtaaaataaacctggtaaaaacgctaa

SEQ ID NO: 21263 - DNA, 7185 bp, Homo sapiens
  ENST00000463544
gggtctgtggatttctagtttatgataaataggactttaaaaaccagggacgggagggcgagtgttcaggttctagagctatgcagctggagcactgcctttctccttctatcatgctctccaagaaatttctcaatgtgagcagcagctacccacattcaggcggatccgagcttgtcttgcacgatcatcccattatctcgaccactgacaacctggagagaagttcacctttgaaaaaaattaccagggggatgacgaatcagtcagatacagacaattttcctgactccaaggactcaccaggggacgtccagagaagtaaactctctcctgtcttggacggggtctctgagcttcgtcacagtttcgatggctctgctgcagatcgctacctcctctctcagtccagccagccacagtctgcggccactgctcccagtgccatgttcccgtaccccggccagcacggaccggcgcaccccgccttctccatcggcagccctagccgctacatggcccaccacccggtcatcaccaacggagcctacaacagcctcctgtccaactcctcgccgcagggataccccacggccggctacccctacccacagcagtacggccactcctaccaaggagctccgttctaccagttctcctccacccagccggggctggtgcccggcaaagcacaggtgtacctgtgcaacaggcccctttggctgaaatttcaccggcaccaaacggagatgatcatcaccaaacagggaaggtaatactacatttttggctgccgctgctctaggcgcagccggggacaagtgcacctaggctgtgactgccgcggcagcgacgatttggggtcgggagcggagtggaaggcgccctagagttggctagttttggaaagggggaaagtggaagggataaccgccagggtgatgttggtgggggggaccccgttctaggaacatagtgggagagccagtcagtggccagaggaaggcaagaaaaaggaagagccctggccagcggctgggcgatgggagggacgcatcaacactggcatgcacggacaggtggagacgcaggtcgccaacctcgctctccacctgggcagtgataactgccaccttcccactccagctcacccgccgctctccctgatttgggttgcacttcttttcttctcccaccaccctttttctaatccagcaaatattcgcctatttgctgcaagtacaagttttgctttgctaactggcgccccgcttcttgcatttaatctttaacatttatgtttcttttttccttgttttctccccccaccccttaatttaaataggcgcatgtttccttttttaagttttaacatttctggtctcgatcccacggctcattacaatatttttgtggatgtgattttggcggatcccaatcactggaggtttcaaggaggcaaatgggttccttgcggcaaagcggacaccaatgtgcaaggaaatcgggtctatatgcatccggattcccccaacactggggctcactggatgcgccaagaaatctcttttggaaaattaaaacttacgaacaacaaaggagcttcaaataacaatgggcaggtcagtggctcaagcgctcgtgttttctctctctctcaccccttcctccctgacatccagttcgtcagtgtaaagcagcatatggaactggatacacgtttctttgcttcattaaaaagacttaaaaattgtatttccaccctccaaatttatattaaatctgtaaagttgttctcattggcaacacctccgtcggcccaattttggagtgcccgaccttcccaagtactaatactgattgattttgagaagaaaccccacaagatctgcaggttgtggaaatctttgttcctccttacaggaggactaggagaagggccctgaggatcgggcggtcggcttcccccttttttccggtgccccggcttatcttcgctcccagaggtgcgaaagccggtctgccccagccagccagccgccagccaggcgagtcccgcggtcagttagcctggaaggcgggctgcaggctgcctccgccggcccgggcgcgcagccgggcgcacacagccacgcgcacagcgaccgcgttaacacgccacccggcgctcccctttcttcccgccggacagatggtggttttacagtccttgcacaagtaccagccccgcctgcatgtggtggaagtgaacgaggacggcacggaggacactagccagcccggccgcgtgcagacgttcactttccctgagactcagttcatcgccgtcaccgcctaccagaacacggatgtaaggagacctaggggctgggggcgaggcgggcggcacagacatctctcccaccctctcacattctcccgccatgcaaggctagggtactagcagcgctaacatcagcaacagctggctccgctgtgcgttttaaggcttagggctcggggcctgcccacggcacctttcctaaataccaagccggtgggaaaaagctttctatttgttttcgtcgctggtcacccgggccacctttgaggtggccaggatttctaaagactcttcttttgggagttttaatttgggctttgaactagaacagattaaaatctactttaaaaaaaaattctctctttcctttagaaaacaagcagatttccccgtgcattttattcttggcaagctttggcatctaaaaaaaaatttctctctctctctctttttttcatctcagaactgatggctgaaatgaacaaacatcactgttctgggagatcaaaagaacatacacattcatatatgtgaaaactacaataaatcaaattactgagggctatggattgagctttctagcacttgaaccacttctgatttttcaagtttgcaaaaacagattttagtggctgatttgactactaggagtgataggggtttttgtgtttgtttcttttttttacttaaatgataatatcagaaattaaaacatgcttttaaatccaacctgattttaagatgcaacttgtggtttctcaggttgtgagtcagaagcgacaaacgttttaaaatataaaatacttaaaatagtcaacatttagtgatgaattcaagttctccttaaagatttttgtctgaacaagtgcattgtgtgtaacaagcatttttaaaatgtgagtttgaacaaatttagaaaacacaggagagctaattgaaagcagttctttggctataggtatcattaatttaaacatgttcctcataactttcatgatactttctctttttttcctttccactcaatccctcaaatttttcagttaggaaaaccttgctatttaataaattgtaggccttaagcccctgtaaaagtggcagatgatatattctcaaacacccagtcttcacgtataaaaggtgagataacattcattttttttctttgccagattacacaactgaaaatagatcacaacccttttgcaaaaggatttcgggataattatgacacgtaagtaactttgtatcttccttttcaaatagctgtggaattgggctttaggtcaaaggtgtattattatgtacaaggattttgaaagctggaatgtgtgaagacaaggttgttttagaggacttcttcttcttcgtctttcttctttcttcttcctcttctttttttttttttttttttttttggttggctccccttctctctggtgaccttgtggcttggtacttgcgtggtttttggtcagaggtttcctccacctaattttaactttcctgtggattacaaagttgttggtgggcctctggggctggctggctggctggggaggctgccctggttctcgggtgcgagtactgtatgtggcgctgcagatgctcagctcagattgtctatgtctgtctgaaacgggcaattctgcctaaaagtgcatgtggctcctctggcagttgttaacagtctccttagcatatgcgacctttatttacccatttccaagttttgtataatagcatttcctgtgcaagttggctacggactgaatacaaatgtgcacccaccacaggcgagttcatgagcagaaccgctgttatggtcattttaggctttcggaaagattcagacggtgttgctgtgtattatttataagcttcaaaagaaaaatatttcctctttgttttgtatctaggtgtgttttaattaaacatgctggtgcccttttctttaggcctcccttacctccctcctttctatcaaaaggctgttctctggggccaacagtaggtgtaaactgaatgctttctgggcttgttctgcaattctcactcagggtccatagtgcctaagagttcagatagtgtcataaatctaaatctggattgtggggttcccccacgttttctgaccataaaaggaaagggtacatacatcttaatttcgtggcttacattgagcgcctgagacagagctaaaaagttgaagctgcctttgactagcatagattaaatgtgtggagaaagagacaagtgactgcctctattccatctccaagcagataccaaccatccctcctgatattttctaataatttaaaagagagtcattgatattactgcctataaccaccatatatattcttcaaaagtactccaaaggaaccaagtctcatcaatatgattccccagaataaaaacttggctactctattcctcacaatctaaaaaggtgtgcccagcacagtggaaagtatatggctcaagagactagagatgttagaggagagtcctgtagattttgagattttaattctgttgtgaacatctgttcaaaagcattttattttgcacaaatcaattcagtaatcccaagtgggtgggacctggataggcatctaaactgtatcttttgcggactgcttttttctttttaaaatattgtggtgataaacagagaagatatttgcaccttgctagttatgttcccttcctgcctccctctacttctcttatttgaaactggaattcaatttcagaagggaaattttgtgcactaaacagaacggacctgagcagccacagcaaaactctcacatgcccctcctcctctggctgccttctgttggaaaagccactcctctttgatcttaaatcactttaaatctttcataaaagcttctttatctatacacacacacacacacacacacacacacaaacctgagatttttaggggacagagaagagttgagtggttcatgacactcttcctttccccttttacgttggttacttggacatggctcaattttggagaaagagggagaagtataagggttcatggggtactaggagcttgcttggccactcaccagggaatctcctccccaaaggattaaggtctgacaagactgaggctctccttcaaaacagtctgttgactaaagattaaaacatttatgtgtgagctaaataaaaagggaggcatgtgtgcatgtgtatgagaaaacacttctaccaatcttcatccaacccttggtttcctctcaattctaatgggattttctaggcccagggcctaaagttaatctttgattattttatctaaggtaattcccaacaacacaatcactgtcgctggttgggcaagttatttaacttccttttgcctcaatttcctcatcggtaaagtgggataataaaagttacctagctcacagtgcctggcatatagtcgagctccgtaaaggttagctattattagtggtccattgcatggagtaggctgataagtacactgtaggtttgccccgaagtttctgcgggtaacggaccaaaagctaggaaaagaaggtcagagtaaagaacaccttttctcttaagagaatatttctgattgatgactactgtttcagagtagtaattcttgtttgtattagtagaggtgggagtgaaagtttcacacaggggaaacaatagacactaagtactttggaggcttccagcagcaaacctcgggttccagaacacgggtgaaggccagtctttcatgattactgcgtgcgcggctttttcctaggggtttctgaaacaatctagaaaaaggagagatatcacctgaacaatcaaatggacacaggaggtcttaaaagggtggaggagtgagtaccttgcttagaaatttcactcataaactgaccgcagaggaaaggcccactgggcaaagagcatcttactccctaggtaaatctgccttaatgtgcacacatatgttggagaagtgggatgaaagtccttgcttgtgcccctctctcagtaccccagtacacttgacgagagagagcaagagaagagggaagtcgttcccttgatggtctgtatcttgctcaggtccctgcatagacagattggctcctctataattccgtgatttattttgggaatgatagaggtctgtggcctcttgtattctccaggaaatcctggactgcaagtttgtagatggagggtgtgggggtgggcgaaaagtggaggtggccttcccttctgcccccacccccaccccaagggacctccgcgccacccctcggctctctctctctctctccctaccccgcaggatctacaccggctgtgacatggaccgcctgaccccctcgcccaacgactcgccgcgctcgcagatcgtgcccggggcccgctacgccatggccggctctttcctgcaggaccagttcgtgagcaactacgccaaggcccgcttccacccgggcgcgggcgcgggccccgggccgggtacggaccgcagcgtgccgcacaccaacgggctgctgtcgccgcagcaggccgaggacccgggcgcgccctcgccgcaacgctggtttgtgacgccggccaacaaccggctggacttcgcggcctcggcctatgacacggccacggacttcgcgggcaacgcggccacgctgctctcttacgcggcggcgggcgtgaaggcgctgccgctgcaggctgcaggctgcactggccgcccgctcggctactacgccgacccgtcgggctggggcgcccgcagtcccccgcagtactgcggcaccaagtcgggctcggtgctgccctgctggcccaacagcgcc

SEQ ID NO: 21264 - DNA, 698 bp, Homo sapiens
  ENST00000411412
tttcaaggaggcaaatgggttccttgcggcaaagcggacaccaatgtgcaaggaaatcgggtctatatgcatccggattcccccaacactggggctcactggatgcgccaagaaatctcttttggaaaattaaaacttacgaacaacaaaggagcttcaaataacaatgggcagatggtggttttacagtccttgcacaagtaccagccccgcctgcatgtggtggaagtgaacgaggacggcacggaggacactagccagcccggccgcgtgcagacgttcactttccctgagactcagttcatcgccgtcaccgcctaccagaacacggatattacacaactgaaaatagatcacaacccttttgcaaaaggatttcgggataattatgacacgatctacaccggctgtgacatggaccgcctgaccccctcgcccaacgactcgccgcgctcgcagatcgtgcccggggcccgctacgccatggccggctctttcctgcaggaccagttccaggccgaggacccgggcgcgccctcgccgcaacgctggtttgtgacgccggccaacaaccggctggacttcgcggcctcggcctatgacacggccacggacttcgcgggcaacgcggccacgctgctctcttacgcggcggcgggcgtgaaggcgctgccgctgcaggctgcaggctgcactgg

SEQ ID NO: 21265 - DNA, 1454 bp, Homo sapiens
  ENST00000410035
tttgtggactggctcgagcgacttttaaaacgatcggccaatgacttctaaaaggaaacgagggggacagggggacagactgagctgcgagaagggggaggattatgcaaaagctattttaatcacccccagttaataggaagaaagaatggcctaaaaaagccccagttaatgggcttcatggtggagtaaggaaatcgggtctatatgcatccggattcccccaacactggggctcactggatgcgccaagaaatctcttttggaaaattaaaacttacgaacaacaaaggagcttcaaataacaatgggcagatggtggttttacagtccttgcacaagtaccagccccgcctgcatgtggtggaagtgaacgaggacggcacggaggacactagccagcccggccgcgtgcagacgttcactttccctgagactcagttcatcgccgtcaccgcctaccagaacacggatattacacaactgaaaatagatcacaacccttttgcaaaaggatttcgggataattatgacacgatctacaccggctgtgacatggaccgcctgaccccctcgcccaacgactcgccgcgctcgcagatcgtgcccggggcccgctacgccatggccggctctttcctgcaggaccagttcgtgagcaactacgccaaggcccgcttccacccgggcgcgggcgcgggccccgggccgggtacggaccgcagcgtgccgcacaccaacgggctgctgtcgccgcagcaggccgaggacccgggcgcgccctcgccgcaacgctggtttgtgacgccggccaacaaccggctggacttcgcggcctcggcctatgacacggccacggacttcgcgggcaacgcggccacgctgctctcttacgcggcggcgggcgtgaaggcgctgccgctgcaggctgcaggctgcactggccgcccgctcggctactacgccgacccgtcgggctggggcgcccgcagtcccccgcagtactgcggcaccaagtcgggctcggtgctgccctgctggcccaacagcgccgcggccgccgcgcgcatggccggcgccaatccctacctgggcgaggaggccgagggcctggccgccgagcgctcgccgctgccgcccggcgccgccgaggacgccaagcccaaggacctgtccgattccagctggatcgagacgccctcctcgatcaagtccatcgactccagcgactcggggatttacgagcaggccaagcggaggcggatctcgccggccgacacgcccgtgtccgagagttcgtccccgctcaagagcgaggtgctggcccagcgggactgcgagaagaactgcgccaaggacattagcggctactatggcttctactcgcacagctaggccgcccctgcccgcccggccccgccgcggcccggacccccagccagcccctcacagct

SEQ ID NO: 21266 - DNA, 461 bp, Homo sapiens
  ENST00000477804
acggcacctttcctaaataccaagccggtgggaaaaagctttctatttgttttcgtcgctggtcacccgggccacctttgagattacacaactgaaaatagatcacaacccttttgcaaaaggatttcgggataattatgacacgatctacaccggctgtgacatggaccgcctgaccccctcgcccaacgactcgccgcgctcgcagatcgtgcccggggcccgctacgccatggccggctctttcctgcaggaccagttcgtgagcaactacgccaaggcccgcttccacccgggcgcgggcgcgggccccgggccgggtacggaccgcagcgtgccgcacaccaacgggctgctgtcgccgcagcaggccgaggacccgggcgcgccctcgccgcaacgctggtttgtgacgccggccaacaaccggctggacttcgcggcctcggcctatgacacgg

SEQ ID NO: 21267 - DNA, 558 bp, Homo sapiens
  ENST00000489530
atcactgttctgggagatcaaaagaacatacacattcatatatgtgaaaactacaataaatcaaattactgagggctatggattgagctttctagcacttgaaccacttctgatttttcaagtttgcaaaaacagattttagtggctgatttgactactaggagtgataggggtttttgtgtttgtttcttttttttacttaaatgataatatcagaaattaaaacatgcttttaaatccaacctgattttaagatgcaacttgtggtttctcaggttgtgagtcagaagcgacaaacgttttaaaatataaaatacttaaaatagtcaacatttagtgatgaattcaagttctccttaaagatttttgtctgaacaagtgcattgtgtgtaacaagcatttttaaaatattacacaactgaaaatagatcacaacccttttgcaaaaggatttcgggataattatgacacgatctacaccggctgtgacatggaccgcctgaccccctcgcccaacgactcgccgcgctcgcagatcgtgcccggggcccgctacgc

SEQ ID NO: 21268 - DNA, 703 bp, Homo sapiens
  ENST00000493340
attgttctgcctggctctgacatggacttttcatctctctcctctctccccacctagccccgtgcattccgattccacagcccccccaaaatcggaggctcgcggagaataaaggagcgtggggtgggcgcggaaagaaatgggaaggggcgcggggcggagagcgaagtggaaaggaggtgctccgaaagctctttattttccatgtgtgagcctgtgcctgtggtttatctctggaggatgtgcctgagggaggagacatatactgcctggactgcctggctgatgtgagctagtttgtctggttgagttggatgtttaaatagaaggcagaacaacaacagggtcttgctctgttgcccaggctggagtgcacttgcagtagcataatcacaattcactgcagcctcaacctcccaggctcaatcattcttcctgcctcagcccccaaagtagctgggactacaggcatgcaccaccatggctggctaagttttaaaacttttttgtagagacatggtctctctgtgttgcccaggctggtctaggactcctgggctcaagcaatcctcccacctcagcctcccaaagtgctgagattacaggtgcaaactatctcacccagcctttaatctttttattagtgagatatctgacccaacggctaggatctgatggtctttttagtatggcctcaaatcac

SEQ ID NO: 21269 - DNA, 459 bp, Homo sapiens
  ENST00000462053
ggctcgcggagaataaaggagcgtggggtgggcgcggaaagaaatgggaaggggcgcggggcggagagcgaagtggaaaggaggtgctccgaaaggagacatatactgcctggactgcctggctgatgtgagctagtttgtctggttgagttggatgtttaaatagaaggcagaacaacaacagaagctttgaggaagagccataactacctggagcagaatgattatttggagccacagaaaatcattttagggagcagtgggtccaggttcagtgttgtgtgttcaactcggaaagaacacagttgggtggctgaccgggttacttctcccctgtggctctgcttgcattggtcattgaggtcaggcaggggtttggccacagtgttagccattggccctgcattgatcctcacatagtaacatcttgtttggttattaaagtgactgaattgttgg

SEQ ID NO: 21270 - DNA, 241 bp, Homo sapiens
  ENST00000473948
aggccgaaccgaagggctcacagaacatttcctgcctgttgctcacactctgttgtccacagcatacccgcaccctagatggctgactcttgtcttctgtttgtgaaactgcacaacatcacaatatcttcaaggccacaggatagagataaccctctttttggtgtatgcatttagctctttattttccatgtgtgagcctgtgcctgtggtttatctctggaggatgtgcctgagggag

SEQ ID NO: 21271 - DNA, 2080 bp, Homo sapiens
  ENST00000425687
gagggccggcctggacccggcgggcgcacggctccgagcccagcgcagccgagccggtctgcagaggggcccccagaactttgtgtgtgtgtgtgcacgcgcgcgcgtgtgtgcccaggtgcgagggttcgcgcgtgtgctggcggggagggaaccgacccgaaagagagccccacgctggcaaagtggctcgcccatctcacagccggttggcgctcgcggagctctttattttccatgtgtgagcctgtgcctgtggtttatctctggaggatgtgcctgagggaggagacatatactgcctggactgcctggctgatgtgagctagtttgtctggttgagttggatgtttaaatagaaggcagaacaacaacaggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagatggttcccctcatcagccaagcctgcgaccttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggttcacggctgaggcccggcagcagcaccggcccttcacgtacctgcccttcggggccggcccacggagctgcctcggggtgcgtctagggctgcttgaggtcaagttgacactgctccacgtgctgcacaagttccggttccaagcctgccctgagacccaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttggttttgacattg

SEQ ID NO: 21272 - DNA, 582 bp, Homo sapiens
  ENST00000474763
cggcctggacccggcgggcgcacggctccgagcccagcgcagccgagccggtctgcagaggggcccccagaactttgtgtgtgtgtgtgcacgcgcgcgcgtgtgtgcccaggtgcgagggttcgcgcgtgtgctggcggggagggaaccgacccgaaagagagccccacgctggcaaagtggctcgcccatctcacagccggttggcgctcgcggaggagacatatactgcctggactgcctggctgatgtgagctagtttgtctggttgagttggatgtttaaatagaaggcagaacaacaacagaagctttgaggaagagccataactacctggagcagaatgattatttggagccacagaaaatcattttagggagcagtgggtccaggttcagtgttgtgtgttcaactcggaaagaacacagttgggtggctgaccgggttacttctcccctgtggctctgcttgcattggtcattgaggtcaggcaggggtttggccacagtgttagccattggccctgcattgatcctcacatagtaacatcttgtttggttattaaagtgactgaattgttgg

SEQ ID NO: 21273 - DNA, 728 bp, Homo sapiens
  ENST00000481440
gcctggacccggcgggcgcacggctccgagcccagcgcagccgagccggtctgcagaggggcccccagaactttgtgtgtgtgtgtgcacgcgcgcgcgtgtgtgcccaggtgcgagggttcgcgcgtgtgctggcggggagggaaccgacccgaaagagagccccacgctggcaaagtggctcgcccatctcacagccggttggcgctcgcggaggctcacagaacatttcctgcctgttgctcacactctgttgtccacagcatacccgcaccctagatggctgactcttgtcttctgtctctttattttccatgtgtgagcctgtgcctgtggtttatctctggaggatgtgcctgagggaggagacatatactgcctggactgcctggctgatgtgagctagtttgtctggttgagttggatgtttaaatagaaggcagaacaacaacagaagctttgaggaagagccataactacctggagcagaatgattatttggagccacagaaaatcattttagggagcagtgggtccaggttcagtgttgtgtgttcaactcggaaagaacacagttgggtggctgaccgggttacttctcccctgtggctctgcttgcattggtcattgaggtcaggcaggggtttggccacagtgttagccattggccctgcattgatcctcacatagtaacatcttgtttggttattaaagtgactgaattgttg

SEQ ID NO: 21274 - DNA, 752 bp, Homo sapiens
  ENST00000438104
gtgtgcacgcgcgcgcgtgtgtgcccaggtgcgagggttcgcgcgtgtgctggcggggagggaaccgacccgaaagagagccccacgctggcaaagtggctcgcccatctcacagccggttggcgctcgcggaggagacatatactgcctggactgcctggctgatgtgagctagtttgtctggttgagttggatgtttaaatagaaggcagaacaacaacagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgag

SEQ ID NO: 21275 - DNA, 2185 bp, Homo sapiens
  ENST00000336425
aaccgacccgaaagagagccccacgctggcaaagtggctcgcccatctcacagccggttggcgctcgcggaggctcacagaacatttcctgcctgttgctcacactctgttgtccacagcatacccgcaccctagatggctgactcttgtcttctgtctctttattttccatgtgtgagcctgtgcctgtggtttatctctggaggatgtgcctgagggaggagacatatactgcctggactgcctggctgatgtgagctagtttgtctggttgagttggatgtttaaatagaaggcagaacaacaacagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagatggttcccctcatcagccaagcctgcgaccttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggttcacggctgaggcccggcagcagcaccggcccttcacgtacctgcccttcggggccggcccacggagctgcctcggggtgcgtctagggctgcttgaggtcaagttgacactgctccacgtgctgcacaagttccggttccaagcctgccctgagacccaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttggttttgacattgccaa

SEQ ID NO: 21276 - DNA, 1963 bp, Homo sapiens
  ENST00000448866
atagggagacactctgagaaagagcacattgtgggggcccactccatgtgatgtttgcttggttgcctgttcccttttctacctgcagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagatggttcccctcatcagccaagcctgcgaccttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggttcacggctgaggcccggcagcagcaccggcccttcacgtacctgcccttcggggccggcccacggagctgcctcggggtgcgtctagggctgcttgaggtcaagttgacactgctccacgtgctgcacaagttccggttccaagcctgccctgagacccaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttggttttgacattgccaa

SEQ ID NO: 21277 - DNA, 1967 bp, Homo sapiens
  ENST00000422328
gcacattgtgggggcccactccatgtgatgtttgcttggttgcctgttcccttttctacctgcagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtaagaaggaaactcaacgtttctattatgtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagatggttcccctcatcagccaagcctgcgaccttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggttcacggctgaggcccggcagcagcaccggcccttcacgtacctgcccttcggggccggcccacggagctgcctcggggtgcgtctagggctgcttgaggtcaagttgacactgctccacgtgctgcacaagttccggttccaagcctgccctgagacccaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttggttttgacattgcc

SEQ ID NO: 21278 - DNA, 633 bp, Homo sapiens
  ENST00000492560
acattgtgggggcccactccatgtgatgtttgcttggttgcctgttcccttttctacctgcagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtaagaaggaaactcaacgtttctattatgtacgatattttctattatgtacgatattttgattttcacgtgttgaactgatatagaagaaatgccaagattaggaatgttgtatgtgtttctatttttcaaagggcccacaaagagggagtcctgcagtacagacaaggcttctagagaagaccctggggttgcccacggggggactctgctggcctgaaagagtaccactttccagcctttgcagccttgctg

SEQ ID NO: 21279 - DNA, 1435 bp, Homo sapiens
  ENST00000455353
gtgggggcccactccatgtgatgtttgcttggttgcctgttcccttttctacctgcagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatgccccagagcatcatgcccaactccagacatcacgtggcctctagagggatgtggcctggagggaggcggctggcctgctacctccatcccttcaggatggccgaaggaattgcagaagtttaactgcttctctgctgcctctagattctctttcccaaacactgcattgctatctcctcgctcaaagtcccctggaagccgtctgtcaagaaactgattctgattattaaatgcagctgtagcttgttgctccatcagcctcagcaaggagtgctgattaaagaagttggagaagccaataagtcaaagtgcacggaccaccaagccacatcctggcaagcagtaaaggtactcccaggagcctgtcatagcacttgagactgtctgagcccctaagccatgagacggcacttgccaactggtgtctccatatttcctcccatgataccaggacatgtgaccctgagagctgacctagaagaggtcaatgatttggcctgctaggggcagacatactcaatgcacatgtccaagcaaggaggacacaataatattgccctcagctttgatcaatttatcctccaagccatttgtctgccgtttctaatttctttcaccatcccctcacccacccctccacgcagactaggtccagtgccccaaactccagagtagagttccaattttcgtcctcttccactcagcacaggattaagccttcaggactaagttcaagttccctagacgatatttaagggcccttgtgtcttagatccattgtgtgtgctccaccctgtctctcactgctccccaatacaaatcgtcactccagcctctccctgctcaccctcacctgctctggagagacctgacctctgccttgctcacgctgacactgcctcagaattgaaggcagtgtaacagtggggctcatattgattatgacgtgagcttgagcacatatc

SEQ ID NO: 21280 - DNA, 2057 bp, Homo sapiens
  ENST00000458722
gtgggggcccactccatgtgatgtttgcttggttgcctgttcccttttctacctgcagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagcttggccttttaatcatgcaagagagaataaaaggtcacatgggtggccagcaggctccacaaagaattccacccacccgtttgtcgaagccgagtggtatctatgtgaatctccattatgccactctacctttctgtatggttcccctcatcagccaagcctgcgaccttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggttcacggctgaggcccggcagcagcaccggcccttcacgtacctgcccttcggggccggcccacggagctgcctcggggtgcgtctagggctgcttgaggtcaagttgacactgctccacgtgctgcacaagttccggttccaagcctgccctgagacccaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttggt

SEQ ID NO: 21281 - DNA, 1792 bp, Homo sapiens
  ENST00000411653
actccatgtgatgtttgcttggttgcctgttcccttttctacctgcagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagatggttcccctcatcagccaagcctgcgaccttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttggttttgacattgccaatggggtttgaaccagtgctctctctaaatgaa

SEQ ID NO: 21282 - DNA, 623 bp, Homo sapiens
  ENST00000476637
gtgatgtttgcttggttgcctgttcccttttctacctgcagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggcgtcgggtttggagttcaagtcggtagccgacagcgttctgtttttacgtgacaaaagatgggaagaggtcagaggtgccctgatgtctgctttcagtcctgaaaagctgaacgagatggttcccctcatcagccaagcctgcgaccttctcctggctcatttaaaacgctatgcggaatctggggacgcatttgacatccagaggtaaggctgctgcattacagatgagaaatcgagtttttgaatcactgcttcttgtaactgt

SEQ ID NO: 21283 - DNA, 1773 bp, Homo sapiens
  ENST00000462275
gatgtttgcttggttgcctgttcccttttctacctgcagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagatggttcccctcatcagccaagcctgcgaccttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggtccaaactgaatccagagatttagcatttcagcagccctgcatgcaaggaacaaggcaatttcaaatgattgtcttccattcattcaagccaggacatgggatacaggattgtatttcaggtctgcactggaaagtaacggaacatcatttcctttttaaaaaacgggcatctatgccaaaacaacagcttcagctgatgtctccatgaatctaaattcacgtgatccactggttgacctgggtccccgccttccaccacctggctttggttcattgtctcctttcatttctgggctctgtgattggaaacatctgagcaggcggcccacactctggtcctcatcagaaccagtcaatatcctgtgtgtgtgatctggcaagggaagggctggcccggcaccagttgtgttttcacctttcatggctccaactgagt

SEQ ID NO: 21284 - DNA, 565 bp, Homo sapiens
  ENST00000414041
ctacctgcagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtggtctgtagtgcagtggcttgatcttggatcactgcaacctccaccttccaggttcaagcaattctcctgcctcagcctcctgagtagctggcactacaggtactatcttggtcgtcggatgtttattgttatttctgagccagacatgatcaagcaggtgttggttgagaacttcagtaactttaccaacagaatggcgtcgggtttggagttcaagtcggtagccgacagcgttctgttt

SEQ ID NO: 21285 - DNA, 1435 bp, Homo sapiens
  ENST00000469630
gggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacgtgagtacaagttggatccagttacccatgggatatccataggacaattgattttgtgtttgtgggagtgaaacttatttttaatgacttgctaatatcacattctaagcttataagatgaaatagggtcattgcttggcttctcctgctctccgggttagcaagcgaaatgaaatgttgagaacaataaccacaacaaaaagacaaattgtgtgtgcaccttcactgtctggggtagtccatgaagccaggcctggctcgaggaagctgtggaagcccaggaaggtgtcaggcccaaagggcagggatggggaaggagtcatggcttcccaatatctgacttggagctgccacacggagggaggcaggtgtgagccagaaaggagagccaagatagaaggcaggagtggacaaaaggacaggccaagctgaagctggactgaagactggaagctgaggaggaggctcacaaatggaataagggaagatggggcccgtcagcgcccaggccagcttcagggcattttcttctagatgaggcccctcttgatcgtttatagcagatataacgagggtgctgagcaaggctactttatcacctcattttttcttctagatgcttgtgtgtgtataactttgactcatgagttgtcaaagagattcatttttaaaatctgtactttaaaaggaagaccaccacagtggaatcctttctgttacattctgatatgattgctattacattcaccattttgaaaggtggtctgttctgttactggaaccattaaaaaatgtttcatacaatgaactgaaaacca

SEQ ID NO: 21286 - DNA, 502 bp, Homo sapiens
  ENST00000494876
cctggtttattatcacccccttttcaatgccacttttgtttttctctttcaagtatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacgtg

SEQ ID NO: 21287 - DNA, 2505 bp, Homo sapiens
  ENST00000416849
gagggccggcctggacccggcgggcgcacggctccgagcccagcgcagccgagccggtctgcagaggggcccccagaactttgtgtgtgtgtgtgcacgcgcgcgcgtgtgtgcccaggtgcgagggttcgcgcgtgtgctggcggggagggaaccgacccgaaagagagccccacgctggcaaagtggctcgcccatctcacagccggttggcgctcgcggaggctcacagaacatttcctgcctgttgctcacactctgttgtccacagcatacccgcaccctagatggctgactcttgtcttctgtctctttattttccatgtgtgagcctgtgcctgtggtttatctctggaggatgtgcctgagggaggagacatatactgcctggactgcctggctgatgtgagctagtttgtctggttgagttggatgtttaaatagaaggcagaacaacaacagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagcttggccttttaatcatgcaagagagaataaaaggtcacatgggtggccagcaggctccacaaagaattccacccacccgtttgtcgaagccgagtggtatctatgtgaatctccattatgccactctacctttctgtatggttcccctcatcagccaagcctgcgaccttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggttcacggctgaggcccggcagcagcaccggcccttcacgtacctgcccttcggggccggcccacggagctgcctcggggtgcgtctagggctgcttgaggtcaagttgacactgctccacgtgctgcacaagttccggttccaagcctgccctgagacccaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttggttttgacattgccaatggggtttgaaccagtgctctctctaaatg

SEQ ID NO: 21288 - DNA, 855 bp, Homo sapiens
  ENST00000476749
agcggtcgggtccgggcgcccgcgcagaatcagctgtctgagctgcccaggcggcgggggagcagcgagcgggcttcagcgagccgcaggaggcacaggcctgtcctgggtccccgcaggtcagtgtgaaggcgtgcgctgccggcggaccctgggacaggggtggagggggctggcagtaggattggggagggggcggagaagggatccggtagattggggaggagggggatgcggagtcgcgggggcgggggcagtggagggagaacccccgaagcaagcctggctcgccttctcgacgcccccttgcactgagtcctccatccattttagtgctggaaatggggggtgggggtagcgaccccgcagtgcgacagtgaaacgtagacatattctggaaataaccccttctcacaatctacacccatggaaacacttgatctccgcaaaaatgaggtggcgctggggcaggttgcctccggggaagggggacacagagacaaacgcagtttggaaagcatcctggtttggtgcccgaggcctggaaagaaatggcggctggggtgcgggggaggtaggggaggaaaacggtgggtaagcagggcctggactcaggaaagggaaccgagtccctgtgagcccgctaagcgcgcagcccctgcccctgtctcctgtctgtccgcaggtctgcgcgtctgttgttcccagcgctctgagaggcctgaaaaggaagagcaacctgtccagaatccccgcaggaaaggaaaaggaggggaaatctcgacatggaaaaactcttcaatgaaaatgaaggaatgccttcgaatcaaggaaagatagacaatgaagaacagc

SEQ ID NO: 21289 - DNA, 1080 bp, Homo sapiens
  ENST00000329035
gcgcccgcgcagaatcagctgtctgagctgcccaggcggcgggggagcagcgagcgggcttcagcgagccgcaggaggcacaggcctgtcctgggtccccgcaggtctgcgcgtctgttgttcccagcgctctgagaggcctgaaaaggaagagcaacctgtccagaatccccgcaggaaaaggaggggaaatctcgacatggaaaaactcttcaatgaaaatgaaggaatgccttcgaatcaaggaaagatagacaatgaagaacagccaccgcacgagggaaagccagaagtagcttgtattctggaagacaagaagttagaaaacgagggaaacacagaaaacacgggcaagagagttgaggaaccgttaaaggataaagaaaagccagagagtgcgggaaaggcaaaaggagaaggaaagtcagagaggaagggaaagtcagagatgcagggaggatcaaagacagagggaaagccagagagagggggaagggcagagggtgaaggagagccagacagtgaaagagagccagagagtgagggagagccagaaagtgaaacaagggctgcaggaaagcgcccagctgaggatgatatacccaggaaagccaaaagaaaaaccaacaaggggctggctcagtacctcaagcaatataaggaagccatacatgatatgaatttcagcaatgaggacatgataagagaatttgacaacatggctagggtggaggataaaaggagaaaaagcaaacagaaattgggggcgtttttgtggatgcaaagaaatttacaggaccccttctatcctaggggtccaagggaattcaggggtggctgcagggccccacgaagggacactgaagacattccttatgtgtagtgtccctggcaggcatttgtcaggccatatgttttaaccttatggtaatactttgctttagtcgttcctcctgctaccagtagcgttttgacccacctgccagtgtttgcttgctctatgtttcagtagcagattttcacacatgtgcattgcagagacgtcatgattcgtggaaaaataaagcagcttataatatc

SEQ ID NO: 21290 - DNA, 1100 bp, Homo sapiens
  ENST00000372780
agcggtcgggtccgggcgcccgcgcagaatcagctgtctgagctgcccaggcggcgggggagcagcgagcgggcttcagcgagccgcaggaggcacaggcctgtcctgggtccccgcaggtctgcgcgtctgttgttcccagcgctctgagaggcctgaaaaggaagagcaacctgtccagaatccccgcaggaaaggaaaaggaggggaaatctcgacatggaaaaactcttcaatgaaaatgaaggaatgccttcgaatcaaggaaagatagacaatgaagaacagccaccgcacgagggaaagccagaagtagcttgtattctggaagacaagaagttagaaaacgagggaaacacagaaaacacgggcaagagagttgaggaaccgttaaaggataaagaaaagccagagagtgcgggaaaggcaaaaggagaaggaaagtcagagaggaagggaaagtcagagatgcagggaggatcaaagacagagggaaagccagagagagggggaagggcagagggtgaaggagagccagacagtgaaagagagccagagagtgagggagagccagaaagtgaaacaagggctgcaggaaagcgcccagctgaggatgatatacccaggaaagccaaaagaaaaaccaacaaggggctggctcagtacctcaagcaatataaggaagccatacatgatatgaatttcagcaatgaggacatgataagagaatttgacaacatggctagggtggaggataaaaggagaaaaagcaaacagaaattgggggcgtttttgtggatgcaaagaaatttacaggaccccttctatcctaggggtccaagggaattcaggggtggctgcagggccccacgaagggacactgaagacattccttatgtgtagtgtccctggcaggcatttgtcaggccatatgttttaaccttatggtaatactttgctttagtcgttcctcctgctaccagtagcgttttgacccacctgccagtgtttgcttgctctatgtttcagtagcagattttcacacatgtgcattgcagagacgtcatgattcgtggaaaaataaagcagcttataatatc

SEQ ID NO: 21291 - DNA, 1168 bp, Homo sapiens
  ENST00000372680
agtgggctggctcctgacgcactttctgcgggtgggaggggaactagggacccgagcccactggtgacgtttttctcacgtgatctgaagccgacgtgtgcagaagtccctctcctccaggtaccagatccctgtttccgtggaggaaggcagacttcagactgaaggacagagaaggcaactgccctacagccctgcaggtcttcaagtctgtggttgtgggcactaacccagacaagaaaaggaaagacctgcagtatcggtgcaggaaaggcaaagaagggaacatctcaacatggaaaagctctacaaagaaaatgaaggaaagccagagaatgaaagaaacctagaaagtgagggaaagccagaggatgagggaagtacagaagatgaaggaaagtcagacgaggaagaaaagccggacatggaggggaagacagaatgcgagggaaagcgagaggatgagggagagccaggtgatgagggacaactggaagatgagggaaaccaggaaaagcagggcaagtctgaaggtgaggacaagccacaaagtgagggcaagccagcctcccaggccaagccagagagccagccgcgggccgccgaaaagcgcccggctgaagattatgtgccccggaaagcaaaaagaaaaaccgacagggggacggacgattcccccaaggactctcaggaggacttacaagaaaggcatctgagcagtgaggagatgatgagagaatgtggagatgtgtcaagggctcaggaggagctaaggaaaaaacagaaaatgggtggttttcattggatgcaaagagatgtacaggatccattcgccccaaggggccaacggggtgtgaggggagtgaggggcggaggtaggggccagaaagacttagaagatgtcccatatgtttaatgtctttggcctttaattctgatttctctgatgggaatattgccagtcctgcttttcctggcaggcatttgccggcctatgtgctttaaccttaagctgatactttcctttaggtgtcactcttgttaccagcagacttttgacccaactacagtgctctgtcttttagtagaggattttcacccatgtgcatggaataaatgttcatggtacattgtaaaataacaataaaaaagagttttcagaaccatg

SEQ ID NO: 21292 - DNA, 1106 bp, Homo sapiens
  ENST00000372774
gtgggcaccagcccccgcgcccgcccgcccgcccagcggtccggtccaggcgcccgcgcagaatcagctgtctgagctgcccaggcggcgggggagcagcgagcgggcttcagcgagccgcaggaggcacaggcctgtcctgggtccccgcaggtctgcgcgtctgttgttcccagcgctcttggaggcctgcaaaggaagagcaacctgtccagactccccgcaggacaggaaaaagagaaatctcgacatggaaaaaccctacaataaaaatgaaggaaacctggaaaacgagggaaagccagaagatgaagtagagcctgatgatgaaggaaagtcagacgaggaagaaaagccagacgcggaggggaagacagaatgcgagggaaagcgaaaggctgagggagagccaggtgatgagggacaactggaagataagggaagccaggaaaagcagggcaagtccgaaggtgagggcaagccacaaggcgagggcaagccagcctcccaggcaaagccagagggccagccgcgggccgccgaaaagcgcccggctggagattatgtgccccggaaagcaaaaagaaaaacagacagggggacggacgattcccccaaggactctcaggaggacttacaggaaaggcatctgagcagtgaggagatgatgagagaatgtggagatgtgtcaagggctcaggaggagctaaggaaaaaacagaaaatgggtggttttcattggatgcaaagagatgtacaggatccattcgcccaaggggacaacggggtgtcaggggagtgaggggtggaggtaggggccaaagaggcttacacgatatcccatacctttaatgcctttggccttccattctgacttctctgatgagattattgtcaaccctgctttccctggtagatatttgccaggcccaatgctttaaccttaagctgatatttttgctttagatgtcaatctcgttaccagcagccttttgacccaactacagcgctctatattttagtagaggattttcacccatgtgcatggaaaagatgttcatgacacattgtaaaaaataaataaataaagaacagtttgcagaacc

SEQ ID NO: 21293 - DNA, 983 bp, Homo sapiens
  ENST00000372773
gggagagacaacttgaggactgaggagagaggaggcccaggacagaaccccaggaacaccgccactcaaggtggcagctcagcttcctggcaggcaccactaccccccgggctctggagtcaggcagagccggtattgaaagtgggctgtggagttctggggctaagcgctcttggcaaagtcgggtaccctctctgatcagctgtcacacctggcgataatgggcatcagagagagatgccttgcgaggatgctgtgagctgcgtcaggtctgcgcgtctgttgttcccagcgctcttggaggcctgcaaaggaagagcaacctgtccagactccccgcaggaaaaagagaaatctcgacatggaaaaaccctacaataaaaatgaaggaaacctggaaaacgagggaaagccagaagatgaagtagagcctgatgatgaaggaaagtcagacgaggaagaaaagccagacgcggaggggaagacagaatgcgagggaaagcgaaaggctgagggagagccaggtgatgagggacaactggaagataagggaagccaggaaaagcagggcaagtccgaaggtgagggcaagccacaaggcgagggcaagccagcctcccaggcaaagccagagggccagccgcgggccgccgaaaagcgcccggctggagattatgtgccccggaaagcaaaaagaaaaacagacagggggacggacgattcccccaaggactctcaggaggacttacaggaaaggcatctgagcagtgaggagatgatgagagaatgtggagatgtgtcaagggctcaggaggagctaaggaaaaaacagaaaatgggtggttttcattggatgcaaagagatgtacaggatccattcgcccaaggggacaacggggtgtcaggggagtgaggggtggaggtaggggccaaagaggcttacacgatatcccatacctttaatgcctttggccttccattct

SEQ ID NO: 21294 - DNA, 1177 bp, Homo sapiens
  ENST00000332431
gtgaaccgaagtccttatattcccgggcttctttctcctctgggtaccagctccttactgccctgcagacaagcgtgccgtgcgtgcttgtggccaagggaaggaagagctggttgatccacagatagctccttcctccccgccccttcctttttgtttggaggtcccaggatctgtgttcacagacatctgggggaagaaaaggagcaggaaactaccccgcacagagttaagcaggaaacaacaacaacatcatgcaaaaaccctgcaaagaaaacgaaggaaagccaaagtgcagcgtgccaaagagggaggaaaaacgcccgtatggagaatttgaacgccagcaaacagaagggaattttagacagaggctgcttcagtctctcgaagaatttaaagaggacatagactataggcattttaaagatgaagaaatgacaagggagggagatgagatggaaaggtgtttggaagagataaggggtctgagaaagaaatttagggctctgcattctaaccataggcattctcgggaccgtccttatcccatttaattaatttctctgacaattcaattattttctgttattaatgttgccactgctttctgtttgtctgcactttcttgataaatatttgctatcgttttactccagtcattcgatgttgctgagatttacatatgactcttgtcaacatctcatcttttgacccaatcttattcatttaataagaggtctcattcatttgcatggaaaaatgctcattgtatattgcaaagtgaaaataacgagttgcaaaacagtgtatacatatatgtgtgtatatatgtacactttatttgtacatttctatgtgacataatgcaaaggaaagtgtctgattttattatacaccaaaggttaacagtgaatctctgtgtgatctctttttttttctttttgcctatctgcatcttctcacttgccaaaaaatgaatatatgtttatgtgtgtatattacttgtgtcacaaaaaaccctaaagtagacagtaaaagaacttgtcaatcgcctttggaaggcaatgaaacacttaataaactctcaataacagaagcgtaaaaatgaaatgtaaacctccaattacctctggatctcttagccagagtaataaactggtaattattacagata

SEQ ID NO: 21295 - DNA, 852 bp, Homo sapiens
  ENST00000372666
tctcctctgggtaccagctccttactgccctgcagacaagcgtgccgtgcgtgcttgtggccaagggaaggaagaggtcccaggatctgtgttcacagacatctgggggaagaaaaggagcaggaaactaccccgcacagagttaagcaggaaacaacaacaacatcatgcaaaaaccctgcaaagaaaacgaaggaaagccaaagtgcagcgtgccaaagagggaggaaaaacgcccgtatggagaatttgaacgccagcaaacagaagggaattttagacagaggctgcttcagtctctcgaagaatttaaagaggacatagactataggcattttaaagatgaagaaatgacaagggagggagatgagatggaaaggtgtttggaagagataaggggtctgagaaagaaatttagggctctgcattctaaccataggcattctcgggaccgtccttatcccatttaattaatttctctgacaattcaattattttctgttattaatgttgccactgctttctgtttgtctgcactttcttgataaatatttgctatcgttttactccagtcattcgatgttgctgagatttacatatgactcttgtcaacatctcatcttttgacccaatcttattcatttaataagaggtctcattcatttgcatggaaaaatgctcattgtatattgcaaagtgaaaataacgagttgcaaaacagtgtatacatatatgtgtgtatatatgtacactttatttgtacatttctatgtgacataatgcaaaggaaagtgtctgattttattatacaccaaaggttaacagtgaatctctgtgtgatctctttttttt

SEQ ID NO: 21296 - DNA, 1071 bp, Homo sapiens
  ENST00000372661
actggtgacgtagatctcatgtgaccaggagtcgacgtgtgcagaagtcctggtaatctggtccttgttcccgtctggataccagcttccttcagcagcgcaggcggtggtccctgaggcccgtggaaggagtcaaacttgcgggaattttgcagtttatctgcagggctgttgtttccagcaagacccaaagctagaaaaggaggaggaagaaactgacccgatcagtgccagaagtcattgtattcaaagaagaataagcaagaaagaaaagaaggaaggaagagaggtagacagatacaagatgaaatcctgtcaaaaaatggaaggaaaaccagaaaatgagagtgaaccaaagcatgaggaagagccaaagcctgaggaaaagccagaagaggaggagaagctagaggaggaggccaaagcaaaaggaacttttagagaaaggctgattcaatctctccaggagtttaaagaagatatacacaacaggcatttaagcaatgaagatatgtttagagaagtggatgaaatagatgagataaggagagtcagaaacaaacttatagtgatgcgttggaaggttaatcgaaaccatccttacccctatttaatgtagtttaccttgatttttatctgatattaacaataccatatagcttgctttttattagcatttcctgatattcctttgtccatatttctacttataacctgttgctattaatggttttagatgtatctcttgttatctgcatctcattgtttattgtattttgaaccaatctacaagtctctgtcttttaataaaagaactttacacatttgtaaaaaagaggttcttggtaagatataaaatggaaaaaggctaagtaatatgtgaatatcatatttttgaaaggtaaaaagtacatttgtatattacatatatggacataacttgtgaaggatgaaagaaagtacagcctctcggtggtgggattatgaatgatttttctccttttgcttgtttgtattttctatattcctaaaattaacacacattattattgctagaataataaaagtttt

SEQ ID NO: 21297 - DNA, 992 bp, Homo sapiens
  ENST00000372656
actggtgacgtagatctcatgtgaccaggagtcgacgtgtgcagaagtcctggtaatctggtccttgttcccgtctggataccagcttccttcagcagcgcaggcggtggtccctgaggcccgtggaaggagtcaaacttgcgggaattttgcagaagtcattgtattcaaagaagaataagcaagaaagaaaagaaggaaggaagagaggtagacagatacaagatgaaatcctgtcaaaaaatggaaggaaaaccagaaaatgagagtgaaccaaagcatgaggaagagccaaagcctgaggaaaagccagaagaggaggagaagctagaggaggaggccaaagcaaaaggaacttttagagaaaggctgattcaatctctccaggagtttaaagaagatatacacaacaggcatttaagcaatgaagatatgtttagagaagtggatgaaatagatgagataaggagagtcagaaacaaacttatagtgatgcgttggaaggttaatcgaaaccatccttacccctatttaatgtagtttaccttgatttttatctgatattaacaataccatatagcttgctttttattagcatttcctgatattcctttgtccatatttctacttataacctgttgctattaatggttttagatgtatctcttgttatctgcatctcattgtttattgtattttgaaccaatctacaagtctctgtcttttaataaaagaactttacacatttgtaaaaaagaggttcttggtaagatataaaatggaaaaaggctaagtaatatgtgaatatcatatttttgaaaggtaaaaagtacatttgtatattacatatatggacataacttgtgaaggatgaaagaaagtacagcctctcggtggtgggattatgaatgatttttctccttttgcttgtttgtattttctatattcctaaaattaacacacattattattgctagaataataaaagtttt

SEQ ID NO: 21298 - DNA, 4394 bp, Homo sapiens
  ENST00000483040
ccccctccagcgtgcagccgcgccacttcctgaccttggcacccatcaaaatacccctccggacgtcccccgtctcagatacaaggacagagcggggccgagtggcccgccctcctgccctgatgctgcgggcccagaagagccgggatggagacaaagaagacaagagtctcactctgtcccccaggccggagtgcagtggtgtaatctcggctcactgcaacctccgcctccaagtttcaagtgattctcctgcctcagcctcccgagtagctgggactacaggagcctccaccgatgctggggggaggagaggacagcacagccagaggcaacaggccagtggcctccaccccggtgcccggatccccctggtgtaattctgcactgtggtcacattctgcagaaagaaaaaaacagcatttaagcgatgagctatcctgctctgatctgtctgtgaatatatattaaaatgataatgctgttgcatgtctatcagcgaaaggcagtggctgaagaaagtgtagcatgccttatgcttcaaaagatctgttttccctccactccaagaagaatcgtaactgaatggcagttaattaaagacgtgcctgttctctctgtcgccctgcgtggctgcttgctctcggaatatgccacactccagacaccctccacgagggagctacagtttttggtttttaaaaatgcccttttataatggagtcatttggaagcagaataaaaggttattacagtaaaaattaagtttcaagcctgaagatgagagtgcagtacacagctgggaggcacagctaatttaaagaacagaaataacaaccacttgtgtcagctcaatgtgccagccaggtacagaaggcagccggctaaggagcgcagggcccccaccagccttgcatagcgagtgagcacatccctgctgactgggcctgctgtgccatgccctggtcctctgatgattcgggtgaacttggctccaatctggacagactggcacccctggcttctatgccatggtcagtgtcggtggcaggctcctggtgcctccagccttccatttgtagctaaagctcctctgtaccctgggagtgcctcggggtgagacctctttgtactaatattatgctgttttccagccacccattctccaacccttacaatttagctcgattctgatgctaactactgggagttagagccaaaccccacaggctggggtcagtccctctggctgccctgctttagacattggctgcaaatggggccccccagctgcctgcacatctgcccagctgaccacagatctggggttcccatgacctcctctccacttcagtggtgatttgctaggaccactcacagaactcaggaagcgctttacttaggattacagttgttttatcaaggatacaactcaggaacagccagtggaagcaatgctcagggtaaggtgtggacctgactgagcttctgggcctcgccggcgccaccctcccagtgctgcagcgttcaccagcctggaagcactctgaacctcaatgttttagaattttaatggagatgtaactacataggcatgactgatgaaatcatcggccaagtgaaaggactcagagggttgggcagcgctgaaagtgacggccctccagtcacgtggttggtgtttctggagaccagcaccctccctgaagctactcaggggtcctgaagtcacatggttggtgtctctggagaccagcaccctccctgaagctactcaggggtcctgaagtcatttcatttgcgcagcctcaggcacaggtgttattcctaccaggtcagggacttggtaggaataacaagatgctttcttcgctcaggaaattctaagagtttgggaagctctgtgtcaggaatctggaacaaagaccgtatacatccctctgctgcttaacgacaggggtatattctggaaaggcatccttaggcagtggcatccgacatccttttatgcacatcacagggtgtgctcacacaggcctggtggcacagcctcctgcacgcctgggctgcatggtgtagaccgtggctcccaggctgcagaccacacagcgctgactgcacagaggcagttgtgacacagtggtagggatgtgtgtgtctaaacacatccaaatgtgagaaggtagagtaaaatttgatattataatctgacgggaccaccatggtatgtgtggtcagtccatggttgagagaaatgtcactctgcggcacatgactgcatatacattttacgatgccacgaactggttgagagcttctacaggcaaactctccagtgtctccaaggcaggcacactgccgcatatcacgctgcaggatggggaaacgttccccaagaccctgtggaatcctcacacagcttccgccaagctcccctggggcgttgcagggatccagaagacttgaccttgagccctagaaccttctcactgcgaaagctgcggctttcttccccagcgatattgtgttaccatgagcaaggcttcgtgcgatccagcaaatgaaaacggttccctggctgctgcactcccctccctcggcgtgggtctttgccgatgaatcctgggtattgagcatgtttgacttttgaaaaactagtatcaaaatcatgttctgagatgaagttggtagaacttttctaaaaagaaaggaaaagtttcccaagacatgatacatgtggatgatgttcaagaagaaaaaggtgattagaaatgatggtgattacgagagatgcggggctcggtcacatcagcctgtgtcactttctcccgtgcaccgtcctctgacttgcagttgcactcgctaagctgagggaggacgcatcggtcttctttgagtgtgtggtctggacgggcgatgaccgagttttcttcttcaacccaacgatgcacctgtctgtctgggagaagcccatggacctgaaggaccgcggagacctcaacaggatcattgaggacccgccccacaaacgcaagctggaggcaccagcaactgacaacagcgatgggtccagttctgaagacaacagggaagaccaagatgtgaaaaccaagaggaaccggaccgaaggctgcgggagtcccaagccagaggaggcaaagagagaggacaaaggcacaaggacgccgcccccgcagatcctcctgcctctggaggagcgtgtgacccacttccgagacatgctgctggagagaggggtatcagcattttctacctgggagaaagaattacacaaaatcgtgtttgacccacgctatctcctgctcaactctgaggaacgaaagcagatatttgaacagtttgtcaagacaagaataaaagaagaatacaaggaaaagaaaagtaaattgctgctagccaaagaagaattcaagaaacttctagaggaatctaaagtgtctcccaggaccacgtttaaggagtttgcagagaaatacggccgggatcagaggttccgacttgttcaaaaaagaaaggaccaggagcattttttcaaccaattcatacttattcttaagaaacgggacaaggaaaacagactaaggctgcggaaaatgagatgagtttgtgaaaaaatgcaataagcccgggggttgaccctgggcgtgccgggggcgagggggtcacggtggagacggacacgggcgtggggcggccgagacctgcacggcccagcgggcaccggcactgcggggtcttcgttctcagaggattactgtttcatattgaagctctctcttttgtacattcagagtttgatgcatttctaatcaccgtgatacgtcgatcccttaattgttttaattatgcaaattacttgtaatatacacaaattatcaatccactgcaggactgtggggaagcaggaacgggagcctctgtaacaatctcaaggcatttgtgtcatcacctaagacgattggcgaaaacttttctgaaaacctttgtgaattacttcgtttctccaggattcccgcagtgttgaggaattccttactctgtccctaggtctcagtctcgtttctgagtagcagcaatagggttttcatcattcatcatagtgacaactgtgagcattccacacctggaccgtggatcacttacaggtttccaagggtggccgcgcgttcctcccagaggggcgtcccggcctggagcagggagccgtgttggttgccaccggtcctacttcaaaagaattattttgtacaaaatcatcatattaatatttgagttatttttattgtatgcccggagtttgcatgagattttttctcatcacctttgtataaaaaatttttaattttttttaatcaataaatattttaaaccag

SEQ ID NO: 21299 - DNA, 2618 bp, Homo sapiens
  ENST00000368642
gagttcgctccggagccgcgccgccgccggcccagcatctcgggcgcccgccgcccccgccgccgccgtcagcgcggggatgtaggatgcaggcgggcgccaggttccagcggcggcggcggcagctgcagcagcagcagccccggcggcggcagcctctcctctggccgatggacgcagagccgccgccgccgccgccctgggtctggatggtgccgggctcggccgggctgctccggctcagcgcgggggtcgtggttcccccggtgctgctcgcctcggccccgccgcccgcggccccgctgctccccggtctccccggctggccggccccgagcgagccggtgctcccgctgctgccgctgccctctgcgccagactccgccgccgccgccgccgcgcaccccttccccgcgctccacgggcagtggctgtttggtggccattctccgtccctaggactgcccccctcttccacagtggagctggtgcccgtcttcccacatctctgcccttctgctcttgcaacccctattgggaaaagttggatagacaaaaggattcctaactgtaagatcttttttaataattcctttgctctggactcaacgtggatacatcctgaggagtcaaggtttttccatgggcatgaaaagcctcgtttgctggcaaatcaagtagctgtgtctctgtccaggccggctcctgcctccaggccgctccccacggtggtgttagcacctcagcccatcccaggtggctgccataacagccttaaggtgaccagcagccccgccattgccatcgccaccgccgccgccgctgccatggtctccgtggaccctgagaacctccggggcccgtccccctccagcgtgcagccgcgccacttcctgaccttggcacccatcaaaatacccctccggacgtcccccgtctcagatacaaggacagagcggggccgagtggcccgccctcctgccctgatgctgcgggcccagaagagccgggatggagacaaagaagacaaggagcctccaccgatgctggggggaggagaggacagcacagccagaggcaacaggccagtggcctccaccccggtgcccggatccccctggtgtgtggtctggacgggcgatgaccgagttttcttcttcaacccaacgatgcacctgtctgtctgggagaagcccatggacctgaaggaccgcggagacctcaacaggatcattgaggacccgccccacaaacgcaagctggaggcaccagcaactgacaacagcgatgggtccagttctgaagacaacagggaagaccaagatgtgaaaaccaagaggaaccggaccgaaggctgcgggagtcccaagccagaggaggcaaagagagaggacaaaggcacaaggacgccgcccccgcagatcctcctgcctctggaggagcgtgtgacccacttccgagacatgctgctggagagaggggtatcagcattttctacctgggagaaagaattacacaaaatcgtgtttgacccacgctatctcctgctcaactctgaggaacgaaagcagatatttgaacagtttgtcaagacaagaataaaagaagaatacaaggaaaagaaaagtaaattgctgctagccaaagaagaattcaagaaacttctagaggaatctaaagtgtctcccaggaccacgtttaaggagtttgcagagaaatacggccgggatcagaggttccgacttgttcaaaaaagaaaggaccaggagcattttttcaaccaattcatacttattcttaagaaacgggacaaggaaaacagactaaggctgcggaaaatgagatgagtttgtgaaaaaatgcaataagcccgggggttgaccctgggcgtgccgggggcgagggggtcacggtggagacggacacgggcgtggggcggccgagacctgcacggcccagcgggcaccggcactgcggggtcttcgttctcagaggattactgtttcatattgaagctctctcttttgtacattcagagtttgatgcatttctaatcaccgtgatacgtcgatcccttaattgttttaattatgcaaattacttgtaatatacacaaattatcaatccactgcaggactgtggggaagcaggaacgggagcctctgtaacaatctcaaggcatttgtgtcatcacctaagacgattggcgaaaacttttctgaaaacctttgtgaattacttcgtttctccaggattcccgcagtgttgaggaattccttactctgtccctaggtctcagtctcgtttctgagtagcagcaatagggttttcatcattcatcatagtgacaactgtgagcattccacacctggaccgtggatcacttacaggtttccaagggtggccgcgcgttcctcccagaggggcgtcccggcctggagcagggagccgtgttggttgccaccggtcctacttcaaaagaattattttgtacaaaatcatcatattaatatttgagttatttttattgtatgcccggagtttgcatgagattttttctcatcacctttgtataaaaaatttttaattttttttaatcaataaatattttaaaccag

SEQ ID NO: 21300 - DNA, 2968 bp, Homo sapiens
  ENST00000282111
ggccaggggctgggacgccccggcggagcaggcggcggcggtggcgagttggggagccctaggctcggcgctgccggaggggcccgagccgagccgcctgcgccccggccgggcagcgccgggcccgcttcccgcggggccacgccctgtcaaactttgttgcggcggctagcgcagcgggcccgcaagcgggcgggaggggcgccgggccgggccgggcagggcgcgggcggctaggggctccgagagcggcggccccggcccgcggccccaccatgccccagctcggcggcgggggcggcggcggcggcggcggcagcgggggaggcggcggctccagcgccggggcggccggcggaggggacgacctcggggcgaacgacgagctgatccccttccaggacgaggggggcgaggagcaggagccgagcagcgatagcgcctcggcgcagcgggacctagacgaggtcaagtcgtccctggtcaacgagtcggagaaccagagcagcagctcggactcggaggcggagaggcgcccgcagcccgtccgggacactttccagaagccgcgggactatttcgccgaagtgagaaggcctcaggacagcgcgttctttaaaggacccccgtaccctgggtaccccttcctgatgatcccggacctgagcagcccgtacctctccaacggacccctgtctcccggaggagcgcgcacctacctgcagatgaaatggcccctcctcgatgtcccctccagcgccacagtcaaggacacgaggtcaccatctccagcacacttgtctaataaagttcctgtcgttcagcacccgcatcacatgcatccgctgactcccctcatcacctacagcaatgaccacttctcccccggctcccctcccacccacctctccccagagatcgatccaaagacaggaatcccccggccccctcacccatccgagctgtcaccgtattacccactctctcccggagctgtcggacaaatcccccaccccctcggctggctcgtcccacagcaaggccagcccatgtactcccttcctcccggtggcttccggcacccttaccccgccctcgccatgaacgcctcgatgtccagcctggtctccagtcggttctctcctcacatggtggctcctgcccaccctggcctgcccacctcagggatcccccaccctgccatcgtctcccccatcgtcaagcaggaaccggcaccccccagcctgagccctgcagtgagcgtgaaatcaccagtcaccgtgaaaaaggaggaggaaaagaagccccacgtgaagaagcctctgaatgccttcatgttgtatatgaaggagatgagggccaaggtggtggctgagtgcaccctgaaggaaagtgcagccattaaccagatccttggaagaaagtggcacaacctgtctcgagaagaacaggccaagtactacgagctggcccggaaggagcggcagcttcactcgcagctctacccaacctggtcagcccgggacaactatggtaagaaaaagaagaggaagagagaaaagcagctgtcccagacacagtcacagcagcaagtccaggaggcagagggtgccctggcctccaagagcaagaagccatgtgttcagtacctgccccccgagaagccctgtgacagccctgcctcctcccacgggagcatgctggactccccggccactccctctgcagctttggcctcaccagctgcccctgctgccacccattcggagcaagcccagcccctctccctcaccaccaaaccagaaacccgggcccagctggctctccactctgccgccttcctgtcggctaaggctgcagcctcctcctctgggcagatgggcagccagcctcccctcctgtcccggcccctcccccttgggtccatgcccacagctctgctggcctctcccccgtccttccccgccacgctccatgcccaccaggccctcccggtgctacaggcccagcctctttccctggtcaccaagtctgcccactaagctccccccgacccctgcaggctgtcacatgactcattgagtagtaatgattcagaagaaaaagaaaaaggagactttattggtcaatatttgaccactctggactgttctgtaaagtggctggtaacaacagcactttacagtttgtagatgtaaccagtagctgatcttaaggcttttttaaaaaacaaaacaaaacaacaaaaaaaaatctttataagaaagagaactgaaaagtagcgtgctattcgtcctgtaggtgctgtggtggatggacctgggcagagggcacttctctctcttacctctcttgcactttctgtctcctgtctcttctcgcccctgccgcctgccccagcttccccgactccatctgcagctctgccattgtgacatttcctgttacccagcccaagttttcatcgtctgctcaataccgtgggttcttcttcgtcctctgtcctctgcccagtgtgaggccatcaccatgtgagaagacatcttggcctgatttgctgccaccagcgtcccctccctcagtgggcccgaactcgccagccccagctttcagtggagaaagcggtcctctgaaatggtttcctcccaacccccgcatttaaagggactcaaggtgcctgccacttcctcagcgaagaagtctgtgttcctccccgtccttgccagtggcgatcatcccttcacaatcccagagtggcaggcgggaccggccccatggtctggctcctgtcacctgggtccgtgccagcacaatctgccaaagttctagagaccctgttcccttccccatcacctcacatgcttcttctgtgtgtatttctttttgtttttatggtttttggagcaatttaaactcccagttgtttattttcacaaaagaaaataaaattgcagttgcaagacctttt

SEQ ID NO: 21301 - DNA, 537 bp, Homo sapiens
  ENST00000494519
ctgggtaccccttcctgatgatcccggacctgagcagcccgtacctctccaacggacccctgtctcccggaggagcgcgcaccacggagtcttgctctgtcgcccaggctggagtgcactgacgtgatctcggctcactgcaagctctgcctcctgggttcacgccattctcccgcctcagcctcccgagtagctgggactacaggcgccggccaccacacccggctaattttggtgcatgtatttctatttttatttttcgtttgccatttcttccagtttccttggttaaagttttcagctaagtacttacctttatagtcagagataacgcctactctacacctgcaagtatcattctcccaccctaccttttctcctggctgattccagcaatgtgggactggctggggggtaaggggctagcacatggtacaagaccagctcccaagagcaagtgttgagtgcaaccactatggaaaacagtatagaggttcttcaaaaaacaaaaaattaattaaaaattaaagaattata

SEQ ID NO: 21302 - DNA, 559 bp, Homo sapiens
  ENST00000442813
aaacaggtgcttggggcagctaaaaataaccaccctgggaagtgaaactgtggcagtgccaaggagctaagaacgtggtgatttaccagaagtcttcagaggcaagccatcttcaattcagaaggggaatcccacatgtgtgttgaatatgaggcattgtttaagacacctcctgccctcaccacattggcaaactgacagcgtcaacttgaaacaagtctgcacattgtggccattttcactccacaacaaatgtttggtctccctctgtcacccaggctagagtgcagcgaaatcacagctcactgcagcctcgacctcctgggctcaagagatcctcccacctcagccttctcagtagctgggactacaggatataagtggattcgtatggtgtgtagccttttgattctggcttcctctgctcactaatatgcacttgaaattcatccacattgctgcagtacctgcagatgaaatggcccctcctcgatgtcccctccagcgccacagtcaaggacacgaggtcaccatctccagcacacttgtctaataaagt

SEQ ID NO: 21303 - DNA, 715 bp, Homo sapiens
  ENST00000490744
ctgtctttatagcattcacacagagttgccaggggaaggcaaagcatttttggagcccctctttggagaaataacagtcactacaagttacagataatgaggaagacacatgtggaggaggaatccaaagtttatttctccatgaatgaggcgggctttctagagacttggttcaccagtgactcttgtcattggtcttgtgggtcctgtccctctcttccaggacgctggcttctgtatcacagccagctggaagatactcttcacagagatagaatccgtgcagctagagagggggtgcattagtcctgcctcccctgaatatgtccttgactgactggtgagagctgctagggagttgacagagggcaaggacaatgacacaagcacctgctaggctccagagcaccagggacatagggcaggatgctcccatttgatgttcgttaaggtgctctggcagggcgagggaacagtctgacatatctctctttggaagcaggaatcccccggccccctcacccatccgagctgtcaccgtattacccactctctcccggagctgtcggacaaatcccccaccccctcggctggctcgtcccacagcaaggccagcccatgtactcccttcctcccggtggcttccggcacccttaccccgccctcgccatgaacgcctcgatgtccaggtgagtcccggggctggggctgtccg

SEQ ID NO: 21304 - DNA, 2499 bp, Homo sapiens
  ENST00000321394
aaaaatgccgaccccgccccttccccggagcctcacttccgtcacagtcctgtttctctccctgttgtccctgcctctttttccttcccgccgtgccccgcggccgggccggggcagccgggaagcgggtggggtggtgtgttacccagtagctcctgggacatcgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacgttatggctgcagcttcgattgccaatattgtaaaaagttctcttggtccagttggcttggataaaatgttggtggatgatattggtgatgtaaccattactaacgatggtgcaaccatcctgaagttactggaggtagaacatcctgcagctaaagttctttgtgagctggctgatctgcaagacaaagaagttggagatggaactacttcagtggttattattgcagcagaactcctaaaaaatgcagatgaattagtcaaacagaaaattcatcccacatcagttattagtggctatcgacttgcttgcaaggaagcagtgcgttatatcaatgaaaacctaattgttaacacagatgaactgggaagagattgcctgattaatgctgctaagacatccatgtcttccaaaatcattggaataaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggatcccagggcatgcccaagagaatcgtaaatgcaaaaattgcttgccttgacttcagcctgcaaaaaacaaaaatgaagcttggtgtacaggtggtcattacagaccctgaaaaactggaccaaattagacagagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggagcaactattctgtcaaccctggccaatttggaaggtgaagaaacttttgaagctgcaatgttgggacaggcagaagaagtggtacaggagagaatttgtgatgatgagctgatcttaatcaaaaatactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaagtaaagatgataaacatggaagttatgaagatgctgttcactctggagcccttaatgattgatctgatgttccttttatttataacaatgttaaatgcaattgtcttgtaccttgagttgagtattacacattaaagtaaagtacaagctgtaaacttgggtttttgtgatgtaggaaatggtttccatctgtactttggtcctctgatttcacatattgcaacctagtactttattagtttaaaaagaaattgaggttgttcaaagtttaagcaattcattctctctgaacacacattgctattcccatcccacccccaatgcacagggctgcaacaccacgacttctgcccattctctccagtgtgtgtaacagggtcacaagaattcgacagccagatgctccaagagggtggcccaaggctatagcccctccttcaatattgacctaacgggggagaaaagatttagattgtttattcttctgtggacacagtttaaaatcttaaacttgtctttttcctcttaatgtatcagcatgctaccctttcaaactcaaattttcattttaactgcttaggaataaatttacacctttgtgaaaattca

SEQ ID NO: 21305 - DNA, 1403 bp, Homo sapiens
  ENST00000544255
tcctgggacatcgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacggatgtaaccattactaacgatggtgcaaccatcctgaagttactggaggtagaacatcctgcagctaaagttctttgtgagctggctgatctgcaagacaaagaagttggagatggaactacttcagtggcatgcccaagagaatcgtaaatgcaaaaattgcttgccttgacttcagcctgcaaaaaacaaaaatgaagcttggtgtacaggtggtcattacagaccctgaaaaactggaccaaattagacagagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggagcaactattctgtcaaccctggccaatttggaaggtgaagaaacttttgaagctgcaatgttgggacaggcagaagaagtggtacaggagagaatttgtgatgatgagctgatcttaatcaaaaatactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaagtaaagatgataaacatggaagttatgaagatgctgttcactctggagcccttaatgattgatctgatgttccttttatttataacaatgttaaatgcaattgtcttgtaccttgagttgagtattacacattaaagtaaagt

SEQ ID NO: 21306 - DNA, 1671 bp, Homo sapiens
  ENST00000420894
tccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacgttatggctgcagcttcgattgccaatattgtaaaaagttctcttggtccagttggcttggataaaatgttggtggatgatattggtgatgtaaccattactaacgatggtgcaaccatcctgaagttactggaggtagaacatcctgcagctaaagttctttgtgagctggctgatctgcaagacaaagaagttggagatggaactacttcagtggttattattgcagcagaactcctaaaaaatgcagatgaattagtcaaacagaaaattcatcccacatcagttattagtggctatcgacttgcttgcaaggaagcagtgcgttatatcaatgaaaacctaattgttaacacagatgaactgggaagagattgcctgattaatgctgctaagacatccatgtcttccaaaatcattggaataaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggatcccagggcatgcccaagagaatcgtaaatgcaaaaattgcttgccttgacttcagcctgcaaaaaacaaaaatgaagcttggtgtacaggtggtcattacagaccctgaaaaactggaccaaattagacagagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggagcaactattctgtcaaccctggccaatttggaaggtgaagaaacttttgaagctgcaatgttgggacaggcagaagaagtggtacaggagagaatttgtgatgatgagctgatcttaatcaaaaatactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaagtaaagatgataaacatggaagttatgaagatgctgttcactctggagcccttaatgattgatctgatgttccttttatttataacaatgttaaatgcaattgtcttgtaccttgagttgag

SEQ ID NO: 21307 - DNA, 1878 bp, Homo sapiens
  ENST00000392168
gtcctgtttctctccctgttgtccctgcctctttttccttcccgccgtgccccgcggccgggccggggcagccgggaagcgggtggggtggtgtgttacccagtagctcctgggacatcgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacggatgtaaccattactaacgatggtgcaaccatcctgaagttactggaggtagaacatcctgcagctaaagttctttgtgagctggctgatctgcaagacaaagaagttggagatggaactacttcagtggttattattgcagcagaactcctaaaaaatgcagatgaattagtcaaacagaaaattcatcccacatcagttattagtggctatcgacttgcttgcaaggaagcagtgcgttatatcaatgaaaacctaattgttaacacagatgaactgggaagagattgcctgattaatgctgctaagacatccatgtcttccaaaatcattggaataaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggatcccagggcatgcccaagagaatcgtaaatgcaaaaattgcttgccttgacttcagcctgcaaaaaacaaaaatgaagcttggtgtacaggtggtcattacagaccctgaaaaactggaccaaattagacagagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggagcaactattctgtcaaccctggccaatttggaaggtgaagaaacttttgaagctgcaatgttgggacaggcagaagaagtggtacaggagagaatttgtgatgatgagctgatcttaatcaaaaatactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaagtaaagatgataaacatggaagttatgaagatgctgttcactctggagcccttaatgattgatctgatgttccttttatttataacaatgttaaatgcaattgtcttgtaccttgagttg

SEQ ID NO: 21308 - DNA, 566 bp, Homo sapiens
  ENST00000546204
gactagacattgtttctgtatagtatatctaaatatcctgtgtaggcaggacttaagggaactttatgtagacttattttattaaaatgccattttttttgagaaattgatggtcttggcaaaaaaaaatttttaaaaatgctattacaagaattgtacttttgttttgaacagtactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggtaagcatggtttcccgctctttgttaacctctgc

SEQ ID NO: 21309 - DNA, 780 bp, Homo sapiens
  ENST00000539756
cgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacggcatgcccaagagaatcgtaaatgcaaaaattgcttgccttgacttcagcctgcaaaaaacaaaaatgaagcttggtgtacaggtggtcattacagaccctgaaaaactggaccaaattagacagagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggagcaactattctgtcaaccctggccaatttggaaggtgaagaaacttttgaagctgcaatgttgggacaggcagaagaagtggtacaggagagaatttgtgatgatgagctgatcttaatcaaaaatactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatatacctt

SEQ ID NO: 21310 - DNA, 873 bp, Homo sapiens
  ENST00000536807
catggtggtatgtgcctgtagtcccagctactaaggaggctgaggtaggagtattaattgaacccaggagtgccagtccaatgtgggcaacatagcaagaccctgtctcgggagtgggtgcgtgtgtgcgcatgtgttgcgcgcacgcgtgcgtagtagcagcagtatcaattttgtgcaataaaattttgaataaccaattttatgcaaattgatatcaatagagaggagtaatgctgtattgaaattacctgttgccttccctgcttttttagggtgaaaaggtaataaaaagcatgtctaaaagtgatatgaattgcagatagtgataatgttgtaacattttggtgacaagtaatgcttgctgctttaatagattagattactaaaaggaagtcccttgaaattacccttgatttttcacgtgtgtaccctttgtccattccaaacctgttactgtccttaacttttggcgtagaaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggatcccagggcatgcccaagagaatcgtaaatgcaaaaattgcttgccttgacttcagcctgcaaaaaacaaaaatgaagcttggtgtacaggtggtcattacagaccctgaaaaactggaccaaattagacagagagaatcagatatcaccaaggagagaattcagaagatcctggcaactggtgccaatgttattctaaccactggtggaattgatgata

SEQ ID NO: 21311 - DNA, 918 bp, Homo sapiens
  ENST00000538530
gctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacgttatggctgcagcttcgattgccaatattgtaaaaagttctcttggtccagttggcttggataaaatgttggtggatgatattggttggttcatattttttcctgcgaatttcttaggatgtaaccattactaacgatggtgcaaccatcctgaagttactggaggtagaacatcctgcagctaaagttctttgtgagctggctgatctgcaagacaaagaagttggagatggaactacttcagtgaccagtgaatgttttctcaacaggttattattgcagcagaactcctaaaaaatgcagatgaattagtcaaacagaaaattcatcccacatcagttattagtggctatcgacttgcttgcaaggaagcagtgcgttatatcaatgaaaacctaattgttaacacagatgaactgggaagagattgcctgattaatgctgctaagacatccatgtcttccaaaatcattggaataaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggatcccagggcatgcccaagagaatcgtaaatgcaaaaattgcttgccttgacttcagcctgcaaaaaacaaaaatgaagcttggtg

SEQ ID NO: 21312 - DNA, 561 bp, Homo sapiens
  ENST00000543532
tttttccttcccgccgtgccccgcggccgggccggggcagccgggaagcgggtggggtggtgtgttacccagtagctcctgggacatcgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacgttatggctgcagcttcgattgccaatattgtaaaaagttctcttggtccagttggcttggataaaatgttggtggatgatattggtgatgtaaccattactaacgatggtgcaaccatcctgaagttactggaggtagaacatcctgcagctaaagttctttgtgagctggctgatctgcaagacaaagaagttggagatggaactacttcagtggcatgcccaagagaatcgtaaatgcaaaaattgcttgccttgacttcagcctgcaaaaaacaaaaatgaagcttggtg

SEQ ID NO: 21313 - DNA, 658 bp, Homo sapiens
  ENST00000467544
tttttgatgtaatagttgtaaactgtgttgtcttaacgttttgattaataactaaattttaatttgaaaaccttcaatttaaatgttttagcatttaagtagtaatatttgaagttaaaaacttggaccagtatcttttttctcatttgactaccacattttctcctaataatagattttagtggctatgcttatgggatagattaaacttgccatgatctgaagagggagggttttttcatgtcctcctcctatatgaaatggctgaacggatattattacttacgacattttggctctgtgttaagcatgatgaatgcaaagagtttgagtagtgactttataagcgtttttctcccccacacttttaaacagggaagcagtgcgttatatcaatgaaaacctaattgttaacacagatgaactgggaagagattgcctgattaatgctgctaagacatccatgtcttccaaaatcattggaataaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtg

SEQ ID NO: 21314 - DNA, 557 bp, Homo sapiens
  ENST00000538128
tttttccttcccgccgtgccccgcggccgggccggggcagccgggaagcgggtggggtggtgtgttacccagtagctcctgggacatcgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacggatgtaaccattactaacgatggtgcaaccatcctgaagttactggaggtagaacatcctgcagctaaagttctttgtgagctggctgatctgcaagacaaagaagttggagatggaactacttcagtgggaagcagtgcgttatatcaatgaaaacctaattgttaacacagatgaactgggaagagattgcctgattaatgctgctaagacatccatgtcttccaaaatcattggaataaatggtgatttctttgctaacatggtagtagatgctgtacttgctatt

SEQ ID NO: 21315 - DNA, 561 bp, Homo sapiens
  ENST00000543517
agtagctcctgggacatcgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacgttatggctgcagcttcgattgccaatattgtaaaaagttctcttggtccagttggcttggataaaatgttggtggatgatattggtgatgtaaccattactaacgatggtgcaaccatcctgaagttactggaggtagaacatcctgcagctaaagttctttgtgagctggctgatctgcaagacaaagaagttggagatggaactacttcagtgggaagcagtgcgttatatcaatgaaaacctaattgttaacacagatgaactgggaagagattgcctgattaatgctgctaagacatccatgtcttccaaaatcattggaataaatggtgatttctttgctaacatggtagtagatgct

SEQ ID NO: 21316 - DNA, 706 bp, Homo sapiens
  ENST00000539948
tttgtttttattttttgtagaaatgggtttcgctatgttgcccaaaggggtctcaaactcctggcatcaagcgatcctcctgcctcggcctcgcagtgttgggattacacctgtgagccacagtgtctggccccatttacactcttagtaggtggtttttaaataattaacacagatttgtagatttgggaaatacgggggctgttggatgtcatttacctttaggctgaaattactgtctttcagagttgtggcttatcctcatttcttttttatttttaattgattgtctacagttatggctgcagcttcgattgccaatattgtaaaaagttctcttggtccagttggcttggataaaatgttggtggatgatattggtgatgtaaccattactaacgatggtgcaaccatcctgaagttactggaggtagaacatcctgcagctaaagttctttgtgagctggctgatctgcaagacaaagaagttggagatggaactacttcagtggttattattgcagcagaactcctaaaaaatgcagatgaattagtcaaacagaaaattcatcccacatcagttattagtggctatcgacttgcttgcaaggaagcagtgcgttatatcaatgaaaacctaattgttaacacagatgaactgggaagagattgcctgattaatgctgctaagacatccatgtcttcc

SEQ ID NO: 21317 - DNA, 709 bp, Homo sapiens
  ENST00000545764
attaacacagatttgtagatttgggaaatacgggggctgttggatgtcatttacctttaggctgaaattactgtctttcagagttgtggcttatcctcatttcttttttatttttaattgattgtctacagttatggctgcagcttcgattgccaatattgtaaaaagttctcttggtccagttggcttggataaaatgttggtggatgatattggtgtaagtacacataactgttgtgttagtttccttaaagtaaaactatcttcagtgttttgctatgttctttctttgactttatcagaatccacgtactggaaggtgatattaaaggtgaacgtgtattataatggggctgtgttgatttctataagtggttcatattttttcctgcgaatttcttaggatgtaaccattactaacgatggtgcaaccatcctgaagttactggaggtagaacatcctgcagctaaagttctttgtgagctggctgatctgcaagacaaagaagttggagatggaactacttcagtggttattattgcagcagaactcctaaaaaatgcagatgaattagtcaaacagaaaattcatcccacatcagttattagtggctatcgacttgcttgcaaggaagcagtgcgttatatcaatgaaaacctaattgttaacacagatgaactgggaagagattgcctgattaatgctgct

SEQ ID NO: 21318 - DNA, 691 bp, Homo sapiens
  ENST00000537390
tttttccttcccgccgtgccccgcggccgggccggggcagccgggaagcgggtggggtggtgtgttacccagtagctcctgggacatcgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacgataaagagagttttaatgagcaaaaaacttgcagaatctgaaggaaaaggctggtatagctgtacgaagtggcagagcatgaaattgttatggctgcagcttcgattgccaatattgtaaaaagttctcttggtccagttggcttggataaaatgttggtggatgatattggtgatgtaaccattactaacgatggtgcaaccatcctgaagttactggaggtagaacatcctgcagctaaagttctttgtgagctggctgatctgcaagacaaagaagttggagatggaactacttcagtggttattattgcagcagaactcctaaaaaatgcagatgaattagtcaaacagaaaattcatcccacatcagttattagtggctatcgacttgcttgcaaggaagcagtgcgttatatcaatg

SEQ ID NO: 21319 - DNA, 535 bp, Homo sapiens
  ENST00000536394
actcgagtgcattgaccccaggagacggcagcgctaacttagcagagcgtttgctgtcaggcctttggatacctacagagcttactgtttcttgatagattcctaatttttttcgtaaacaaatctgaaagtcaccaccttccccgttgactaccgatttctctcctcacagataaagagagttttaatgagcaaaaaacttgcagaatctgaaggaaaaggctggtatagctgtacgaagtggcagagcatgaaattgttatggctgcagcttcgattgccaatattgtaaaaagttctcttggtccagttggcttggataaaatgttggtggatgatattggtgatgtaaccattactaacgatggtgcaaccatcctgaagttactggaggtagaacatcctgcagctaaagttctttgtgagctggctgatctgcaagacaaagaagttggagatggaactacttcagtggttattattgcagcagaactcctaaaaaatgcagatgaattagtcaaacagaaaattcatc

SEQ ID NO: 21320 - DNA, 572 bp, Homo sapiens
  ENST00000536607
acgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacgttatggctgcagcttcgattgccaatattgtaaaaagttctcttggtccagttggcttggataaaatgttggtggatgatattggtgtaagtacacataactgttgtgttagtttccttaaagtaaaactatcttcagtgttttgctatgttctttctttgactttatcagaatccacgtactggaaggtgatattaaaggtgaacgtgtattataatggggctgtgttgatttctataagtggttcatattttttcctgcgaatttcttaggatgtaaccattactaacgatggtgcaaccatcctgaagttactggaggtagaacatcctgcagctaaagttctttgtgagctggctgatctgcaagacaaagaagttggagatggaactacttcagt

SEQ ID NO: 21321 - DNA, 1135 bp, Homo sapiens
  ENST00000546023
ctttttccttcccgccgtgccccgcggccgggccggggcagccgggaagcgggtggggtggtgtgttacccagtagctcctgggacatcgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacgaaagggcctcggggccccgcagccggacccagcccacccgccgttctctggggcagggcgctgtggccccacttttcccacagcgaggaggagccccgccgcgcgcggcagggttttgagaccggcaacgcgtggatgtggtgtccggggcggcgttggaaacgcgccctccgcgggaaagcgggcctcccgggctcgcacgtgcgggccacgcctcgcacccccttttgtttcagggcgaccccctgagtgtccatgttaaacgccaggttttattttaggaccatttaccagaaaaagagtaggtccatccgcgcgccctcggatgagcccggtgccctgtccgcccgcagctgcagtcgaggtcgggcgtccggcgtccagccgtatccgggttgacagcttcttacagtagagttagcccaggaaacgccactcgagtgcattgaccccaggagacggcagcgctaacttagcagagcgtttgctgtcaggcctttggatacctacagagcttactgtttcttgatagattcctaatttttttcgtaaacaaatctgaaagtcaccaccttccccgttgactaccgatttctctcctcacagataaagagagttttaatgagcaaaaaacttgcagaatctgaaggaaaaggctggtatagctgtacgaagtggcagagcatgaaattggtggttattactttttttttttttccccgccatcagattccaccccgcatcaaagctgtgccaaataggctcgctttgtttagggacagggtcccacctgtcgcccagacgagagtgccatcatagctcactgcattctccaagcacaggtccgcgccgccgcatccggcttt

SEQ ID NO: 21322 - DNA, 153 bp, Homo sapiens
  ENST00000553143
acgcacgccaagtcttcagagggcctggatgggtgtgactccaaggagctaatcgtcccgtgcaggtgctacctttttacccacacttaagtgacgcaaaatgcccttcaatggcgagaagcagtgtgtgggagaggaccagccaagcgattc

SEQ ID NO: 21323 - DNA, 1788 bp, Homo sapiens
  ENST00000547153
gggacactggggctgggggggtttgttgggctggtgagttttcgaggtgactgtgctgtgctcggtgaggggacgcccagagagccctgacccggggtcactccgtcgccgttctcctcttgtctacgtgctggacccggtgctacctttttacccacacttaagtgacgcaaaatgcccttcaatggcgagaagcagtgtgtgggagaggaccagccaagcgattctgattcttcccggttttccgaaagcatggcttcgctcagtgactatgaatgctccaggcagagctttgcaagtgactcctccagcaaatccagctctcctgcttcaacaagccctccaagggttgtaacatttgatgaagtgatggctacagcaaggaacttatcaaacttgactcttgctcatgagattgctgtaaatgagaactttcaattgaaacaagaggctctcccagaaaagagtttggctggtcgagtgaagcacattgttcaccaggccttctgggacgtcttggattcagaactaaatgctgaccctcctgagtttgaacatgccatcaaactgtttgaagaaatcagagagattcttctctcttttctcactcccggtggcaaccggcttcgcaaccaaatctgtgaagttttggacacagacctcattaggcagcaggctgagcacagtgctgttgacatccaaggcctggccaactatgtcatcagtacgatgggaaagctgtgtgctcccgtgcgagataatgatatcagagagttaaaggctactggcaacatcgtggaggtgctgagacaaatattccatgtcctggacctcatgcaaatggacatggccaattttacaattatgagtctcagaccgcaccttcaacgccagttggtggaatatgagagaaccaagttccaggaaattttggaagaaactccaagaaaagccgaggttgcaggtgcctcatgaggctgaccttgcttttggaaccagagagagcagtcaccgtgccagcctgtgagagtgaagtctctgccgatccctaagagaagagccaacgtttcactctaaacgcatgctccttctgctttaccggtcattctcaagtctgactacaaattagaatcatctggggcgtttaaacacagaggcctgagccctgcctcagacagaataaatcaaagtctccaggagctgtgcccatgaactctttttttcctttttaaagctccccaggtgattctaaagtcagccaggattgagaaccactatgccacactgttgcttttgttcaaggtaactaaatgggctcttaaatgtgtcagctgtaaatgattaaacttgcagtataaatgcttattactgccacattgtaattatattcacgatgatttccactcgcgctctctcagttggatgtcttttaaatgaaagactgcaagtcttttacatctttataaaacagaactagcaaaccaaaaacaacatttgccaactgaggagaaacaagagttgtgaaattctgggggtggtgttgctttagtgtggcaaacagaactactcataaattatccctgctcaagtgctgggtccaagaagaatttcagtctctctctactctgcacctgtgttcaggctgtatttcttggcaattgtcaccttataaattctaccaaatgtataattgtataagaactgtggtataaaaagcaatttgtttctagtgggaaaccttagaactgggcctaaagcaaaataaagtgaattttgtcctaaggcaga

SEQ ID NO: 21324 - DNA, 2219 bp, Homo sapiens
  ENST00000299045
gggacactggggctgggggggtttgttgggctggtgagttttcgaggtgactgtgctgtgctcggtgaggggacgcccagagagccctgacccggggtcactccgtcgccgttctcctcttgtctacgtgctggacccggtgctacctttttacccacacttaagtgacgcaaaatgcccttcaatggcgagaagcagtgtgtgggagaggaccagccaagcgattctgattcttcccggttttccgaaagcatggcttcgctcagtgactatgaatgctccaggcagagctttgcaagtgactcctccagcaaatccagctctcctgcttcaacaagccctccaagggttgtaacatttgatgaagtgatggctacagcaaggaacttatcaaacttgactcttgctcatgagattgctgtaaatgagaactttcaattgaaacaagaggctctcccagaaaagagtttggctggtcgagtgaagcacattgttcaccaggccttctgggacgtcttggattcagaactaaatgctgaccctcctgagtttgaacatgccatcaaactgtttgaagaaatcagagagattcttctctcttttctcactcccggtggcaaccggcttcgcaaccaaatctgtgaagttttggacacagacctcattaggcagcaggctgagcacagtgctgttgacatccaaggcctggccaactatgtcatcagtacgatgggaaagctgtgtgctcccgtgcgagataatgatatcagagagttaaaggctactggcaacatcgtggaggtgctgagacaaatattccatgtcctggacctcatgcaaatggacatggccaattttacaattatgagtctcagaccgcaccttcaacgccagttggtggaatatgagagaaccaagttccaggaaattttggaagaaactccaagtgctcttgatcagactacagaatggataaaagaatctgtaaatgaagaattattttctctttctgagagtgctttaactcctggggccgaaaatacctccaagccaagcctgagccctactttggtgctaaataatagttacttgaaactgttacagtgggattatcagaaaaaagaattaccagagacacttatgacagatggagcacgtcttcaggaactaacagaaaagctgaatcaattgaaaattattgcctgcctgtccctaattaccaacaacatggtgggtgctattacaggaggcctgcctgagcttgcaagcaggttaacaaggatttcagctgttctacttgaaggcatgaacaaagagacctttaacttgaaggaagtcctgaattctattggtattcagacttgtgttgaggttaacaagaccctgatggaaagaggtttacccactttaaatgctgagattcaagctaatcttataggtcaattttcaagcattgaagaggaggacaatcctatctggtccttgattgataaacgaattaagctttacatgagaaggctactttgtcttccaagccctcaaaaatgcatgcctcctatgccaggaggcctagctgtcattcagcaggagctagaagccctaggctctcaatatgcaaacattgtgaatctcaacaaacaagtgtatggaccattttatgcaaatatacttcgaaagctgctcttcaatgaggaagccatggggaaggtagatgcttcacctcctactaactaaagaagaactgacattggacgagagattggaaatccagtactttggtatccagtccacttccattgatggcattagagatccagcacattctcagtactgtggtgcagtattagcccaaatctgtgtaatgggtaatattagcattacagaagacacacacatcacatagaccctcagaagacgtaaacatcacatagaccctatttgtgcatcattttcaagtttaaaacaaatatttgtaatgaacagaaaacaatttgtaattaattatattacctatataatacttgtaaatgttttcttaaccatttatatttggcttatgacatttaacccctaaggagttgtttttctcacttgttattatcaaacctaatggtttttaattttggtacaactccttaaagggttgaaggttgtgacaataactgagggaactgatgttctgaataaatgatgtgaagtaaacacaattgtatttgaaa

SEQ ID NO: 21325 - DNA, 3198 bp, Homo sapiens
  ENST00000546625
ggggggtttgttgggctggtgagttttcgaggtgactgtgctgtgctcggtgaggggacgcccagagagccctgacccggggtcactccgtcgccgttctcctcttgtctacgtgctggacccggtgctacctttttacccacacttaagtgacgcaaaatgcccttcaatggcgagaagcagtgtgtgggagaggaccagccaagcgattctgattcttcccggttttccgaaagcatggcttcgctcagtgactatgaatgctccaggcagagctttgcaagtgactcctccagcaaatccagctctcctgcttcaacaagccctccaagggttgtaacatttgatgaagtgatggctacagcaaggaacttatcaaacttgactcttgctcatgagattgctgtaaatgagaactttcaattgaaacaagaggctctcccagaaaagagtttggctggtcgagtgaagcacattgttcaccaggccttctgggacgtcttggattcagaactaaatgctgaccctcctgagtttgaacatgccatcaaactgtttgaagaaatcagagagattcttctctcttttctcactcccggtggcaaccggcttcgcaaccaaatctgtgaagttttggacacagacctcattaggcagcaggctgagcacagtgctgttgacatccaaggcctggccaactatgtcatcagtacgatgggaaagctgtgtgctcccgtgcgagataatgatatcagagagttaaaggctactggcaacatcgtggaggtgctgagacaaatattccatgtcctggacctcatgcaaatggacatggccaattttacaattatgagtctcagaccgcaccttcaacgccagttggtggaatatgagagaaccaagttccaggaaattttggaagaaactccaagtgagtataatataatgtgtatttatattgaaattaggttaaaatgatgattttaaatgttaaaatttaaattaaattaaattaaattaaattaaattaataaataaataaaatttaatttaatttaaattaattaaaatttaaaatgttaaaggttaaaatgaaaattaggtgatgttttcatttttgacttcatatatagtatcactaaagaattttggcctttctattaaacatttttttaccttccaaaattgacatcacaaacttacagttgtttattctgtccaggaactgtgctaagcactattcgtttcttcattcattcaagatatatttattgagtgcctcctgtgtttcagacactgcttaggtgcagtggatactgcagcgaacagaatggaatacagttgccgtccccaaggagctgacattctagtaggcatgacaaataaataaacatatattgtcaggtgtattattaagtgctatgaagaaaaataggataaagggacagtaatgggtcagaagtgaggacagcattgttttttagatgtgatggactgggaaggtctctgtaagtaacatttgagtaaagtttgcaaagaaatgaggaaggggcatgtaaagatggggaaaagaacgttctagcctgagggactgcaggtacaaaggcactgaagcagaaactgcttatgagtttgacaaacacagggcagacattgtgacgggagtagagttggtaaggggagagtggtaagagatgaggctgaaaaggagataaaggcaggtcacatagagcattgttagtaaatgagaggagtttggatttcattccatgtgcggtggaaactcatcagagagttttaatcaggggagcaacatctgattttcatttttgaagaatattcttgttcctggctacagaataggtcatgtgggaacaaagagggaaacagaggtaccaattaggtggtattacagttgctcaggcaagaaatgatggtggcttgttccagatggtaatggtggaaggagtgagaagagaccagattctggatacattttgaaagtggagtaatcagatttgctgaagattggataagggagaaaagagttgagggtgactctaaggtttttggcctcgtacaaccgggtgaatggtcatacagtttgagtgaaactggtgagaccaggagaaagaaggttgggagatgacatggaatcaagagttcagtttggtgatgtaaacttttgagatttcatttgacatcaatgtggagatgttaggtaggcatttagatatgaattatgagtttacaggaataatggaaactgtatatgtatttgggaatcatcagtatatgtatgatatataaagccatggaactgggtactagttaacacttagaaaatccttatcacactctaagtactttacctgtacaaactaatttaatccttgcaacaactatatgaagttaccccccattttatgggtgcggaaactgaggcactgtgaggttaagtcactggcctatgtaacacacttaaaagtataggagctcacctaggaaggcagcttggctccatagtccatgttcctgtccattatattacactgggtgagactacctagggggagtgagtgtggactctgaaagaaactgacgtggggcactccagcagctagaagctgaagttgagatgaggaggagggtctaacaatggagactatgagggagtagccagagaggtagtgtgacagtcaggagaggcgggtgtcctgtaagatacgtgaagaaggtatttggagaaggaaggcatgtttggatttgacaagcattgctaagtggtcaagaaagacacaggccaacttgaccattggatttgactgtttgatgatggtcagtaaccttgatgagagtggtttcagtggatttgtgtgcattaaagccagactgggcagggcacagtggctcacacctgtaatcctagcactttgggaggccgaggcaggcacatcacctgagatcaggagttcaagaccagcctggccaacatgctgaaaccccttctctactaaaatctaaaaattagccgggatgatggcaggtgcctgtaatcccagctgctcgggaggttgagatgggagaatcgcttgaacccaggagatggtggttgcagtgagccaaggtcgcatcattgcactccagcctggggggctgagcaagactccgtctcggaaaaaaaaaaaaaaaaaaaaa

SEQ ID NO: 21326 - DNA, 985 bp, Homo sapiens
  ENST00000553098
ctggtgagttttcgaggtgactgtgctgtgctcggtgaggggacgcccagagagccctgacccggggtcactccgtcgccgttctcctcttgtctacgtgctggacccgggatttcatgcatcaccctgacagccagtggaagttgcctgatttgaagaggcccagggccgaagatacccagtcatgtgtggaagcagcttcaatgccattttgtgagaggttgagggccccagagggggaagcacaggtgctacctttttacccacacttaagtgacgcaaaatgcccttcaatggcgagaagcagtgtgtgggagaggaccagccaagcgattctgattcttcccggttttccgaaagcatggcttcgctcagtgactatgaatgctccaggcagagctttgcaagtgactcctccagcaaatccagctctcctgcttcaacaagccctccaagggttgtaacatttgatgaagtgatggctacagcaaggaacttatcaaacttgactcttgctcatgagattgctgtaaatgagaactttcaattgaaacaagaggctctcccagaaaagagtttggctggtcgagtgaagcacattgttcaccaggccttctgggacgtcttggattcagaactaaatgctgaccctcctgagtttgaacatgccatcaaactgtttgaagaaatcagagagattcttctctcttttctcactcccggtggcaaccggcttcgcaaccaaatctgtgaagttttggacacagacctcattaggcagcaggctgagcacagtgctgttgacatccaaggcctggccaactatgtcatcagtacgatgggaaagctgtgtgctcccgtgcgagataatgatatcagagagttaaaggctactggcaacatcgtggaggtgctgagacaaatattccatgtcctggacctcatgcaaatggacatggccaattttacaattatgagtctcaga

SEQ ID NO: 21327 - DNA, 534 bp, Homo sapiens
  ENST00000549906
ctgtgctgtgctcggtgaggggacgcccagagagccctgacccggggtcactccgtcgccgttctcctcttgtctacgtgctggacccggtgctacctttttacccacacttaagtgacgcaaaatgcccttcaatggcgagaagcagtgtgtgggagaggaccagccaagcgattctgattcttcccggttttccgaaagcatggcttcgctcagtgactatgaatgctccaggcagagctttgcaagtgactcctccagcaaatccagctctcctgctttgctttatgaacatcttactgcatgaagcctttctggaaagacttttggatatcactggattattggaccaaagtatatagacatttttaaggagaatcttgagtcagacctggcaaaagaaattaacagcagccaccccagcaacaagccctccaagggttgtaacatttgatgaagtgatggctacagcaaggaacttatcaaacttgactcttgctcatgagattgctgtaaatgagaactttcaattga

SEQ ID NO: 21328 - DNA, 625 bp, Homo sapiens
  ENST00000551802
aaggcggggtcaggggccatcaagctcggctcctagttcatgtcttcccactccgcgtccccttgtttgacctcgaactgccgtcccgcgtgggagcggggagcggggcaccgagtggccgccccgcgtgtcggggtggacacggacttcgggcctcggaggccgcttcgccgctgtttaaatcctgctggacaggtgctacctttttacccacacttaagtgacgcaaaatgcccttcaatggcgagaagcagtgtgtgggagaggaccagccaagcgattctgattcttcccggttttccgaaagcatggcttcgctcagtgactatgaatgctccaggcagagctttgcaagtgactcctccagcaaatccagctctcctgcttcaacaagccctccaagggttgtaacatttgatgaagtgatggctacagcaaggaacttatcaaacttgactcttgctcatgagattgctgtaaatgagaactttcaattgaaacaagaggctctcccagaaaagagtttggctggtcgagtgaagcacattgttcaccaggccttctgggacgtcttggattcagaactaaatgctgaccctcctgagtttgaacatgccatcaaact

SEQ ID NO: 21329 - DNA, 1067 bp, Homo sapiens
  ENST00000548428
gggtgaggtcgtgcagactgctgctgcgtccccttgccgggacctttggttaaggggaagaggtggagaaaagccgattgggcctgggctcgaacgctgaaccctcaggtgttgcttgtgcttcccaaagctgctactgtaggtggcaccactgggggtaatagcaatgatttgaggtggcatatggatgaacatagttacttgttttcgttactattaagaaaatctgttccattaagtaagcagtttcacaatgatagagtttccttttaaaataaatatatttaaatgcaaaaatctagtcaagatagagacgcggttactaaattatagtaaaggtaaggagggagacgtagaaatagtcatgaagagtggcactcaaacgacttaagtttgggaaatcttagatggttgtcctgctaccttaactgtgaagaaactggacaagttgtccttgtccccagtgggtgtctcagcacccatggtcaccagcccagtcagggactttgctcttcttacctgccaacggataatgagttaatctcagtggttcccacttgaggaggctccctgccgtggtccttttcctctcttctctagggatttcatgcatcaccctgacagccagtggaagttgcctgatttgaagaggcccagggccgaagatacccagtcatgtgtggaagcagcttcaatgccattttgtgagaggttgagggccccagagggggaagcacaggtgctacctttttacccacacttaagtgacgcaaaatgcccttcaatggcgagaagcagtgtgtgggagaggaccagccaagcgattctgattcttcccggttttccgaaagcatggcttcgctcagtgactatgaatgctccaggcagagctttgcaagtgactcctccagcaaatccagctctcctgcttcaacaagccctccaagggttgtaacatttgatgaagtgatggctacagcaaggaacttatcaaacttgactcttgctcatgagattgctgtaaatgagaactttcaattgaaacaagaggctctcccagaaaagag

SEQ ID NO: 21330 - DNA, 544 bp, Homo sapiens
  ENST00000551228
tggcactcaaacgacttaagtttgggaaatcttagatggttgtcctgctaccttaactgtgaagaaactggacaagttgtccttgtccccagtgggtgtctcagcacccatggtcaccagcccagtcagggactttgctcttcttacctgccaacggataatgagttaatctcagtggttcccacttgaggaggctccctgccgtggtccttttcctctcttctctagggatttcatgcatcaccctgacagccagtggaagttgcctgatttgaagaggcccagggccgaagatacccagtcatgtgtggaagcagcttcaatgccattttgtgagaggttgagggccccagagggggaagcacagtgacctgctatcgtgttggaggctttgcttggagtcatcttcagtcttttctgttgactttacctttgaccagtgattaaatcctccaggtgctacctttttacccacacttaagtgacgcaaaatgcccttcaatggcgagaagcagtgtgtgggagaggaccagccaagcgattc

SEQ ID NO: 21331 - DNA, 389 bp, Homo sapiens
  ENST00000552690
ctgagcacagtgctgttgacatccaaggcctggccaactatgtcatcagtacgatgggaaagctgtgtgctcccgtgcgagataatgatatcagagagttaaaggctactggcaacatcgtggaggtgctgagacaaatattccatgtcctggacctcatgcaaatggacatggccaattttacaattatgagtctcagaccgcaccttcaacgccagttggtggaatatgagagaaccaagttccaggaaattttggaagaaactccaagaactgtgctaagcactattcgtttcttcattcattcaagatatatttattgagtgcctcctgtgtttcagacactgcttaggtgcagtggatactgcagcgaacagaatggaatacag

SEQ ID NO: 21332 - DNA, 3067 bp, Homo sapiens
  ENST00000371505
gtgaggcgagcgccggggctcccggagcggatccctacctgtttcaaggacctgccagtctgagaagcttcttgtcataaggccatccaggggccacgcacccctaccttgccagcctccagcatgcaggataccgtaacgacatcagcattgttggaccccagccactcctcagtctccacccaggacaattcctccactggaggacacacttcaagcacaagcccacagctctcaaagccttcaatcacaccagtccctgcaaagtccaggaacccacatcccagggccaatatccgtcggatgcgccggatcattgctgaggatcctgagtggtcactggccatcgtgcccctcctcacagagctctgcattcagcacattatcaggaacttccagaaaaaccctatcctgaagcagatgctcccggaacaccagcagaaggtcctgaaccacctgtcccctgacctaccactggctgtgaccgccaacctgatagacagtgagaactactggctccgctgctgcatgcatcgctggcccgtgtgccacgtggcccaccatggcggcagctggaaacgcatgttcttcgagcggcacctggagaacctgctaaagcactttatcccaggcaccacagaccctgcggtgatcctcgacctgctgccgctctgccggaattacgtgcgcagggtccacgtcgatcagttccttccgccggtgcagctcccggcccagctccggccgggcgaccagtccgactcaggcagcgagggagagatggaggagcccaccgttgaccactaccaactgggcgatctggtagctggcctgagccacctggaggagctggacctggtgtacgatgtcaaggactgcggcatgaatttcgagtggaatctcttcctcttcacctaccgtgactgcctctccttggcagccgccatcaaggcatgccacaccctcaagatcttcaagctgacccgaagcaaggtggatgatgacaaggcacgcatcataattcgaagccttctggaccacccagtcctcgaggagctggacttgtcacaaaacctcattggagaccgtggtgcacgaggtgctgccaagctgctgagccacagccgcctgcgtgtgctcaacctggctaacaaccaggtgcgtgcacccggtgcccagtccctggctcacgctctggcacacaacaccaacctcatttccctcaacctacgtctcaactgcatcgaggatgagggtggccaggctcttgcccatgccttgcagaccaacaagtgcctcaccacgctgcacctcggtggcaatgagctgtctgagcccaccgccacactcctgtcacaggtgctcgccatcaacaccacactcaccagcatcaacctgtcctgcaaccacatcgggctggacggtgggaagcagctcctggaaggcatgtcagacaacaagaccctcctggaatttgacttgcgcctgtcagatgtggcccaggaaagcgagtacctcattggccaggccctctacgcaaaccgagaagcagcccgccagcgggccctgaatcccagccacttcatgtcaaccataactgccaatggccctgagaactctgtgggataaaatgacctgacttggatcatggccccagccccatccctcatttcatacccctgccatgcctgctgcagagtatcacactggttcagagggagcggggagggggactgtgaataaccttggagtgatcaagggttgtatggatggagacatgaggcagggaagggagcctggcatgggggaagaaagggtatgcagtagggacccagcctttgtgcccagggaaaggatattactggacacccacaaatgaccaacttctttcaggaacagggaagtcagagaggtgtctgagggactgtgcctgccagattctcccgttggggctgcctgcctccctgactccccaccattttcttctctaccaaacagatccttgatcttcaaacacacacacacacacacacacacacacacacacacacacacacacaccctctggctacagcagggctatgcctggctctctctgccaccctcatccctgtagatgcatttccctgttgcttgactctgctttaagtgatccagttctacaggccacgccatcccctagttccccaactcccaacctgggaaggggacaatgagctgacaccaggggctcagacccagtggactcctctggggaggcaactgtagatgacaacttccagggaaggatgacacaatccctgccacccaccccagagagcttccctgggagggagggaaagaagtgccacactgggacaggaagtcagtgagtcatccacgactttattatccaccagtttgatttgtacaatctttgcgcttaaatccacgacaaaaaggccacagtgtgatgcacccaattgacagagacctgtcttctccccagccaggcccagcccaccccacaagcccttgtccccaggacacatggagccttccaggtgccctacatgagtcccccatcactctgtagctgtccaccctggggccacacctacaggaatcacatcagcccccagggccacaagagacctagctgactgattcaggctgagcgccattgcccatcctccttgggctgattcattggcccagagcctccagaactgtgtccccaaagggcaggtcatgggctacaaccccagtccaggagtgcctgctctccagggactccttccgctaagcaggcgctgagcagagcaccaaagggggcttgggagtgactgcatgtgtgtgcctgtctaggcaacctagagtctgtctgtgcctgacaccctctgacagttccggagtgcaaacgtgtaggtgtgagggtgtgtgtgtgtgtgtgtgtgtgtatagccacagctgctagcagaagttctaattagagaaacaagaacattcagtgtaaagtttaattttagagattaattaattttctggttttcattttccctggcaatcagtaaagctaccaagaaaa

SEQ ID NO: 21333 - DNA, 616 bp, Homo sapiens
  ENST00000371504
cgcatgttcttcgagcggcacctggagaacctgctaaagcactttatcccaggcaccacagaccctgcggtgatcctcgacctgctgccgctctgccggaattacgtgcgcagggtccacgtcgatcagttccttccgccggtgcagctcccggcccagctccggccgggcgaccagtccgactcaggcagcgagggagagatggaggagcccaccgttgaccactaccaactgggcgatctggtagctggcctgagccacctggaggagctggacctggtgtacgatgtcaaggactgcggcatgaatttcgagtggaatctcttcctcttcacctaccgtgactgcctctccttggcagccgccatcaaggcatgccacaccctcaaggacggtgggaagcagctcctggaaggcatgtcagacaacaagaccctcctggaatttgacttgcgcctgtcagatgtggcccaggaaagcgagtacctcattggccaggccctctacgcaaaccgagaagcagcccgccagcgggccctgaatcccagccacttcatgtcaaccataactgccaatggccctgagaactctgtgggataaaatgacctgacttgga

SEQ ID NO: 21334 - DNA, 758 bp, Homo sapiens
  ENST00000525663
agagtccagggagagtgcgcgggcggccgccggctgaatgaagcctgggacgcgggagccgcgccgcgcgcagtgtctgcagtgccggaggtctgggaggctccgggcgaagcctccctgctgcaggttatgatgatgtcagacaatgctaaaggcagagcagctcattcatggaagaaaagagggagtatttcttctctaagtaatcatgaattttggcgaaaggaaattcatgggcgcatcaaagattctatgagtactgtgtcttatatggaagaacccagtcagcgtgatgatatctctcgccttacagttcagatggaaaacacctatcagttgggtgtgttcttttatctctcactcctattttaaacttctaaattggtgactgattctcttaaaaatgatatttgataacctggcattgtcttcaattctagcacaatataagggactttaatgaattgagtgatttgatgttgctttagtttcttcctcagcaaaaaggtaacaacacttgctgtcttacttttctttactaatgtttcccaaatgccaaacaattcactgggtggcactgatgcatacagtatactactgacttaacaaattcactgagtatttctgggtacatagatatgacttaaatgaaagagataagtattgatattttatccaacaaaaccaatcagtgttgttaggtgaaggaaaaaaaaaaactcaaagcaaaggcaaatgactcatagtcccctgttgac

SEQ ID NO: 21335 - DNA, 2001 bp, Homo sapiens
  ENST00000282670
gagtccagggagagtgcgcgggcggccgccggctgaatgaagcctgggacgcgggagccgcgccgcgcgcagtgtctgcagtgccggaggtctgggaggctccgggcgaagcctccctgctgcaggttatgatgatgtcagacaatgctaaaggcagagcagctcattcatggaagaaaagagggagtatttcttctctaagtaatcatgaattttggcgaaaggaaattcatgggcgcatcaaagattctatgagtactgtgtcttatatggaagaacccagtcagcgtgatgatatctctcgccttacagttcagatggaaaacacctatcagttgggtcctcccaaacattttcctgtggtcaccgtcaatcatattttgaaagatgtagtaaccagctatctacaagtagaagaatatgaaccagagctctgtagacagatgactaaaaccatttctgaggttattaaagcccaggtcaaggacttgatgattccacggtataaactaattgtgattgttcacattggacaactgaacaggcagagcatacttattggaagcagatgcctctgggatcctaaaagtgataccttttcatcttatgttttcagaaattcttctctcttcgctcttgcaaatgtctatgcagtttaccttgagtgattgaaaataagaaatctagctcttacttttgaaaattctgaggcaggctgtatgtctgtacacaaaagttttactgccaaaaactttgagaaagaaacaacactgatatttcaagcaactggaagcttttgaattttttcatattctagtaaagatttggggaggggagggtagccacagaaagaatcttgtttatctaaagcaggaacttgatcttggttttgctggattgctttccatagacatagattcttattaaatatttgttttggtactaattattttaattattctttaattagagtgttacaatttcctgcattgttttttaataaaaagaagctttagaaaaactatggctatataccctgaccaataaatgatagtagaatattcaacatggtatacacaaatgataaataatgtgcctcagtgctgcatataaaagaatactggttttcattttgtacttaataaattgagcagcattcattaagtgcaattattgttacatgtacctgacagttgaaactgctgaggtagaattaatggcttcataacaattatcgtggtcccacgggctgcaagctaaaactagaagctcttgtggcttgcctgcactttacacaattgtgggagaaccgaaagttggctcttcagtaatggaaactataaagtgaataaaggctttttgggacactgaagtagacattgtgatattaaatatacatgatgcttaatactaaatgtgtctgtaacacataaaatcatttattggaaagagacattgcttttaaatatcctaggctaacaaactttttcacaaaatatatggctggcaccttaacaaataaagcatgtgtagttaccattttactcctatgaatttaatactaaagtgacccagtgaggtttttgaatagacgggtgctaaaatttacagggctgaaatagcttattattctgctggttaatgtatcttacgccacggatcatttatttttatgaagctttcaagtctttgtgtgcaagtaaaatgatgttgtggcgttgttcttggatggtaagtggactgcctagaggacatttgttaaaggtcaaagacaaattgtacacatatggagaaaattagcaatgctgtagtcttaaggaaaaaatgatttatcattcatatcaaaaagagtttagcaaatggaaaaccagttaatgctttaattttaaaatgttttggtgtcttacttttccctaaaaatgacatgtagtaaaaaatggatacttttaaaatcccttcccttctgctattttctggcttttaaagtgattattcaaaatg

SEQ ID NO: 21336 - DNA, 1010 bp, Homo sapiens
  ENST00000528352
aatgaagcctgggacgcgggagccgcgccgcgcgcagtgtctgcagtgccggaggtctgggaggctccgggcgaagcctccctgctgcaggttatgatgatgtcagacaatgctaaaggcagagcagctcattcatggaagaaaagagggagtatttcttctctaagtaatcatgaattttggcgaaaggaaattcatgggcgcatcaaagattctatgagtactgtgtcttatatggaagaacccagtcagcgtgatgatatctctcgccttacagttcagatggaaaacacctatcagttggcacaatataagggactttaatgaattgagtgatttgatgttgctttagtttcttcctcagcaaaaagcattgtattagactctgaggaggataaaatccgagcttgcttaccatttcactggaaacgcaggtcctcccaaacattttcctgtggtcaccgtcaatcatattttgaaagatgtagtaaccagctatctacaagtagaagaatatgaaccagagctctgtagacagatgactaaaaccatttctgaggttattaaagcccaggtcaaggacttgatgattccacggtataaactaattgtgattgttcacattggacaactgaacaggcagagcatacttattggaagcagatgcctctgggatcctaaaagtgataccttttcatcttatgttttcagaaattcttctctcttcgctcttgcaaatgtctatgcagtttaccttgagtgattgaaaataagaaatctagctcttacttttgaaaattctgaggcaggctgtatgtctgtacacaaaagttttactgccaaaaactttgagaaagaaacaacactgatatttcaagcaactggaagcttttgaattttttcatattctagtaaagatttggggaggggagggtagccacagaaagaatcttgtttatctaaagcaggaacttgatcttggttttgctggattgctttccatagacata

SEQ ID NO: 21337 - DNA, 492 bp, Homo sapiens
  ENST00000491611
tgtctgcagtgccggaggtctgggaggctccgggcgaagcctccctgctgcaggttatgatgatgtcagacaatgctaaaggcagagcagctcattcatggaagaaaagagggagtatttcttctctaagtaatcatgaattttggcgaaaggaaattcatgggcgcatcaaagaccctggaagtctgtggattacacatacaatgccttttacaggtgggaaactgactataaaggagtagcaatcccagcacatgtcagaagtaaagctaatttgagttttgtaccacctcttcttctccatgaatttttaatatggtgttcagtagaaaagaaattgagtttttatgaataccttctgtattatgcaattctatgagtactgtgtcttatatggaagaacccagtcagcgtgatgatatctctcgccttacagttcagatggaaaacacctatcagttgggtgtgttcttttatctctcactcctattt

SEQ ID NO: 21338 - DNA, 360 bp, Homo sapiens
  ENST00000448074
ggcacatgttcatgtcatgcaatgacattagtatatgaccaaagtgatgatatggctaatattcctgggatgcaggaggaagaagattcatttgaagcttctcctctgaacgtggatgaaatgtggtcgagaatataagctctagcatcagataaacctgggtgtgcaccccagctctgcctctctgtgtgattctgggcaggttactcaatgtatataaatctctgtttccccacctgccaaatggagataacagtgagattcacctcagagatctattggaagactatataagcattgtattagactctgaggaggataaaatccgagcttgcttaccatttcactggaaacgcaggt

SEQ ID NO: 21339 - DNA, 819 bp, Homo sapiens
  ENST00000489510
ttcaatagagtccacccagaagattaaatccctccatgtttccatactcttttgattagcctatggggtgggtgggtgtgatttgaaattactttttagaaataaattttatgtgtattttcaggtcctcccaaacattttcctgtggtcaccgtcaatcatattttgaaagatgtagtaaccagctatctacaagtagaagaatatgaaccagagctctgtagacagatgactaaaaccatttctgaggttattaaagcccaggtcaaggacttgatgattccacggtataaactaattgtgattgttcacattggacaactgaacaggcagagcatacttattggaagcagatgcctctgggatcctaaaagtgataccttttcatcttatgttttcagaaattcttctctcttcgctcttgcaaatgtctatgcagtttaccttgagtgattgaaaataagaaatctagctcttacttttgaaaattctgaggcaggctgtatgtctgtacacaaaagttttactgccaaaaactttgagaaagaaacaacactgatatttcaagcaactggaagcttttgaattttttcatattctagtaaagatttggggaggggagggtagccacagaaagaatcttgtttatctaaagcaggaacttgatcttggttttgctggattgctttccatagacatagattcttattaaatatttgttttggtactaattattttaattattctttaattagagtgttacaatttcctgcattgttttttaataaaaagaagctttagaaaaactatggctatata

SEQ ID NO: 21340 - DNA, 3040 bp, Homo sapiens
  ENST00000554976
cttaactcgttgagcgcggctggaaatccaagcgcttctaggtgctggttcaatgcctggttcatgatttatttcattctctccctccatcttgcaataggttacttttaatcatttagatctatgacactatgctaaacgttataggagacaaaaagactgtgaacaaacaagaagaaccaaacgaaaagagccaagtccaggattctcgttcagatcagcaagtcattgggatcgagctcctagggcagctactacatctgttatgtcctcaagataatcccagcacctagcactgtgcctggcacaaagtagatcttcaatgaaagaacgaaacgagccgttatatttacacagatgtatttcactcagtcctctggaagagatgcctagtgtgaaagagattccaagaataaataccataaacagcaccgagcccaaatcccacagcaaacatccttattaaaggcaaggaacgtggggcgagttccttttctcagaagattttacgagaacgcaactgttgcgaagaaggaacagacattcgaggttctgagtccaatgggaactcatttaactttttattttgcagcagatttcaaagtctgcacccagcccctcccaggacacaggtctccttgcagctgcctttaacctaagcgtatcctctctccactttaaaccaaacgccgctgcatggagccctgggagcctgagccatgagaatcctgtaaagaggagttggagcacacagctgtattaaaaaggcaaatcgaaggccgggcgcggtgactcacgcctgtcatcctagcactttgggaggccgaggcggctgaatcacttgaggttaggagtttgagatcagcccgggcaacatggtgaaaccccgtctctacaaaaatagaaaaattagccgagcgtgatggtggatgcctgtaatcctagctcctcgggaggctaaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaaccccttccagttttacctcactagagtctctggagttaagccaaagtataactctggagccctccacatcaagggacagtcttatgagtagatgttacaatcgtattccttggataaatgatgcatctgcactttagaaaagtgcccaaggtcgtagagctgatattttatctcctttatttgggacgcttgtttcttcagctcagtttaactactgctttgacgtggactggctcgtaaaacagtatccaccagagttcaggaagaagccaatcctgcttgtgcatggtgataagcgagaggctaaggctcacctccatgcccaggccaagccttacgagaacatctctctctgccaggcaaagttggatattgcgtttggaacacaccacacgaaaatgatgctgctgctctatgaagaaggcctccgggttgtcatacacacctccaacctcatccatgctgactggcaccagaaaactcaagggttcgtaggggcctgctcacttcctggcagtgtgtgtgttgataaagaatatggttgagccccttatacccacgaattgctgatggaacccacaaatctggagagtcgccaacacattttaaagctgatctcatcagttacttgatggcttataatgccccttctctcaaggagtggatagatgtcattcacaagcacgatctctctgaaacaaatgtttatcttattggttcaaccccaggacgctttcaaggaagtcaaaaagataattggggacattttagacttaagaagcttctgaaagaccatgcctcatccatgcctaacgcagagtcctggcctgtcgtaggtcagttttcaagcgttggctccttgggagccgatgaatcaaagtggttatgttctgagtttaaagagagcatgctgacactggggaaggaaagcaagactccaggaaaaagctctgttcctctttacttgatctatccttctgtggaaaatgtgcggaccagtttagaaggatatcctgctgggggctctcttccctatagcatccagacagctgaaaaacagaattggctgcattcctattttcacaaatggtcagctgagacttctggccgcagcaatgccatgccacatattaagacatatatgaggccttctccagacttcagtaaaattgcttggttccttgtcacaagcgcaaatctgtccaaggctgcctggggagcattggagaagaatggcacccagctgatgatccgctcctacgagctcggggtccttttcctcccttcagcatttggtctagacagtttcaaagtgaaacagaagttcttcgctggcagccaggagccaatggccacctttcctgtgccatatgatttgcctccagaactgtatggaagtaaagatcggccatggatatggaacattccttatgtcaaagcaccggatacgcatgggaacatgtgggtgccctcctgagaatcttgaggcactgtgaaatttaagtgtaagacattgagccacaaacatggaatctcttctttgtactggatgtccacttcccttaaagtcttatttgcacccttac

SEQ ID NO: 21341 - DNA, 2370 bp, Homo sapiens
  ENST00000393452
actgcgcgcatgcgcggcggccgccgaaggggcgggatccgaggcaagcgttggttctgtgcgcctcagagttggagcacacagctgtattaaaaaggcaaatcgaaggccgggcgcggtgactcacgcctgtcatcctagcactttgggaggccgaggcggctgaatcacttgaggttaggagtttgagatcagcccgggcaacatggtgaaaccccgtctctacaaaaatagaaaaattagccgagcgtgatggtggatgcctgtaatcctagctcctcgggaggctaaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaaccccttccagttttacctcactagagtctctggagttaagccaaagtataactctggagccctccacatcaaggatattttatctcctttatttgggacgcttgtttcttcagctcagtttaactactgctttgacgtggactggctcgtaaaacagtatccaccagagttcaggaagaagccaatcctgcttgtgcatggtgataagcgagaggctaaggctcacctccatgcccaggccaagccttacgagaacatctctctctgccaggcaaagttggatattgcgtttggaacacaccacacgaaaatgatgctgctgctctatgaagaaggcctccgggttgtcatacacacctccaacctcatccatgctgactggcaccagaaaactcaaggaatatggttgagccccttatacccacgaattgctgatggaacccacaaatctggagagtcgccaacacattttaaagctgatctcatcagttacttgatggcttataatgccccttctctcaaggagtggatagatgtcattcacaagcacgatctctctgaaacaaatgtttatcttattggttcaaccccaggacgctttcaaggaagtcaaaaagataattggggacattttagacttaagaagcttctgaaagaccatgcctcatccatgcctaacgcagagtcctggcctgtcgtaggtcagttttcaagcgttggctccttgggagccgatgaatcaaagtggttatgttctgagtttaaagagagcatgctgacactggggaaggaaagcaagactccaggaaaaagctctgttcctctttacttgatctatccttctgtggaaaatgtgcggaccagtttagaaggatatcctgctgggggctctcttccctatagcatccagacagctgaaaaacagaattggctgcattcctattttcacaaatggtcagctgagacttctggccgcagcaatgccatgccacatattaagacatatatgaggccttctccagacttcagtaaaattgcttggttccttgtcacaagcgcaaatctgtccaaggctgcctggggagcattggagaagaatggcacccagctgatgatccgctcctacgagctcggggtccttttcctcccttcagcatttgcccctgcgaagagaataaaggatgaagtggaggcttcgttctctgggtctagacagtttcaaagtgaaacagaagttcttcgctggcagccaggagccaatggccacctttcctgtgccatatgatttgcctccagaactgtatggaagtaaagatcggccatggatatggaacattccttatgtcaaagcaccggatacgcatgggaacatgtgggtgccctcctgagaatcttgaggcactgtgaaatttaagtgtaagacattgagccacaaacatggaatctcttctttgtactggatgtccacttcccttaaagtcttatttgcacccttacaaaatctttccaaaggtcactcttatgaatggatgttggttatacttttaatggacattaacattcctaataaagtattagtttcttaa

SEQ ID NO: 21342 - DNA, 910 bp, Homo sapiens
  ENST00000554180
gcgcatgcgcggcggccgccgaaggggcgggatccgaggcaagcgttggttctgtgcgcctcaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaaccccttccagttttacctcactagagtctctggagttaagccaaagtataactctggagccctccacatcaaggatattttatctcctttatttgggacgcttgtttcttcagctcagtttaactactgctttgacgtggactggctcgtaaaacagtatccaccagagttcaggaagaagccaatcctgcttgtgcatggtgataagcgagaggctaaggctcacctccatgcccaggccaagccttacgagaacatctctctctgccaggcaaagttggatattgcgtttggaacacaccacacgaaaatgatgctgctgctctatgaagaaggcctccgggttgtcataca

SEQ ID NO: 21343 - DNA, 2068 bp, Homo sapiens
  ENST00000393454
atccgaggcaagcgttggttctgtgcgcctcaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaaccccttccagttttacctcactagagtctctggagttaagccaaagtataactctggagccctccacatcaaggatattttatctcctttatttgggacgcttgtttcttcagctcagtttaactactgctttgacgtggactggctcgtaaaacagtatccaccagagttcaggaagaagccaatcctgcttgtgcatggtgataagcgagaggctaaggctcacctccatgcccaggccaagccttacgagaacatctctctctgccaggcaaagttggatattgcgtttggaacacaccacacgaaaatgatgctgctgctctatgaagaaggcctccgggttgtcatacacacctccaacctcatccatgctgactggcaccagaaaactcaaggaatatggttgagccccttatacccacgaattgctgatggaacccacaaatctggagagtcgccaacacattttaaagctgatctcatcagttacttgatggcttataatgccccttctctcaaggagtggatagatgtcattcacaagcacgatctctctgaaacaaatgtttatcttattggttcaaccccaggacgctttcaaggaagtcaaaaagataattggggacattttagacttaagaagcttctgaaagaccatgcctcatccatgcctaacgcagagtcctggcctgtcgtaggtcagttttcaagcgttggctccttgggagccgatgaatcaaagtggttatgttctgagtttaaagagagcatgctgacactggggaaggaaagcaagactccaggaaaaagctctgttcctctttacttgatctatccttctgtggaaaatgtgcggaccagtttagaaggatatcctgctgggggctctcttccctatagcatccagacagctgaaaaacagaattggctgcattcctattttcacaaatggtcagctgagacttctggccgcagcaatgccatgccacatattaagacatatatgaggccttctccagacttcagtaaaattgcttggttccttgtcacaagcgcaaatctgtccaaggctgcctggggagcattggagaagaatggcacccagctgatgatccgctcctacgagctcggggtccttttcctcccttcagcatttggtctagacagtttcaaagtgaaacagaagttcttcgctggcagccaggagccaatggccacctttcctgtgccatatgatttgcctccagaactgtatggaagtaaagatcggccatggatatggaacattccttatgtcaaagcaccggatacgcatgggaacatgtgggtgccctcctgagaatcttgaggcactgtgaaatttaagtgtaagacattgagccacaaacatggaatctcttctttgtactggatgtccacttcccttaaagtcttatttgcacccttacaaaatctttccaaaggtcactcttatgaatggatgttggttatacttttaatggacattaacattcctaataaagtattagtttcttaattc

SEQ ID NO: 21344 - DNA, 876 bp, Homo sapiens
  ENST00000553617
cgaggcaagcgttggttctgtgcgcctcaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaaccccttccagttttacctcactagagtctctggagttaagccaaagtataactctggagccctccacatcaaggatattttatctcctttatttgggacgcttgtttcttcagctcagtttaactactgctttgacgtggactggctcgtaaaacagtatccaccagagttcaggaagaagccaatcctgcttgtgcatggtgataagcgagaggctaaggctcacctccatgcccaggccaagccttacgagaacatctctctctgccaggcaaagttggatattgcgtttggaacacaccacacgaaaatgatgctgctgctctatgaagaaggcctccgggttgtcatacacacctccaacctcatccatgctgactggcaccagaaaactcaaggaatatggttgagccccttatacccacgaattgctgatggaacccacaaatctggagagtcgccaacacattt

SEQ ID NO: 21345 - DNA, 3702 bp, Homo sapiens
  ENST00000335725
gttggttctgtgcgcctcagagttggagcacacagctgtattaaaaaggcaaatcgaaggccgggcgcggtgactcacgcctgtcatcctagcactttgggaggccgaggcggctgaatcacttgaggttaggagtttgagatcagcccgggcaacatggtgaaaccccgtctctacaaaaatagaaaaattagccgagcgtgatggtggatgcctgtaatcctagctcctcgggaggctaaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaaccccttccagttttacctcactagagtctctggagttaagccaaagtataactctggagccctccacatcaaggatattttatctcctttatttgggacgcttgtttcttcagctcagtttaactactgctttgacgtggactggctcgtaaaacagtatccaccagagttcaggaagaagccaatcctgcttgtgcatggtgataagcgagaggctaaggctcacctccatgcccaggccaagccttacgagaacatctctctctgccaggcaaagttggatattgcgtttggaacacaccacacgaaaatgatgctgctgctctatgaagaaggcctccgggttgtcatacacacctccaacctcatccatgctgactggcaccagaaaactcaaggaatatggttgagccccttatacccacgaattgctgatggaacccacaaatctggagagtcgccaacacattttaaagctgatctcatcagttacttgatggcttataatgccccttctctcaaggagtggatagatgtcattcacaagcacgatctctctgaaacaaatgtttatcttattggttcaaccccaggacgctttcaaggaagtcaaaaagataattggggacattttagacttaagaagcttctgaaagaccatgcctcatccatgcctaacgcagagtcctggcctgtcgtaggtcagttttcaagcgttggctccttgggagccgatgaatcaaagtggttatgttctgagtttaaagagagcatgctgacactggggaaggaaagcaagactccaggaaaaagctctgttcctctttacttgatctatccttctgtggaaaatgtgcggaccagtttagaaggatatcctgctgggggctctcttccctatagcatccagacagctgaaaaacagaattggctgcattcctattttcacaaatggtcagctgagacttctggccgcagcaatgccatgccacatattaagacatatatgaggccttctccagacttcagtaaaattgcttggttccttgtcacaagcgcaaatctgtccaaggctgcctggggagcattggagaagaatggcacccagctgatgatccgctcctacgagctcggggtccttttcctcccttcagcatttggtctagacagtttcaaagtgaaacagaagttcttcgctggcagccaggagccaatggccacctttcctgtgccatatgatttgcctccagaactgtatggaagtaaagatcggccatggatatggaacattccttatgtcaaagcaccggatacgcatgggaacatgtgggtgccctcctgagaatcttgaggcactgtgaaatttaagtgtaagacattgagccacaaacatggaatctcttctttgtactggatgtccacttcccttaaagtcttatttgcacccttacaaaatctttccaaaggtcactcttatgaatggatgttggttatacttttaatggacattaacattcctaataaagtattagtttcttaattcacttttatatgttttggaaagaaaattagtgaacttctctatgttaaaaatacgtactgcttgagtatcccctgtctgaaatgcttgggaccagaagtgtttcagcttttggatttttttgaattttggaatatttgcatagcataatgagatatcttgggaatgggacccaaatctaaacacaaaattcatttatgtttcatatacaccttatatacaataacctaaaggtgattttatatgatattttgagtaattttatgcatgaaacaaagttttgacaggcttttgaccgtgattcatcacatgagttcaggcatggaaattttcatttggagcatcatgtcagcactcaaaaagttctggatcttggagcagttcagattttcagattagggatgctcaaatctatatagatataaaattatcctcacagtaacatagaatctcttggtgctgtcagctgttgggaattgaagattgactttgtgcttccaccctccatccagaaaggcacccttcattccaccagaactttacccaggaagaacacgatcatttcctttttcaccgatgccctctctcagctttctgagtacgtctcttggggtcgctggaggtgatcctaggatctgtctctgagaccaatgtgctgtttcagccccctgcagctaagaattgtattgactgtcctcacagcggcttttcatagctttcagcttcagctttacgaggcttctcctctctccctggcaccctgctggctgcctcactgcttacagacaggtcccaccaaacccaaacacctgcctagggtaaatgggtctctcttctatccccagaaactttcagaggaagcagctcatagaaacatacaaaagcacacaagtattttgggaaaaaatcctaaaaggtgacttaatttgatgccttaaattcacaagtgaggaagctaaggcctagaaggttaaggatgtccccagggtcacacagtgagcggggctcagagcttgagtgtctttgtgctttgtgtacattgtgttctccctagggtgctttagaccctgtttgttttcttctgcatgaggctgatttccagtttgtcatcaacctctttatcttataatttaggatagagttgaacgttagtcttgaaagattttctaaagtagtctttcaaactgttcctcagaggcctaggattttccaaaagtaccttaggaaccttgtaggctgcagtgggggtgtggcgatagagcaggaggcagggagacagggctgcagggcctcccaccttccaacagacaggctctgctgtatctgttgtacatactgggattctgtaaaggacattatctggggtgttgtatgtatttttgtgtgttctgctttttttaaataaacttgaaaagctactgaactaa

SEQ ID NO: 21346 - DNA, 524 bp, Homo sapiens
  ENST00000555565
gttctgtgcgcctcagagttggagcacacagctgtattaaaaaggcaaatcgaaggccgggcgcggtgactcacgcctgtcatcctagcactttgggaggccgaggcggctgaatcacttgaggttaggagtttgagatcagcccgggcaacatggtgaaaccccgtctctacaaaaatagaaaaattagccgagcgtgatggtggatgcctgtaatcctagctcctcgggaggctaagatattttatctcctttatttgggacgcttgtttcttcagctcagtttaactactgctttgacgtggactggctcgtaaaacagtatccaccagagttcaggaagaagccaatcctgcttgtgcatggtgataagcgagaggctaaggctcacctccatgcccaggccaagccttacgagaacatctctctctgccaggcaaagttggatattgcgtttggaacacaccacacgaaaatgatgctgctgctctatgaagaaggcctccgggttgtcatacacacct

SEQ ID NO: 21347 - DNA, 748 bp, Homo sapiens
  ENST00000556867
cgcggactcggtgcggtctctcgcgggctgcggtcgggcccgggatcctgctcctggccgagtcgcggtgcgcgggctgctggggtccggcagggctggaggcggaccgcgaggaagcggcgcggccgggaagatggggcagggtcgcctcggccccggggcctcggtttcctccgatcacagcgcctcagggggcgcgcacgggcgctgcggagacctgtgtcctgccggggcgcggcgctaggggcccctgctcgggtttttattcccagacctaagcttacaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggcca

SEQ ID NO: 21348 - DNA, 879 bp, Homo sapiens
  ENST00000553569
ctctcgcgggctgcggtcgggcccgggatcctgctcctggccgagtcgcggtgcgcgggctgctggggtccggcagggctggaggcggaccgcgaggaagcggcgcggccgggaagatggggcagggtcgcctcggccccggggcctcggtttcctccgatcacagcgcctcagggggcgcgcacgggcgctgcggagacctgtgtcctgccggggcgcggcgctaggggcccctgctcgggtttttattcccagacctaagcttacagagttggagcacacagctgtattaaaaaggcaaatcgaaggccgggcgcggtgactcacgcctgtcatcctagcactttgggaggccgaggcggctgaatcacttgaggttaggagtttgagatcagcccgggcaacatggtgaaaccccgtctctacaaaaatagaaaaattagccgagcgtgatggtggatgcctgtaatcctagctcctcgggaggctaaggtaggagaattgcttgaacctgggaggcagagaggttggagtgagccgagattgcgccattgcgctccagcctgagcggcagagcgagactctgtctcaaaaaaataaatgtaaatcggactccccttcttaaagccctcagtggggtcccattgatcattgcataaaatccaatttctttaacaagtcttctcccctcacccgcttcggaccactgcctgccttgcctaagtcctttcttatgacctctttcccacctctgccggctgggttccctctacttgggaatgctcttcaccccatcatttagacagcaggttccttttggccctctgggtctcatttatatgttactttttaagtatattccaaaggtcacccctattt

SEQ ID NO: 21349 - DNA, 910 bp, Homo sapiens
  ENST00000553527
atcctgctcctggccgagtcgcggtgcgcgggctgctggggtccggcagggctggaggcggaccgcgaggaagcggcgcggccgggaagatggggcagggtcgcctcggccccggggcctcggtttcctccgatcacagcgcctcagggggcgcgcacgggcgctgcggagacctgtgtcctgccggggcgcggcgctaggggcccctgctcgggtttttattcccagacctaagcttacagagttggagcacacagctgtattaaaaaggcaaatcgaaggccgggcgcggtgactcacgcctgtcatcctagcactttgggaggccgaggcggctgaatcacttgaggttaggagtttgagatcagcccgggcaacatggtgaaaccccgtctctacaaaaatagaaaaattagccgagcgtgatggtggatgcctgtaatcctagctcctcgggaggctaaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgag

SEQ ID NO: 21350 - DNA, 728 bp, Homo sapiens
  ENST00000553989
aacgccttcagcaagagccctctcacttcctttgtcttcaacccattctccgcagagttggagcacacagctgtattaaaaaggcaaatcgaaggccgggcgcggtgactcacgcctgtcatcctagcactttgggaggccgaggcggctgaatcacttgaggttaggagtttgagatcagcccgggcaacatggtgaaaccccgtctctacaaaaatagaaaaattagccgagcgtgatggtggatgcctgtaatcctagctcctcgggaggctaaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatc

SEQ ID NO: 21351 - DNA, 2488 bp, Homo sapiens
  ENST00000545686
ccattctccgcagagttggagcacacagctgtattaaaaaggcaaatcgaaggccgggcgcggtgactcacgcctgtcatcctagcactttgggaggccgaggcggctgaatcacttgaggttaggagtttgagatcagcccgggcaacatggtgaaaccccgtctctacaaaaatagaaaaattagccgagcgtgatggtggatgcctgtaatcctagctcctcgggaggctaaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaaccccttccagttttacctcactagagtctctggagttaagccaaagtataactctggagccctccacatcaaggatattttatctcctttatttgggacgcttgtttcttcagctcagtttaactactgctttgacgtggactggctcgtaaaacagtatccaccagagttcaggaagaagccaatcctgcttgtgcatggtgataagcgagaggctaaggctcacctccatgcccaggccaagccttacgagaacatctctctctgccaggcaaagttggatattgcgtttggaacacaccacacgaaaatgatgctgctgctctatgaagaaggcctccgggttgtcatacacacctccaacctcatccatgctgactggcaccagaaaactcaaggaactcacctgtgagtgaatctctgatccaggaggagcctcactcagcctgggaactttgaggtgctattgcaaggggaggtcctccacgtctgtccagcccaacctggtcattttacacacggaggcaaaggcccagagagatcacagagcttacccaaaatgaatatggttgagccccttatacccacgaattgctgatggaacccacaaatctggagagtcgccaacacattttaaagctgatctcatcagttacttgatggcttataatgccccttctctcaaggagtggatagatgtcattcacaagcacgatctctctgaaacaaatgtttatcttattggttcaaccccaggacgctttcaaggaagtcaaaaagataattggggacattttagacttaagaagctttgcataattatcaaagcaggaaatgcagatcagtcttctgcagtgttttagctgcttctgaaagaccatgcctcatccatgcctaacgcagagtcctggcctgtcgtaggtcagttttcaagcgttggctccttgggagccgatgaatcaaagtggttatgttctgagtttaaagagagcatgctgacactggggaaggaaagcaagactccaggaaaaagctctgttcctctttacttgatctatccttctgtggaaaatgtgcggaccagtttagaaggatatcctgctgggggctctcttccctatagcatccagacagctgaaaaacagaattggctgcattcctattttcacaaatggtcagctgagacttctggccgcagcaatgccatgccacatattaagacatatatgaggccttctccagacttcagtaaaattgcttggttccttgtcacaagcgcaaatctgtccaaggctgcctggggagcattggagaagaatggcacccagctgatgatccgctcctacgagctcggggtccttttcctcccttcagcatttggtctagacagtttcaaagtgaaacagaagttcttcgctggcagccaggagccaatggccacctttcctgtgccatatgatttgcctccagaactgtatggaagtaaagatcggccatggatatggaacattccttatgtcaaagcaccggatacgcatgggaacatgtgggtgccctcctgagaatcttgaggcactgtgaaatttaagtgtaagacattgagccacaaacatggaatctcttctttgtactggatgtccacttcccttaaagtcttatttgcacccttacaaaatctttccaaaggtcactcttatgaatggatgttggttatacttttaatggacattaacattcctaataaagtattagtttcttaa

SEQ ID NO: 21352 - DNA, 2200 bp, Homo sapiens
  ENST00000555178
ccgcagagttggagcacacagctgtattaaaaaggcaaatcgaaggccgggcgcggtgactcacgcctgtcatcctagcactttgggaggccgaggcggctgaatcacttgaggttaggagtttgagatcagcccgggcaacatggtgaaaccccgtctctacaaaaatagaaaaattagccgagcgtgatggtggatgcctgtaatcctagctcctcgggaggctaaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaaccccttccagttttacctcactagagtctctggagttaagccaaagtataactctggagccctccacatcaaggatattttatctcctttatttgggacgcttgtttcttcagctcagtttaactactgctttgacgtggactggctcgtaaaacagtatccaccagagttcaggaagaagccaatcctgcttgtgcatggtgataagcgagaggctaaggctcacctccatgcccaggccaagccttacgagaacatctctctctgccaggaaaatgatgctgctgctctatgaagaaggcctccgggttgtcatacacacctccaacctcatccatgctgactggcaccagaaaactcaaggaatatggttgagccccttatacccacgaattgctgatggaacccacaaatctggagagtcgccaacacattttaaagctgatctcatcagttacttgatggcttataatgccccttctctcaaggagtggatagatgtcattcacaagcacgatctctctgaaacaaatgtttatcttattggttcaaccccaggacgctttcaaggaagtcaaaaagataattggggacattttagacttaagaagcttctgaaagaccatgcctcatccatgcctaacgcagagtcctggcctgtcgtaggtcagttttcaagcgttggctccttgggagccgatgaatcaaagtggttatgttctgagtttaaagagagcatgctgacactggggaaggaaagcaagactccaggaaaaagctctgttcctctttacttgatctatccttctgtggaaaatgtgcggaccagtttagaaggatatcctgctgggggctctcttccctatagcatccagacagctgaaaaacagaattggctgcattcctattttcacaaatggtcagctgagacttctggccgcagcaatgccatgccacatattaagacatatatgaggccttctccagacttcagtaaaattgcttggttccttgtcacaagcgcaaatctgtccaaggctgcctggggagcattggagaagaatggcacccagctgatgatccgctcctacgagctcggggtccttttcctcccttcagcatttggtctagacagtttcaaagtgaaacagaagttcttcgctggcagccaggagccaatggccacctttcctgtgccatatgatttgcctccagaactgtatggaagtaaagatcggccatggatatggaacattccttatgtcaaagcaccggatacgcatgggaacatgtgggtgccctcctgagaatcttgaggcactgtgaaatttaagtgtaagacattgagccacaaacatggaatctcttctttgtactggatgtccacttcccttaaagtcttatttgcacccttacaaaatctttccaaaggtcactcttatgaatggatgttggttatacttttaatggacattaaca

SEQ ID NO: 21353 - DNA, 597 bp, Homo sapiens
  ENST00000556498
gggttatagctctatttgcactcgctgtttagctggtccgaatttcttgtcctgcgtccaagaataatgaggttaggctgacaaccgaaggggaaaagggcggaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaa

SEQ ID NO: 21354 - DNA, 1894 bp, Homo sapiens
  ENST00000555880
caggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaaccccttccagttttacctcactagagtctctggagttaagccaaagtataactctggagccctccacatcaaggatattttatctcctttatttgggacgcttgtttcttcagctcagtttaactactgctttgacgtggactggctcgtaaaacagtatccaccagagttcaggaagaagccaatcctgcttgtgcatggtgataagcgagaggctaaggctcacctccatgcccaggccaagccttacgagaacatctctctctgccaggcaaagttggatattgcgtttggaacacaccacacgaaaatgatgctgctgctctatgaagaaggcctccgggttgtcatacacacctccaacctcatccatgctgactggcaccagaaaactcaaggaatatggttgagccccttatacccacgaattgctgatggaacccacaaatctggagagtcgccaacacattttaaagctgatctcatcagttacttgatggcttataatgccccttctctcaaggagtggatagatgtcattcacaagcacgatctctctgaaacaaatgtttatcttattggttcaaccccaggacgctttcaaggaagtcaaaaagataattggggacattttagacttaagaagcttctgaaagaccatgcctcatccatgcctaacgcagagtcctggcctgtcgtaggtcagttttcaagcgttggctccttgggagccgatgaatcaaagtggttatgttctgagtttaaagagagcatgctgacactggggaaggaaagcaagactccaggaaaaagctctgttcctctttacttgatctatccttctgtggaaaatgtgcggaccagtttagaaggatatcctgctgggggctctcttccctatagcatccagacagctgaaaaacagaattggctgcattcctattttcacaaatggtcagctgagacttctggccgcagcaatgccatgccacatattaagacatatatgaggccttctccagacttcagtaaaattgcttggttccttgtcacaagcgcaaatctgtccaaggctgcctggggagcattggagaagaatggcacccagctgatgatccgctcctacgagctcggggtccttttcctcccttcagcatttatcggccatggatatggaacattccttatgtcaaagcaccggatacgcatgggaacatgtgggtgccctcctgagaatcttgaggcactgtgaaatttaagtgtaagacattgagccacaaacatggaatctcttctttgtactggatgtccacttcccttaaagtcttatttgcacccttacaaaatctttccaaaggtcactcttatgaatggatgttggttatacttttaatggaca

SEQ ID NO: 21355 - DNA, 318 bp, Homo sapiens
  ENST00000557782
gcaaagttggatattgcgtttggaacacaccacacgaaaatgatgctgctgctctatgaagaaggcctccgggttgtcatacacacctccaacctcatccatgctgactggcaccagaaaactcaaggccattttgtacatctctgcctgtgctagagaagagctggttaacaaacagccttctgtgttgggagaaactcggacgtttgtctagcaccatttccagaactcacctgtgagtgaatctctgatccaggaggagcctcactcagcctgggaactttgaggtgctattgcaaggggaggtcctccacgtct

SEQ ID NO: 21356 - DNA, 1076 bp, Homo sapiens
  ENST00000556063
acgctttcaaggaagtcaaaaagataattggggacattttagacttaagaagcttctgaaagaccatgcctcatccatgcctaacgcagagtcctggcctgtcgtaggtcagttttcaagcgttggctccttgggagccgatgaatcaaagtggttatgttctgagtttaaagagagcatgctgacactggggaaggaaagcaagactccaggaaaaagctctgttcctctttacttgatctatccttctgtggaaaatgtgcggaccagtttagaaggatatcctgctgggggctctcttccctatagcatccagacagctgaaaaacagaattggctgcattcctattttcacaaatggtcagctgagacttctggccgcagcaatgccatgccacatattaagacatatatgaggccttctccagacttcagtaaaattgcttggttccttgtcacaagcgcaaatctgtccaaggctgcctggggagcattggagaagaatggcacccagctgatgatccgctcctacgagctcggggtccttttcctcccttcagcatttggtctagacagtttcaaagtgaaacagaagttcttcgctggcagccaggagccaatggccacctttcctgtgccatatgatttgcctccagaactgtatggaagtaaaggtgagacacagataaaggaaaaccacgggtggatatgcataagaaaaacaaacagagcccaggagaagcctttggtctcagtgggatcctggctcatggaaccctctggaagctcaagtttgcagagggccctttgccagcctgtctggggccttgtagccactggttagtcttggaatccctttgcactcctataattactatacagatccttcctgacttacactggggctacatgctgataaacccctcatgaattgaaaatatcataagtcaaaaatgcatttaatgcgtcaaatctactgagcaccatagcttagtctagcctaccctaaacatgatcagacctcttaaattagtctacacttgggcaaaataaatcaaagactgttttataataaa

SEQ ID NO: 21357 - DNA, 2544 bp, Homo sapiens
  ENST00000527636
ggccgcgtccaggcacaggccatgcagtgacgcccccccacccctccacctttgcccggagcgcgggcagcagcccagcgcgccagccggccccggggcaggagcggtgctaggcaggggtggggtggccgggcccagggaccgggagccggggagggagccgggcaccgagcagagggcgggggaagcggcgccgaagtttgcctcggactcgccgggcgctgcggtggctccctgggccgaggactgttgctgccgctgccgccgccgcttcattgcacattcaagtggaaaattttcaggagtcagcagaaacattgtgtccaaaaaagactgagtcgcagttaccaccaaacccaggaggagactctccctggaaaacttcccttccctttcggtttattttcttgaaaaggctccaggcttcggcttggaaaatcccaccgccaaaattgagcccagcagctggagcggcagtgagagccctgccgaaaacatggaaaggatgagtgactctgcagataagccaattgacaatgatgcagaaggggtctggagccccgacatcgagcaaagctttcaggaggccctggctatctatccaccatgtgggaggaggaaaatcatcttatcagacgaaggcaaaatgtatggtaggaatgaattgatagccagatacatcaaactcaggacaggcaagacgaggaccagaaaacaggtgtctagtcacattcaggttcttgccagaaggaaatctcgtgattttcattccaagctaaaggatcagactgcaaaggataaggccctgcagcacatggcggccatgtcctcagcccagatcgtctcggccactgccattcataacaagctggggctgcctgggattccacgcccgaccttcccaggggcgccggggttctggccgggaatgattcaaacagggcagccaggatcctcacaagacgtcaagccttttgtgcagcaggcctaccccatccagccagcggtcacagcccccattccagggtttgagcctgcatcggccccagctccctcagtccctgcctggcaaggtcgctccattggcacaaccaagcttcgcctggtggaattttcagcttttctcgagcagcagcgagacccagactcgtacaacaaacacctcttcgtgcacattgggcatgccaaccattcttacagtgacccattgcttgaatcagtggacattcgtcagatttatgacaaatttcctgaaaagaaaggtggcttaaaggaactgtttggaaagggccctcaaaatgccttcttcctcgtaaaattctgggctgatttaaactgcaatattcaagatgatgctggggctttttatggtgtaaccagtcagtacgagagttctgaaaatatgacagtcacctgttccaccaaagtttgctcctttgggaagcaagtagtagaaaaagtagagacggagtatgcaaggtttgagaatggccgatttgtataccgaataaaccgctccccaatgtgtgaatatatgatcaacttcatccacaagctcaaacacttaccagagaaatatatgatgaacagtgttttggaaaacttcacaattttattggtggtaacaaacagggatacacaagaaactctactctgcatggcctgtgtgtttgaagtttcaaatagtgaacacggagcacaacatcatatttacaggcttgtaaaggactgaacatggttatttatatatatagatatctgtatatacacacacacatatgtgcacacacacactctctctccattatcgaacgactgactgtaaacctcaccacacagggtggtgccctggccccgaggtcaccccgacttttctaaatcttgtttgagtgaagtcattttttcatgtgttcatactatcattgtagctgtgaagttctggtacagttgtaaaaagagaaattgagttgtttctctatgttcttcagatgtgcagcccacaattcctcgggaaaggtgaacctgaacaacccaagtctctctctgcagagccctgtttctaattgtggtagaaaatattgagacagagcatttgccatgggacatttacagcctttatacaaatgtatttagttctcttttttccaacataaaattcttgttttaagatacaagtaaaattaatctttaaatataaatgtaaattagtacacaaaactaagaatctttagacttatctttgtaactaattagggtggaagttatgaaagaatgtaattcactaaattattttttaaatgaaacctttttttttctttttgaaaccaaatgttaaactatagccttaagaaatgcttggtagaagtgtcctaatgagacaaatttgtacttttatcctcaaggttaacactaatctcctaatccattaaactcttgaacaggtattacaaaggaagaaaacttcaccccttatccttaacatatatagtatatttaaaaaatataaaattgtattgtactaatgtgatgatggattatttaatg

SEQ ID NO: 21358 - DNA, 477 bp, Homo sapiens
  ENST00000527376
gtgacgcccccccacccctccacctttgcccggagcgcgggcagcagcccagcgcgccagccggccccggggcaggagcggtgctaggcaggggtggggtggccgggcccagggaccgggagccggggagggagccgggcaccgagcagagggcgggggaagcggcgccgaagtttgcctcggactcgccgggcgctgcggtggctccctgggccgaggtttattttcttgaaaaggctccaggcttcggcttggaaaatcccaccgccaaaattgagcccagcagctggagcggcagtgagagccctgccgaaaacatggaaaggatgagtgactctgcagataagccaattgacaatgatgcagaaggggtctggagccccgacatcgagcaaagctttcaggaggccctggctatctatccaccatgtgggaggaggaaaatcatcttatcagacgaaggcaaaatgtatggta

SEQ ID NO: 21359 - DNA, 3063 bp, Homo sapiens
  ENST00000527575
tcgcagttaccaccaaacccaggaggagactctccctggaaaacttcccttccctttcggtttattttcttgaaaaggctccaggcttcggcttggaaaatcccaccgccaaaattgagcccagcagctggagcggcagtgagagccctgccgaaaacatggaaaggatgagtgactctgcagataagccaattgacaatgatgcagaaggggtctggagccccgacatcgagcaaagctttcaggaggccctggctatctatccaccatgtgggaggaggaaaatcatcttatcagacgaaggcaaaatgtatggtaggaatgaattgatagccagatacatcaaactcaggacaggcaagacgaggaccagaaaacaggtgtctagtcacattcaggttcttgccagaaggaaatctcgtgattttcattccaagctaaaggatcagactgcaaaggataaggccctgcagcacatggcggccatgtcctcagcccagatcgtctcggccactgccattcataacaagctggggctgcctgggattccacgcccgaccttcccaggggcgccggggttctggccgggaatgattcaaacagggcagccaggatcctcacaagacgtcaagccttttgtgcagcaggcctaccccatccagccagcggtcacagcccccattccagggtttgagcctgcatcggccccagctccctcagtccctgcctggcaaggtcgctccattggcacaaccaagcttcgcctggtggaattttcagcttttctcgagcagcagcgagacccagactcggctgatttaaactgcaatattcaagatgatgctggggctttttatggtgtaaccagtcagtacgagagttctgaaaatatgacagtcacctgttccaccaaagtttgctcctttgggaagcaagtagtagaaaaagtagagacggagtatgcaaggtttgagaatggccgatttgtataccgaataaaccgctccccaatgtgtgaatatatgatcaacttcatccacaagctcaaacacttaccagagaaatatatgatgaacagtgttttggaaaacttcacaattttattggtggtaacaaacagggatacacaagaaactctactctgcatggcctgtgtgtttgaagtttcaaatagtgaacacggagcacaacatcatatttacaggcttgtaaaggactgaacatggttatttatatatatagatatctgtatatacacacacacatatgtgcacacacacactctctctccattatcgaacgactgactgtaaacctcaccacacagggtggtgccctggccccgaggtcaccccgacttttctaaatcttgtttgagtgaagtcattttttcatgtgttcatactatcattgtagctgtgaagttctggtacagttgtaaaaagagaaattgagttgtttctctatgttcttcagatgtgcagcccacaattcctcgggaaaggtgaacctgaacaacccaagtctctctctgcagagccctgtttctaattgtggtagaaaatattgagacagagcatttgccatgggacatttacagcctttatacaaatgtatttagttctcttttttccaacataaaattcttgttttaagatacaagtaaaattaatctttaaatataaatgtaaattagtacacaaaactaagaatctttagacttatctttgtaactaattagggtggaagttatgaaagaatgtaattcactaaattattttttaaatgaaacctttttttttctttttgaaaccaaatgttaaactatagccttaagaaatgcttggtagaagtgtcctaatgagacaaatttgtacttttatcctcaaggttaacactaatctcctaatccattaaactcttgaacaggtattacaaaggaagaaaacttcaccccttatccttaacatatatagtatatttaaaaaatataaaattgtattgtactaatgtgatgatggattatttaatgaaaaagaaaaaatggctctttttgcaataagtagatacatactgaaaaaatctaaacttacaatgtttatagtcttgtgtgtgcagttatattttatatggacgaccaaattttttattaagatgagtaaatatttgaaccactgaattttaataacaaaattttaaaattggcatgaatacggaatactgcactgtgagatgcaaagtatacagaatctgtggctgggagaaaatttcatcaaatagacaagtaaaaggctcatcagttttagcatctctgctccccagaaaattgtaagcatcctcaccagcctgtggatacattctttatttctagtgacccaatatgcatattaacctgctataactagggctatatgtgtaggtatgtgtatacatatacacaaatgcacatatagagttaacacatttagtgaacacttgtttagtgtcactcagtttgctaggtgctgatatgtacgtatatctcaatgtgtctgtagacttagatacatcctcttgaagcacatccatttctttagcgtctctcagtaagttacagtacttgtttgacttaggtttaagaggcccagctacctatctctgaccttttcaaataggctcatttgggagattcttttgccaggagagattcaactttccaatctaagtattccagagcattgcccaggcagagttggtttgatgtggccagatgttttgagttatttcccttaagtgtttcactggggagagaacagggagtgctcctccagcttcccaaagaaatatgtttttgtaagtggtaggaacatgtgcacacaatagaacatgaaataagttttttaacttgtaaaacatgtcaagatttttccaccaagctagaaaataaaaaacttagttctaccacatccaattaacttacacacccccttccctgtctcaacacctgctttgaccctgcttttctattattacatcagtcagcatcttgtggtccctaacatgaggatgtggctggctcgtggg

SEQ ID NO: 21360 - DNA, 1134 bp, Homo sapiens
  ENST00000525312
aaagacgtttaaaaaccccagcttgactctggcgggctgagggtgctgccgtgccactgctgcaggatggagctctcttcctggtggagacttgattcacaaggacgctaattattcattcttcctccgtgcagcccgctgaaacaattgctgtgcttgttcggtgcacagtgtggcgtcggacagtcaggcctttttatgtaactgatggcgctgtaggaatgaattgatagccagatacatcaaactcaggacaggcaagacgaggaccagaaaacaggtgtctagtcatatacaggtcttagcaagaaagaaagttcgagaaattcaagccgccattaaggtacgtctggcttgcccacttgtagggggcttttcatctccatggttacaggcttttcctttgttttcctcccttcccctaccctgcaggtgtctagtcacattcaggttcttgccagaaggaaatctcgtgattttcattccaagctaaaggtatgcgcttttctgctttttggcttgtggttgctatgcatctcacttcctgttttccatggtgactggtgaatgcctggtgctgggattctcgtaacctagtttccttgcatgtgagagctgtttacatttctttgtgtttaatctctctgtttctgtactagcctcacattaaactcaatgtgtgtgagcgcgtgtgtgtgtttgcgtgtgtgtgtgcgtgtgtatgtgtgtgttcctaataacaatgcaaatgcagcagagagctggtcttgataacttttcagcacagaaacatgattttttttttttaaccttcagatgtccaccaagcagccatgggctaggaaagcttaaaaaaagaaaagtccagagatgcaaaattgagtagaaattatttagaaagaatcatttccaaagtggtcatgaaattacctttttaaaaaatttagaaattattttaactcatgcttttgatgtatttttaagaagacttataaaaaatacgtctttttcatgcatgtctcttccctcagagtattttcagccagatttcttccacattgcttactactgttttttaagtgaatggcgctcttattaaaagagaaatctgagcagtggcctttaaaaaaaaaa

SEQ ID NO: 21361 - DNA, 8477 bp, Homo sapiens
  ENST00000526600
tgagaggcttcacattctgttggaaaatggatttaatccctaaaaaaagccttgccccattgggtcttcccagtaaatgttgagaggtacggtaggttgagtgtggtttagccttctggctgtgttatttatccatgcatgtttgctttttttggcctattttgtggctctgtattttagtccatgtgctcgtggctgtgcctgtgtaacctgcctggtagccatgcgttatgtattaagttggtgtgtcactgtcaccttcaaggatcagactgcaaaggataaggccctgcagcacatggcggccatgtcctcagcccagatcgtctcggccactgccattcataacaagctggggctgcctgggattccacgcccgaccttcccaggggcgccggggttctggccgggaatgattcaaacagggcagccaggatcctcacaagacgtcaagccttttgtgcagcaggcctaccccatccagccagcggtcacagcccccattccagggtttgagcctgcatcggccccagctccctcagtccctgcctggcaaggtcgctccattggcacaaccaagcttcgcctggtggaattttcagcttttctcgagcagcagcgagacccagactcgtacaacaaacacctcttcgtgcacattgggcatgccaaccattcttacagtgacccattgcttgaatcagtggacattcgtcagatttatgacaaatttcctgaaaagaaaggtggcttaaaggaactgtttggaaagggccctcaaaatgccttcttcctcgtaaaattctgggctgatttaaactgcaatattcaagatgatgctggggctttttatggtgtaaccagtcagtacgagagttctgaaaatatgacagtcacctgttccaccaaagtttgctcctttgggaagcaagtagtagaaaaagtagagacggagtatgcaaggtttgagaatggccgatttgtataccgaataaaccgctccccaatgtgtgaatatatgatcaacttcatccacaagctcaaacacttaccagagaaatatatgatgaacagtgttttggaaaacttcacaattttattggtggtaacaaacagggatacacaagaaactctactctgcatggcctgtgtgtttgaagtttcaaatagtgaacacggagcacaacatcatatttacaggcttgtaaaggactgaacatggttatttatatatatagatatctgtatatacacacacacatatgtgcacacacacactctctctccattatcgaacgactgactgtaaacctcaccacacagggtggtgccctggccccgaggtcaccccgacttttctaaatcttgtttgagtgaagtcattttttcatgtgttcatactatcattgtagctgtgaagttctggtacagttgtaaaaagagaaattgagttgtttctctatgttcttcagatgtgcagcccacaattcctcgggaaaggtgaacctgaacaacccaagtctctctctgcagagccctgtttctaattgtggtagaaaatattgagacagagcatttgccatgggacatttacagcctttatacaaatgtatttagttctcttttttccaacataaaattcttgttttaagatacaagtaaaattaatctttaaatataaatgtaaattagtacacaaaactaagaatctttagacttatctttgtaactaattagggtggaagttatgaaagaatgtaattcactaaattattttttaaatgaaacctttttttttctttttgaaaccaaatgttaaactatagccttaagaaatgcttggtagaagtgtcctaatgagacaaatttgtacttttatcctcaaggttaacactaatctcctaatccattaaactcttgaacaggtattacaaaggaagaaaacttcaccccttatccttaacatatatagtatatttaaaaaatataaaattgtattgtactaatgtgatgatggattatttaatgaaaaagaaaaaatggctctttttgcaataagtagatacatactgaaaaaatctaaacttacaatgtttatagtcttgtgtgtgcagttatattttatatggacgaccaaattttttattaagatgagtaaatatttgaaccactgaattttaataacaaaattttaaaattggcatgaatacggaatactgcactgtgagatgcaaagtatacagaatctgtggctgggagaaaatttcatcaaatagacaagtaaaaggctcatcagttttagcatctctgctccccagaaaattgtaagcatcctcaccagcctgtggatacattctttatttctagtgacccaatatgcatattaacctgctataactagggctatatgtgtaggtatgtgtatacatatacacaaatgcacatatagagttaacacatttagtgaacacttgtttagtgtcactcagtttgctaggtgctgatatgtacgtatatctcaatgtgtctgtagacttagatacatcctcttgaagcacatccatttctttagcgtctctcagtaagttacagtacttgtttgacttaggtttaagaggcccagctacctatctctgaccttttcaaataggctcatttgggagattcttttgccaggagagattcaactttccaatctaagtattccagagcattgcccaggcagagttggtttgatgtggccagatgttttgagttatttcccttaagtgtttcactggggagagaacagggagtgctcctccagcttcccaaagaaatatgtttttgtaagtggtaggaacatgtgcacacaatagaacatgaaataagttttttaacttgtaaaacatgtcaagatttttccaccaagctagaaaataaaaaacttagttctaccacatccaattaacttacacacccccttccctgtctcaacacctgctttgaccctgcttttctattattacatcagtcagcatcttgtggtccctaacatgaggatgtggctggctcgtgggaaacagcaaaacactaagcctgacctctcccaaattgggaagaccagaggagaaagtgcaaaactgtccccatttggaatgcccattccttctagaaaccagttggacagtgctcctctgcccttcataaacagactactgttgggtccctgattccaggctggcctgtgaaggattgccccaggtgtcccctttcacggttgtcacatttacagtgacttctgttgaacacccctcttagggatgtttcttttgctcttatttcctgcatctttccttaagggaagccccatcctctcccaggaccaggagtttatgaccaggcgagcacaaatggctaaaagccaagctgtcctagaacttcagtgggagagctgtctggttcatattctacccaggaatggtacttttcagtgcagccaggagggctcttgggatttcctttccaaagcacaaaaatactgggacccaagaagaacagctagaggacaactctgttggcacagagacggggacagcccagtctgctgacctcacagggtcagctgggcccccctggtgcttcaccacctgcatcctcttgctcagaatgcctttgcagttgagttttctgggtttctatgattgaccttgaggtttactccttgctcttacaacatttctaaggatttttaaaagtttacttcttgtcttgttcttctaaagctttctccaggacagatattttccctgtcttaaccactggtccagtcatcccagtgggcttctctttgtctctcccagattagacctttgggtgagattggcatcacaacatctaatctgagtctgtcttttgtccttcattctgtatggcagtctccctttgttataaaagctttctaaagcatactaaagaagccttcccagagccccgtcttgcttctcttccaggtgctctatcccctcgagaccctctggtgccaggcttgcttcacggccatcttgtgttgtcactgcagagtttggaggccagttttccacagcctaaacagggaggagctgcagaatggggctctggtctctgggcattcatttccctcatagaggctgagaataaaacaaggacttattcacacatgttctagaaccccagaatggcccaagttacctgagaccagggtttctcaaccttgacaccattgacattttggactgggtaattctttgttctgcagagctgtcctttgcactgtaggagatttactaatatccctggcctctacccagtagtaccactagcacctattccccacccagcgtgtctccagatattgtcaaatatcccatcgggtgcaaaatgatccctggtcaagatctgttgcccaagatgttacaggtcacaatgaccacatttgaaattgttttccctttcattttaccctgtgaaagcatctctcctagagccttgcaagaggcaggtgacattgtgtccatatttcttcctgtttcagaacttctgtttcacaacaatttctctctcgctacaagtattctttcactcagcactggggaagttgggaacagctggtcaccatcatccctttaatcaactcacacctgtttaaagagtgtttctgatttgaccttcatcccttagtttactggcgttaaaaaaagtctcagcaattttcattatttctcgtgggtctcattatcaaacctttacttatttcggcatatttcctctgggcttcttctagtttctgccttacaagcaatgctgttctgtaaatttattgaaacctctggaacatttcacctttagagatggaggatggaaggattggtaccagaagagggctaagatacgttttctgtcttgagctgaaagcacagtctactctccttcgttttgtcgatgagaaagttgaggccagaggggaggtgacatgtttagagtcacccagctggttagtgacagaaaaagcgtgagagttgtctaggattcctgccactttggtccctggcctctcctgggggaggctgctgttcttaggtgctctaagcttaatccctcagaatgtgtggacaggtcagcttagaagagatggggagattcaggatccccctgtgccagagcacagcctcaccggatgctgcttcccacactgaagtgtcctgtccgaccattgctatctgaggcatccacaagcaggtaggaaagctggcgagccattttacttcctgaggacaattccccagccacaggctctgagtcaaatttctatttggtaagcatcctagcagcaaagtcctgcactcagaccagccaaaaaacagcccccattccaagtacttggtgtcaaaagtccccgaacgacttttaaacccaagtcttcttaaggtttcagtactgtggtggctttagcagttgtttttgtgcaactataaattatttaaatcatctgagatgacagtcaattttacaaaccaggtacatattaatttgtataattttgtatatgctctggtacactacctgaactaacgaagggtagaactaattctgtttgtcagtgttcacacctgtaacattaggaggatatgtctgcattgcttatttctttatgttggtgtttctgtggcaaagccctgcacatggcatttctgaaaagccttaaatctttaagatgttgcatgtagggtatgcagtgcaaaaggctgcctcagaactgtgagcccttttgtaagctggaagcatttctcttactactgttacttttgtaggaagttttcaattcagagctgccaaagtgttcccgtaagcagtgccttagtaataccttagtcatgccgccagccttttcttacaccaattcctaatgttcatttacgaattggcccaatattggaaacaaaacaagcaaaaattgtcttcatttttgttttgtaagcccattttttctccagttctataggaaactgactgcttggtgtaaaatccgaaactggacacaagtcagttctttcaccacactcaaatgtatataccaaaacaaaaggttgcaacttcatagtttactatgaaaagcaaattgtactttttaatgttgccttttaaattcatgaccaaatacttagctatttgtgaatcttctgcactctagcatgaaagtgcctttggtttgagattccagcttagaaaagtgctgccataataacgataatttgtagagagaccaaaaatattttgagatcaccgtaatgcctttggtttaccgggatgagtaaccaaccacaggcctctgttcacaagagcacgacgtggtccccgcctgctgctagtctgtctgccactgggggcctcccaacatccatagcacacttcagcggaaggaccccagaaactgttgtgtttgtgtgtgctgatgacctagtgtgtcatttcacctcgtcacccagccctgcgtccggatgaggggacttctgcacaaatgacagaatctcggctggtggacagatactacagctttctcctcctccttgtgttcgtgttcagtctctgtggagactttcttttccattcaaatgacagtgcgcacttatctggtttacacaatgataccattttgaaagttggaagcctcaaactgagacgacagtgcagaacaaaacaaaagtgagttagggtcgttaaaattgaagtgttcttcttagggcaaacatgttgactccgagtattgtgtatgaatgtgctacgagaaacttccaaagagcaccattcacaatttggcattttcaaagaatgttccagccctcaaaggggcaactctttaaagtccttgttggcttttatccaaaccttgtagaaattgggaaagctgatagaggtaaggaagacgagtgaaaaggacaagaaggccaaacaccagccaaaaagaaactaggaaaaaaagattttctttgctaatatagatgtaaaaataacatcagacatctttgaaaattagcctctaaactcttaatacatacgttctgtgtgtctctacctggcgtctttaagaatatcctctctgggctctgaaattttaggagtgattcttatccactccaagttgtaagtatttgtagaaatttgtgcaaacaaacaaaaactatcaaatgaaaagaaaatgtactcaacctaacttatagttagcagctggaattctcaactcttccctgccagcactataccacagtgtggaagaaattagtcaaatgcttgttttcctgcttctcttttcaactgttactgtgctttgtttgaaagtagttttctctctcaaagccgttgcttatatcgttaagaatgaaggtttgtgtttaaaatttattgcattgcaaagggtagtttcactgaagtcatgcaccattaaataagatgaaatatttgtatttattgtcctacttcctaagccgtaacttcttttcctctgtgaatttgcattgagtcactcatgctacactacatcgctttagtatttgagatggcatttatgtttcctctcgtttatcatgaaatggggtcagattccatcagattccacctctgtcaggtggactcttgtctgccttccatgatgagattttttttctccttcccctttctttaagagaggctgacagatctaggtgtcaatcaattggaaaccagtctctgattttttttcattagttattttctatcattagtttcactgtgtaaattagatatcaactgcacttctttaaaaaaaaatacatctccctattacctccttgaaagatttacttctgtaggcctttttcaataggctcatgactgcagacaaggaaaaaaaaagtaaaaacaaaaacagtatgtgcctgaaaatgacaaaaaaaaaatttgtaacatttaaaaaagaaacctgaatagcctttaattctttaataatacacttaaattttatgtaaatcggttttcgccacgtgtgtttgttcacattctaaatgacttaatgggattctcacggtctgtgtctttgtgtcacgtgtataaaatgggcttgtgatgtaagcgtttcatctggtcagtggttcctttgatattgtactgctgctgggagtgggctgtggaacctgccttcgggtaactgggttcctcttgggtagattggagagatgggggtgggcgtgggcaaattctcacacatgttttcttaacctatttgcagaaactttcaaaaggcatttgattaaacctcttggcagtacagtattcttgtatttgttaacgtctgtgtttaggtactggtacctttttgttttaaaatgttctaagtgttggctttaaagtgaatttatctttagtatgatagttatatgaaaattataggatttgtgtgcagagaatttttttataaagtgctttgt

SEQ ID NO: 21362 - DNA, 1281 bp, Homo sapiens
  ENST00000638666
attgagcccagcagctggagcggcagtgagagccctgccgaaaacatggaaaggatgagtgactctgcagataagccaattgacaatgatgcagaaggggtctggagccccgacatcgagcaaagctttcaggaggccctggctatctatccaccatgtgggaggaggaaaatcatcttatcagacgaaggcaaaatgtatggtaggaatgaattgatagccagatacatcaaactcaggacaggcaagacgaggaccagaaaacaggtgtctagtcacattcaggttcttgccagaaggaaatctcgtgattttcattccaagctaaaggatcagactgcaaaggataaggccctgcagcacatggcggccatgtcctcagcccagatcgtctcggccactgccattcataacaagctggggctgcctgggattccacgcccgaccttcccaggggcgccggggttctggccgggaatgattcaaacagggcagccaggatcctcacaagacgtcaagccttttgtgcagcaggcctaccccatccagccagcggtcacagcccccattccagggtttgagcctgcatcggccccagctccctcagtccctgcctggcaaggtcgctccattggcacaaccaagcttcgcctggtggaattttcagcttttctcgagcagcagcgagacccagactcgtacaacaaacacctcttcgtgcacattgggcatgccaaccattcttacagtgacccattgcttgaatcagtggacattcgtcagatttatgacaaatttcctgaaaagaaaggtggcttaaaggaactgtttggaaagggccctcaaaatgccttcttcctcgtaaaattctgggctgatttaaactgcaatattcaagatgatgctggggctttttatggtgtaaccagtcagtacgagagttctgaaaatatgacagtcacctgttccaccaaagtttgctcctttgggaagcaagtagtagaaaaagtagagacggagtatgcaaggtttgagaatggccgatttgtataccgaataaaccgctccccaatgtgtgaatatatgatcaacttcatccacaagctcaaacacttaccagagaaatatatgatgaacagtgttttggaaaacttcacaattttattggtggtaacaaacagggatacacaagaaactctactctgcatggcctgtgtgtttgaagtttcaaatagtgaacacggagcacaacatcatatttacaggcttgtaaaggactga

SEQ ID NO: 21363 - DNA, 3075 bp, Homo sapiens
  ENST00000334310
tcgcagttaccaccaaacccaggaggagactctccctggaaaacttcccttccctttcggtttattttcttgaaaaggctccaggcttcggcttggaaaatcccaccgccaaaattgagcccagcagctggagcggcagtgagagccctgccgaaaacatggaaaggatgagtgactctgcagataagccaattgacaatgatgcagaaggggtctggagccccgacatcgagcaaagctttcaggaggccctggctatctatccaccatgtgggaggaggaaaatcatcttatcagacgaaggcaaaatgtatggtaggaatgaattgatagccagatacatcaaactcaggacaggcaagacgaggaccagaaaacaggtgtctagtcacattcaggttcttgccagaaggaaatctcgtgattttcattccaagctaaaggtaacaagcatggatcagactgcaaaggataaggccctgcagcacatggcggccatgtcctcagcccagatcgtctcggccactgccattcataacaagctggggctgcctgggattccacgcccgaccttcccaggggcgccggggttctggccgggaatgattcaaacagggcagccaggatcctcacaagacgtcaagccttttgtgcagcaggcctaccccatccagccagcggtcacagcccccattccagggtttgagcctgcatcggccccagctccctcagtccctgcctggcaaggtcgctccattggcacaaccaagcttcgcctggtggaattttcagcttttctcgagcagcagcgagacccagactcggctgatttaaactgcaatattcaagatgatgctggggctttttatggtgtaaccagtcagtacgagagttctgaaaatatgacagtcacctgttccaccaaagtttgctcctttgggaagcaagtagtagaaaaagtagagacggagtatgcaaggtttgagaatggccgatttgtataccgaataaaccgctccccaatgtgtgaatatatgatcaacttcatccacaagctcaaacacttaccagagaaatatatgatgaacagtgttttggaaaacttcacaattttattggtggtaacaaacagggatacacaagaaactctactctgcatggcctgtgtgtttgaagtttcaaatagtgaacacggagcacaacatcatatttacaggcttgtaaaggactgaacatggttatttatatatatagatatctgtatatacacacacacatatgtgcacacacacactctctctccattatcgaacgactgactgtaaacctcaccacacagggtggtgccctggccccgaggtcaccccgacttttctaaatcttgtttgagtgaagtcattttttcatgtgttcatactatcattgtagctgtgaagttctggtacagttgtaaaaagagaaattgagttgtttctctatgttcttcagatgtgcagcccacaattcctcgggaaaggtgaacctgaacaacccaagtctctctctgcagagccctgtttctaattgtggtagaaaatattgagacagagcatttgccatgggacatttacagcctttatacaaatgtatttagttctcttttttccaacataaaattcttgttttaagatacaagtaaaattaatctttaaatataaatgtaaattagtacacaaaactaagaatctttagacttatctttgtaactaattagggtggaagttatgaaagaatgtaattcactaaattattttttaaatgaaacctttttttttctttttgaaaccaaatgttaaactatagccttaagaaatgcttggtagaagtgtcctaatgagacaaatttgtacttttatcctcaaggttaacactaatctcctaatccattaaactcttgaacaggtattacaaaggaagaaaacttcaccccttatccttaacatatatagtatatttaaaaaatataaaattgtattgtactaatgtgatgatggattatttaatgaaaaagaaaaaatggctctttttgcaataagtagatacatactgaaaaaatctaaacttacaatgtttatagtcttgtgtgtgcagttatattttatatggacgaccaaattttttattaagatgagtaaatatttgaaccactgaattttaataacaaaattttaaaattggcatgaatacggaatactgcactgtgagatgcaaagtatacagaatctgtggctgggagaaaatttcatcaaatagacaagtaaaaggctcatcagttttagcatctctgctccccagaaaattgtaagcatcctcaccagcctgtggatacattctttatttctagtgacccaatatgcatattaacctgctataactagggctatatgtgtaggtatgtgtatacatatacacaaatgcacatatagagttaacacatttagtgaacacttgtttagtgtcactcagtttgctaggtgctgatatgtacgtatatctcaatgtgtctgtagacttagatacatcctcttgaagcacatccatttctttagcgtctctcagtaagttacagtacttgtttgacttaggtttaagaggcccagctacctatctctgaccttttcaaataggctcatttgggagattcttttgccaggagagattcaactttccaatctaagtattccagagcattgcccaggcagagttggtttgatgtggccagatgttttgagttatttcccttaagtgtttcactggggagagaacagggagtgctcctccagcttcccaaagaaatatgtttttgtaagtggtaggaacatgtgcacacaatagaacatgaaataagttttttaacttgtaaaacatgtcaagatttttccaccaagctagaaaataaaaaacttagttctaccacatccaattaacttacacacccccttccctgtctcaacacctgctttgaccctgcttttctattattacatcagtcagcatcttgtggtccctaacatgaggatgtggctggctcgtggg

SEQ ID NO: 21364 - DNA, 1637 bp, Homo sapiens
  ENST00000358409
gtggccccgccgccactccctccggctccctccctcccgccgcggcgcgcatctcattccagccctcattccgcgcattccagcgtcctcctcgcacactcgaggccagggggcgggagggccgcagctccggcgccgccgcgtcccgccagaacgatcgccgcggccggaagagttggcgctcggggcggactccttggaactggcttagcgcacccatcccaccttcccgcaccctgggaccggtccaacgagcgctcctccaagcggagccttggagggcacggccggcaccattacctccaacgagtggagctctcccacctcccctgaggggagcaccgcctctgggggcagtcaggcactggacaagcccatcgacaatgacgcagagggcgtgtggagcccggatattgagcagagtttccaggaggccctcgccatctacccgccctgtggcaggcgcaaaatcatcctgtcggacgagggcaagatgtatggtcggaacgagctgattgcccgctacatcaagctccggacagggaagacccgcaccaggaagcaggtctccagccacatccaggtgctggctcgtcgcaaagctcgcgagatccaggccaagctaaagttttggcaaggagctttgccaggccaagccggaacgtcccatgatgtgaagcctttctctcagcaaacctatgctgtccagcctccgctgcctctgccagggtttgagtctcctgcagggcccgccccatcgccctctgcgcccccggcacccccatggcagggccgcagcgtggccagctccaagctctggatgttggagttctctgccttcctggagcagcagcaggacccggacacgtacaacaagcacctgttcgtgcacattggccagtccagcccaagctacagcgacccctacctcgaagccgtggacatccgccaaatctatgacaaattcccggagaaaaagggtggactcaaggatctcttcgaacggggaccctccaatgccttttttcttgtgaagttctgggcagacctcaacaccaacatcgaggatgaaggcagctccttctatggggtctccagccagtatgagagccccgagaacatgatcatcacctgctccacgaaggtctgctctttcggcaagcaggtggtggagaaagttgagacagagtatgctcgctatgagaatggacactactcttaccgcatccaccggtccccgctctgtgagtacatgatcaacttcatccacaagctcaagcacctccctgagaagtacatgatgaacagcgtgctggagaacttcaccatcctgcaggtggtcaccaacagagacacacaggagaccttgctgtgcattgcctatgtctttgaggtgtcagccagtgagcacggggctcagcaccacatctacaggctggtgaaagaatgagagactcggggagcagggaggggggaagagacgtgtgtgcaggaaacggggacgtggggaggggacctgcaggggcagccccctgaagtgccaagagagctgagaggagcagttgtgactctacccaggaacaaactgtgcctgaacctgaggtgcccaaccccaaataaacccaagatgctgtgta

SEQ ID NO: 21365 - DNA, 578 bp, Homo sapiens
  ENST00000540314
attccagcgtcctcctcgcacactcgaggccagggggcgggagggccgcagctccggcgccgccgcgtcccgccagaacgatcgccgcggccggaagagttggcgctcggggcggactccttggaactggcttagcgcacccatcccaccttcccgcaccctgggaccggtaaggctggggcgcggggacttggtaggactttgccggagggcaggagtctgcgcggtgcgtgcggagctccctcccgggacgagactgggaagagcgaggcacgtggaggcggcgcgactgaggctgctggaggcgaagcggctccaggggcgggtaaggggggtggacactcgggactttgggggaaagggaggccggtgtggaaaggaccggagaggcagaaccgagagcatcggcaacagaagagacccagcacccatgcctcttttctgctgggcccttttcgagcctggaagggagagacctggaggtccaacgagcgctcctccaagcggagccttggagggcacggccggcaccattacctccaacgagtggagctctcccacctcccctgaggggagca

SEQ ID NO: 21366 - DNA, 570 bp, Homo sapiens
  ENST00000536826
ttccagcgtcctcctcgcacactcgaggccagggggcgggagggccgcagctccggcgccgccgcgtcccgccagaacgatcgccgcggccggaagagttggcgctcggggcggactccttggaactggcttagcgcacccatcccaccttcccgcaccctgggaccggtaaggctggggcgcggggacttggtaggactttgccggagggcaggagtctgcgcggtgcgtgcggagctccctcccgggacgagactgggaagagcgaggcacgtggaggcggcgcgactgaggctgctggaggcgaagcggctccaggggcgggtccaacgagcgctcctccaagcggagccttggagggcacggccggcaccattacctccaacgagtggagctctcccacctcccctgaggggagcaccgcctctgggggcagtcaggcactggacaagcccatcgacaatgacgcagagggcgtgtggagcccggatattgagcagagtttccaggaggccctcgccatctacccgccctgtggcaggcgcaaaatcatcctgtcggacgagggca

SEQ ID NO: 21367 - DNA, 1690 bp, Homo sapiens
  ENST00000359864
gtcctcctcgcacactcgaggccagggggcgggagggccgcagctccggcgccgccgcgtcccgccagaacgatcgccgcggccggaagagttggcgctcggggcggactccttggaactggcttagcgcacccatcccaccttcccgcaccctgggaccggtccaacgagcgctcctccaagcggagccttggagggcacggccggcaccattacctccaacgagtggagctctcccacctcccctgaggggagcaccgcctctgggggcagtcaggcactggacaagcccatcgacaatgacgcagagggcgtgtggagcccggatattgagcagagtttccaggaggccctcgccatctacccgccctgtggcaggcgcaaaatcatcctgtcggacgagggcaagatgtatggtcggaacgagctgattgcccgctacatcaagctccggacagggaagacccgcaccaggaagcaggtctccagccacatccaggtgctggctcgtcgcaaagctcgcgagatccaggccaagctaaaggaccaggcagctaaggacaaggccctgcagagcatggctgccatgtcgtctgcacagatcatctccgccacggccttccacagtagcatggccctcgcccggggccccggccgcccagcagtctcagggttttggcaaggagctttgccaggccaagccggaacgtcccatgatgtgaagcctttctctcagcaaacctatgctgtccagcctccgctgcctctgccagggtttgagtctcctgcagggcccgccccatcgccctctgcgcccccggcacccccatggcagggccgcagcgtggccagctccaagctctggatgttggagttctctgccttcctggagcagcagcaggacccggacacgtacaacaagcacctgttcgtgcacattggccagtccagcccaagctacagcgacccctacctcgaagccgtggacatccgccaaatctatgacaaattcccggagaaaaagggtggactcaaggatctcttcgaacggggaccctccaatgccttttttcttgtgaagttctgggcagacctcaacaccaacatcgaggatgaaggcagctccttctatggggtctccagccagtatgagagccccgagaacatgatcatcacctgctccacgaaggtctgctctttcggcaagcaggtggtggagaaagttgagacagagtatgctcgctatgagaatggacactactcttaccgcatccaccggtccccgctctgtgagtacatgatcaacttcatccacaagctcaagcacctccctgagaagtacatgatgaacagcgtgctggagaacttcaccatcctgcaggtggtcaccaacagagacacacaggagaccttgctgtgcattgcctatgtctttgaggtgtcagccagtgagcacggggctcagcaccacatctacaggctggtgaaagaatgagagactcggggagcagggaggggggaagagacgtgtgtgcaggaaacggggacgtggggaggggacctgcaggggcagccccctgaagtgccaagagagctgagaggagcagttgtgactctacccaggaacaaactgtgcctgaacctgaggtgcccaaccccaaataaacccaagatgctgtgtattttcaga

SEQ ID NO: 21368 - DNA, 801 bp, Homo sapiens
  ENST00000543035
cctccctccgcgcgctccgctccgctccgctgggcgcaccggggccggtcggcgcggggtgggcttggccccgcggccccgccttcactgcgccgcccgtcggccccggccggagcccggctctgcgcgctgacgccctgtcgtccccgcagaacgatcgccgcggccggaagagttggcgctcggggcggactccttggaactggcttagcgcacccatcccaccttcccgcaccctgggaccggtccaacgagcgctcctccaagcggagccttggagggcacggccggcaccattacctccaacgagtggagctctcccacctcccctgaggggagcaccgcctctgggggcagtcaggcactggacaagcccatcgacaatgacgcagagggcgtgtggagcccggatattgagcagagtttccaggaggccctcgccatctacccgccctgtggcaggcgcaaaatcatcctgtcggacgagggcaagatgtatggtcggaacgagctgattgcccgctacatcaagctccggacagggaagacccgcaccaggaagcaggtctccagccacatccaggtgctggctcgtcgcaaagctcgcgagatccaggccaagctaaaggaccaggcagctaaggacaaggccctgcagagcatggctgccatgtcgtctgcacagatcatctccgccacggccttccacagtagcatggccctcgcccggggccccggccgcccagcagtctcagggttttggcaaggagctttgccaggccaagccggaacgtcccatga

SEQ ID NO: 21369 - DNA, 1396 bp, Homo sapiens
  ENST00000397122
tctgcgcgctgacgccctgtcgtccccgcagaacgatcgccgcggccggaagagttggcgctcggggcggactccttggaactggcttagcgcacccatcccaccttcccgcaccctgggaccggtcggaacgagctgattgcccgctacatcaagctccggacagggaagacccgcaccaggaagcaggtctccagccacatccaggtgctggctcgtcgcaaagctcgcgagatccaggccaagctaaaggaccaggcagctaaggacaaggccctgcagagcatggctgccatgtcgtctgcacagatcatctccgccacggccttccacagtagcatggccctcgcccggggccccggccgcccagcagtctcagggttttggcaaggagctttgccaggccaagccggaacgtcccatgatgtgaagcctttctctcagcaaacctatgctgtccagcctccgctgcctctgccagggtttgagtctcctgcagggcccgccccatcgccctctgcgcccccggcacccccatggcagggccgcagcgtggccagctccaagctctggatgttggagttctctgccttcctggagcagcagcaggacccggacacgtacaacaagcacctgttcgtgcacattggccagtccagcccaagctacagcgacccctacctcgaagccgtggacatccgccaaatctatgacaaattcccggagaaaaagggtggactcaaggatctcttcgaacggggaccctccaatgccttttttcttgtgaagttctgggcagacctcaacaccaacatcgaggatgaaggcagctccttctatggggtctccagccagtatgagagccccgagaacatgatcatcacctgctccacgaaggtctgctctttcggcaagcaggtggtggagaaagttgagacagagtatgctcgctatgagaatggacactactcttaccgcatccaccggtccccgctctgtgagtacatgatcaacttcatccacaagctcaagcacctccctgagaagtacatgatgaacagcgtgctggagaacttcaccatcctgcaggtggtcaccaacagagacacacaggagaccttgctgtgcattgcctatgtctttgaggtgtcagccagtgagcacggggctcagcaccacatctacaggctggtgaaagaatgagagactcggggagcagggaggggggaagagacgtgtgtgcaggaaacggggacgtggggaggggacctgcaggggcagccccctgaagtgccaagagagctgagaggagcagttgtgactctacccaggaacaaactgtgcctgaacctgaggtgcccaaccccaaataaacccaagatgctgtgtattttca

SEQ ID NO: 21370 - DNA, 641 bp, Homo sapiens
  ENST00000443986
gcagaacgatcgccgcggccggaagagttggcgctcggggcggactccttggaactggcttagcgcacccatcccaccttcccgcaccctgggaccggtccaacgagcgctcctccaagcggagccttggagggcacggccggcaccattacctccaacgagtggagctctcccacctcccctgaggggagcaccgcctctgggggcagtcaggcactggacaagcccatcgacaatgacgcagagggcgtgtggagcccggatattgagcagagtttccaggaggccctcgccatctacccgccctgtggcaggcgcaaaatcatcctgtcggacgagggcaagatgtatggtctccagccacatccaggtgctggctcgtcgcaaagctcgcgagatccaggccaagctaaagttttggcaaggagctttgccaggccaagccggaacgtcccatgatgtgaagcctttctctcagcaaacctatgctgtccagcctccgctgcctctgccagggtttgagtctcctgcagggcccgccccatcgccctctgcgcccccggcacccccatggcagggccgcagcgtggccagctccaagctctggatgttggagttctctgccttcctggagcagcagc

SEQ ID NO: 21371 - DNA, 567 bp, Homo sapiens
  ENST00000544666
agggaagacccgcaccaggaagcaggtctccagccacatccaggtgctggctcgtcgcaaagctcgcgagatccaggccaagctaaagacaggtgctgagctaggcacctgtggtagagaggaccaggcagctaaggacaaggccctgcagagcatggctgccatgtcgtctgcacagatcatctccgccacggccttccacagtagcatggccctcgcccggggccccggccgcccagcagtctcagggttttggcaaggagctttgccaggccaagccggaacgtcccatgatgtgaagcctttctctcagcaaacctatgctgtccagcctccgctgcctctgccagggtttgagtctcctgcagggcccgccccatcgccctctgcgcccccggcacccccatggcagggccgcagcgtggccagctccaagctctggatgttggagttctctgccttcctggagcagcagcaggacccggacacgtacaacaagcacctgttcgtgcacattggccagtccagcccaagctacagcgacccctacctcgaagccgtggacat

SEQ ID NO: 21372 - DNA, 3687 bp, Homo sapiens
  ENST00000381501
gggcggggcggggcgctttgctctggactctggggcgctaggctccggactccgcggcgcagactgcacctcgcagtctccccaggtccgcccagcagccgcgcttcagccagaatactgggatcttcagtggcaggaggagtaatcagaagacggagatgaattttaacactattttggaggagattcttattaaaaggtcacagcagaaaaagaagacatcgcccttaaactacaaagagagactttttgtacttacaaagtccatgctaacctactatgagggtcgagcagagaagaaatacagaaaggggtttattgatgtttcaaaaatcaagtgtgtggaaatagtgaagaatgatgatggtgtcattccctgtcaaaataagtatccatttcaggttgttcatgatgctaacacactttacatttttgcacctagtccacaaagcagggacctgtgggtgaagaagttaaaagaagaaataaagaacaacaataatattatgattaaatatcatcctaaattctggacagatggaagttatcagtgttgtagacaaactgaaaaattagcacccggatgtgaaaaatacaatctttttgagagcagtataagaaaagcactacctccagcaccagaaacaaagaagcgaaggcctcccccaccaattccactagaagaagaagataatagtgaagaaatcgttgtagccatgtatgatttccaagcagcagaaggacatgatctcagattagagagaggccaagagtatctcattttagaaaagaatgatgttcattggtggagagcaagagataaatatgggaatgaaggatatatcccaagtaattacgtaacgggaaagaaatcaaacaacttagatcaatatgaatggtattgcagaaatatgaatagaagcaaggcagagcaactcctccgcagtgaagataaagaaggtggttttatggtaagggattccagtcaaccaggcttgtacacagtctccctttataccaagtttggaggagaaggttcatcgggttttaggcattatcatataaaggaaacaacaacatctccaaagaagtattacctagctgaaaaacatgcttttggctccattcctgagattattgaatatcataagcacaatgcagcaggacttgtcaccaggcttcggtacccagttagtgtgaaagggaagaatgcacccaccactgcaggattcagctatgagaaatgggagattaacccttcagaactgacctttatgagggaattgggaagtggactgtttggagtggtgaggcttggcaaatggcgagcccagtacaaagtcgcaatcaaagctattcgggaaggtgcaatgtgcgaggaggactttatagaagaagctaaagtgatgatgaaactgacacacccgaagttagtgcagctttatggtgtgtgcacccagcagaaaccaatatacattgttactgagttcatggaaaggggctgccttctgaatttcctccgacagagacaaggtcatttcagtagagacgtactgctgagcatgtgtcaggatgtgtgtgaagggatggagtatctggagagaaacagcttcatccacagagatctggctgccagaaattgtctagtaagtgaggcgggagttgtaaaagtatctgattttggaatggccaggtatgttctggatgatcagtacacaagttcttctggtgctaagtttcctgtgaagtggtgtccacctgaagtgtttaattacagccgcttcagcagcaaatcagatgtctggtcatttggtgttttaatgtgggaagtattcacggaaggcagaatgccttttgaaaaatacaccaattatgaagtggtaaccatggttactcgaggccaccgactctaccagccgaagttggcgtccaactatgtgtatgaggtgatgctgagatgttggcaggagaaaccagagggaaggccttctttcgaagatctgctgcgcacaatagatgaactagttgaatgtgaagaaacttttggaagataagtgatgtgtgaccagtggctcccagattcccaagcacaaggaaggatgggcattttgtggcttttaatttattgagcacttggacatgtagatcattttacttatacagtggaaacacataaataatttgcttctagaccagcctctgtctagacttgcttctagacagaatctcccagagtgtggaaatgttgccttagaaatggtgattaaaatcactcatttctattcattcctcaggcacttgagtgacagttgtttaccaggcactgtgtgtagccccagggtttggccattcaggggtgcacacatgggaccatgttagctgatgccagttgaaggccagggtatttgggaaggggaagggtattagagtcatgaccaagcaacccttctttttccctttgacttctacagaaatctgggcctgagacattgtctacaattgggttctagatacatcaggaacccatcttggataaataaatacctatcttttgttttgaaaacatctcagttttcaagactgctcttagtattacatgaacaatatttgtatgctgtatatattgtaaatatatataatatataaagttatatatttatgagaaacacgaattgtcttttaattgaaacttttaatcctgtagtataggagttcaccttcttaggactagagactgtgccttatagctgttaattcatttccccctgaacatcaaatatgcctgaagagaagaaagtctagattcttctatgagtaacgccccctcctcactcaggtaaatgtgtctggggatgcctgtccagcttaaccacgtgcatttggcctatgtaatcctgcccatggtggccgcagctaatcagaatcagatggaaaattaaaccgggtaatctacttctaagccttaagaatattccctgggacacagacactataattggaagtgctgagctctggggcagaaggatcaggtgaccttcgcaacaaagtttgcccccacctcacataggacccggaagcagcctgagctgtggcggaggatccaggaagctacggagagaagcagccagcatggtgttccgtgcctcccggacgtttttcaggaggcctggttggacttgggttcctggatggtgggattgttgtacagcctctcaggagaccctgctgtcaagactgtgtgtgtggatttctcacccttagaagctctactaagacatcaacggaattagggccttcctttttgccttgtgagcgccaaggaaaagaaactatctcggtcacgtgagcgccagcgaaaagaaactgtatcagtcatccagagaccgtttattgcccaacacgttattcttgctgttggtggggtaactagccgaggaagacacagcgccttcccttcaggagttgcgtctcctctgcaggccacgatggtctgctctggagcattgggtgaacacacaggctggctgctctgggcagcgccttcactctgaccctggagaaccatttcatttcatcctggtcagtctagagtctgtgcaccaggcagtccatccactgaaggctgtgtttattcttttcctgtgcccctcataatggaagaaagtaaactgcttatcccgagcctta

SEQ ID NO: 21373 - DNA, 2446 bp, Homo sapiens
  ENST00000505452
aatactgggatcttcagtggcaggaggagtaatcagaagacggagatgaattttaacactattttggaggagattcttattaaaaggtcacagcagaaaaagaagacatcgcccttaaactacaaagagagactttttgtacttacaaagtccatgctaacctactatgagggtcgagcagagaagaaatacagaaaggggtttattgatgtttcaaaaatcaagtgtgtggaaatagtgaagaatgatgatggtgtcattccctgtcaaaataagtatccatttcagtccacaaagcagggacctgtgggtgaagaagttaaaagaagaaataaagaacaacaataatattatgattaaatatcatcctaaattctggacagatggaagttatcagtgttgtagacaaactgaaaaattagcacccggatgtgaaaaatacaatctttttgagagcagtataagaaaagcactacctccagcaccagaaacaaagaagcgaaggcctcccccaccaattccactagaagaagaagataatagtgaagaaatcgttgtagccatgtatgatttccaagcagcagaaggacatgatctcagattagagagaggccaagagtatctcattttagaaaagaatgatgttcattggtggagagcaagagataaatatggatggtattgcagaaatatgaatagaagcaaggcagagcaactcctccgcagtgaagataaagaaggtggttttatggtaagggattccagtcaaccaggcttgtacacagtctccctttataccaagtttggaggagaaggttcatcgggttttaggcattatcatataaaggaaacaacaacatctccaaagaagtattacctagctgaaaaacatgcttttggctccattcctgagattattgaatatcataagcacaatgcagcaggacttgtcaccaggcttcggtacccagttagtgtgaaagggaagaatgcacccaccactgcaggattcagctatgagaaatgggagattaacccttcagaactgacctttatgagggaattgggaagtggactgtttggagtggtgaggcttggcaaatggcgagcccagtacaaagtcgcaatcaaagctattcgggaaggtgcaatgtgcgaggaggactttatagaagaagctaaagtgatgatgaaactgacacacccgaagttagtgcagctttatggtgtgtgcacccagcagaaaccaatatacattgttactgagttcatggaaaggggctgccttctgaatttcctccgacagagacaaggtcatttcagtagagacgtactgctgagcatgtgtcaggatgtgtgtgaagggatggagtatctggagagaaacagcttcatccacagagatctggctgccagaaattgtctagtaagtgaggcgggagttgtaaaagtatctgattttggaatggccaggtatgttctggatgatcagtacacaagttcttctggtgctaagtttcctgtgaagtggtgtccacctgaagtgtttaattacagccgcttcagcagcaaatcagatgtctggtcatttggtgttttaatgtgggaagtattcacggaaggcagaatgccttttgaaaaatacaccaattatgaagtggtaaccatggttactcgaggccaccgactctaccagccgaagttggcgtccaactatgtgtatgaggtgatgctgagatgttggcaggagaaaccagagggaaggccttctttcgaagatctgctgcgcacaatagatgaactagttgaatgtgaagaaacttttggaagataagtgatgtgtgaccagtggctcccagattcccaagcacaaggaaggatgggcattttgtggcttttaatttattgagcacttggacatgtagatcattttacttatacagtggaaacacataaataatttgcttctagaccagcctctgtctagacttgcttctagacagaatctcccagagtgtggaaatgttgccttagaaatggtgattaaaatcactcatttctattcattcctcaggcacttgagtgacagttgtttaccaggcactgtgtgtagccccagggtttggccattcaggggtgcacacatgggaccatgttagctgatgccagttgaaggccagggtatttgggaaggggaagggtattagagtcatgaccaagcaacccttctttttccctttgacttctacagaaatctgggcctgagacattgtctacaattgggttctagatacatcaggaacccatcttggataaataaatacctatcttttgttttgaaaacatctcagttttcaagactgctcttagtattacatgaacaatatttgtatgctgtatatattgtaaatatatataatatataaagttatatatttatgagaaa

SEQ ID NO: 21374 - DNA, 681 bp, Homo sapiens
  ENST00000515146
aggacttgtcaccaggcttcggtacccagttagtgtgaaagggaagaatgcacccaccactgcaggattcagctatgagaaatgggagattaacccttcagaactgacctttatgagggaattgggaagtggactgtttggagtggtgaggcttggcaaatggcgagcccagtacaaagtcgcaatcaaagctattcgggaaggtgcaatgtgcgaggaggactttatagaagaagctaaagtgatgatgctgccagaaattgtctagtaagtgaggcgggagttgtaaaagtatctgattttggaatggccaggtatgttctggatgatcagtacacaagttcttctggtgctaagtttcctgtgaagtggtgtccacctgaagtgtttaattacagccgcttcagcagcaaatcagatgtctggtcatttggtgttttaatgtgggaagtattcacggaaggcagaatgccttttgaaaaatacaccaattatgaagtggtaaccatggttactcgaggccaccgactctaccagccgaagttggcgtccaactatgtgtatgaggtgatgctgagatgttggcaggagaaaccagagggaaggccttctttcgaagatctgctgcgcacaatagatgaactagttgaatgtgaagaaacttttggaagataagtgatg

SEQ ID NO: 21375 - DNA, 436 bp, Homo sapiens
  ENST00000511150
aagaaaagaaaaaaaaaagacaattggtaaagattatgtaataatgccttattgcaaatacaactttctgacctgcctattcatttttttcaaatacacaatggaaatacttccataggggtaaaaacaacttattaaagggtgtttccactctctgcaaatgttgactaggttacactaaatttaatataaatagaacttacattttcctacttaaatgatagaatttttaaactaatataccatcataatgttgttttccaggctgccagaaattgtctagtaagtgaggcgggagttgtaaaagtatctgattttggaatggccaggtatgttctggatgatcagtacacaagttcttctggtgctaagtttcctgtgaagtggtgtccacctgaagtgtttaattacagccgcttcagcagcaaatcagatg

SEQ ID NO: 21376 - DNA, 814 bp, Homo sapiens
  ENST00000511471
agagtagcagtcttctgcacaggatgttgtccattcaccttggaactgccatccacaaacctagcaactcttggtaggataaagaaggtggttttatggtaagggattccagtcaaccaggcttgtacacagtctccctttataccaagtttggagggttcatcgggttttaggcattatcatataaaggaaacaacaacatctccaaagaagtattacctagctgaaaaacatgcttttggctccattcctgagattattgaatatcataagcacaatgcagcaggacttgtcaccaggcttcggtacccagttagtgtgaaagggaagaatgcacccaccactgcaggattcagctatgagaaatgggagattaacccttcagaactgacctttatgagggaattgggaagtggactgtttggagtggtgaggcttggcaaatggcgagcccagtacaaagtcgcaatcaaagctattcgggaaggtgcaatgtgcgaggaggactttatagaagaagctaaagtgatgatgaaactgacacacccgaagttagtgcagctttatggtgtgtgcacccagcagaaaccaatatacattgttactgagttcatggaaaggggctgccttctgaatttcctccgacagagacaaggtcatttcagtagagacgtactgctgagcatgtgtcaggatgtgtgtgaagggatggagtatctggagagaaacagcttcatccacagagatctggctgccagaaattgtctagtaagtgaggcgggagttgtaaaagtatctgattttggaatggcca

SEQ ID NO: 21377 - DNA, 3836 bp, Homo sapiens
  ENST00000519097
ttattctcagtttcccgcctatgagaggatacccctattgtttctgaaaatgctgaccgggacccacacttccaacaaaaattcctctgcccctacagcagcagcaaaagcagcagcagaagcaacagcaacagataagtgttttgatgaattgcgagatggatagggcttgagtgcccccagccctgctgataccaaatgcctttaagatacagcctttcccatcctaatctacaaaggaaacaggaaaaaggaacttaaaactccctgtgctcagacagaaatgagactgttacagcctgcttctgtgctgttccttcttgcctctaacttgtaaacaagacgtagtaggacgatgctaatggaaagtcacaaaccgctgggtttttgaaaggatccttgggacctcatgcacatttgtggaaactggatggagagatttggggaagcatggactctttagccagcttagttctctgtggagtcagcttgctcctttctgcttccttcctaccagctactttaactatgactgtggacaagggagataacgtgaacatatctttcaaaaaggtattgattaaagaagaagatgcagtgatttacaaaaatggttccttcatccattcagtgccccggcatgaagtacctgatattctagaagtacacctgcctcatgctcagccccaggatgctggagtgtactcggccaggtatataggaggaaacctcttcacctcggccttcaccaggctgatagtccggagatgtgaagcccagaagtggggacctgaatgcaaccatctctgtactgcttgtatgaacaatggtgtctgccatgaagatactggagaatgcatttgccctcctgggtttatgggaaggacgtgtgagaaggcttgtgaactgcacacgtttggcagaacttgtaaagaaaggtgcagtggacaagagggatgcaagtcttatgtgttctgtctccctgacccctatgggtgttcctgtgccacaggctggaagggtctgcagtgcaatgaaggcatacagaggatgaccccaaagatagtggatttgccagatcatatagaagtaaacagtggtaaatttaatcccatttgcaaagcttctggctggccgctacctactaatgaagaaatgaccctggtgaagccggatgggacagtgctccatccaaaagactttaaccatacggatcatttctcagtagccatattcaccatccaccggatcctcccccctgactcaggagtttgggtctgcagtgtgaacacagtggctgggatggtggaaaagcccttcaacatttctgttaaagttcttccaaagcccctgaatgccccaaacgtgattgacactggacataactttgctgtcatcaacatcagctctgagccttactttggggatggaccaatcaaatccaagaagcttctatacaaacccgttaatcactatgaggcttggcaacatattcaagtgacaaatgagattgttacactcaactatttggaacctcggacagaatatgaactctgtgtgcaactggtccgtcgtggagagggtggggaagggcatcctggacctgtgagacgcttcacaacagcttctatcggactccctcctccaagaggtctaaatctcctgcctaaaagtcagaccactctaaatttgacctggcaaccaatatttccaagctcggaagatgacttttatgttgaagtggagagaaggtctgtgcaaaaaagtgatcagcagaatattaaagttccaggcaacttgacttcggtgctacttaacaacttacatcccagggagcagtacgtggtccgagctagagtcaacaccaaggcccagggggaatggagtgaagatctcactgcttggacccttagtgacattcttcctcctcaaccagaaaacatcaagatttccaacattacacactcctcagctgtgatttcttggacaatattggatggctattctatttcttctattactatccgttacaaggttcaaggcaagaatgaagaccagcacgttgatgtgaagataaagaatgccaccatcactcagtatcagctcaagggcctagagcctgaaacagcataccaggtggacatttttgcagagaacaacatagggtcaagcaacccagccttttctcatgaactggtgaccctcccagaatctcaagcaccagcggacctcggaggggggaagatgctgcttatagccatccttggctctgctggaatgacctgcctgactgtgctgttggcctttctgatcatattgcaattgaagagggcaaatgtgcaaaggagaatggcccaagccttccaaaacagggaagaaccagctgtgcagttcaactcagggactctggccctaaacaggaaggtcaaaaacaacccagatcctacaatttatccagtgcttgactggaatgacatcaaatttcaagatgtgattggggagggcaattttggccaagttcttaaggcgcgcatcaagaaggatgggttacggatggatgctgccatcaaaagaatgaaagaatatgcctccaaagatgatcacagggactttgcaggagaactggaagttctttgtaaacttggacaccatccaaacatcatcaatctcttaggagcatgtgaacatcgaggctacttgtacctggccattgagtacgcgccccatggaaaccttctggacttccttcgcaagagccgtgtgctggagacggacccagcatttgccattgccaatagcaccgcgtccacactgtcctcccagcagctccttcacttcgctgccgacgtggcccggggcatggactacttgagccaaaaacagtttatccacagggatctggctgccagaaacattttagttggtgaaaactatgtggcaaaaatagcagattttggattgtcccgaggtcaagaggtgtatgtgaaaaagacaatgggaaggctcccagtgcgctggatggccatcgagtcactgaattacagtgtgtacacaaccaacagtgatgtatggtcctatggtgtgttactatgggagattgttagcttaggaggcacaccctactgcgggatgacttgtgcagaactctacgagaagctgccccagggctacagactggagaagcccctgaactgtgatgatgaggtgtatgatctaatgagacaatgctggcgggagaagccttatgagaggccatcatttgcccagatattggtgtccttaaacagaatgttagaggagcgaaagacctacgtgaataccacgctttatgagaagtttacttatgcaggaattgactgttctgctgaagaagcggcctaggacagaacatctgtataccctctgtttccctttcactggcatgggagacccttgacacctgctgagaaaacatgcctctgccaaaggatgtgatatataagtgtacatatgtgctgtacacctgggaccttcaccactgtagatcccatgcatggatctatgtagtatgctctgactctaataggactgtatatactgttttaagaatgggctgaaatcagaatgcctgtttgtggtttcatatgcaataatatatttttttaaaaatgtggacttcataggaaggcgtgagtacaattagtataatgcataactcattgttgtcctagatattttgatatttacctttatgttgaatgctattaaatgttttcctgtgtcaaagtaaaatattgttaataaacctaacaatgaccctgatagtacaggttaagtgagagaactatatgaattct

SEQ ID NO: 21378 - DNA, 4760 bp, Homo sapiens
  ENST00000380036
agtttcccgcctatgagaggatacccctattgtttctgaaaatgctgaccgggacccacacttccaacaaaaattcctctgcccctacagcagcagcaaaagcagcagcagaagcaacagcaacagataagtgttttgatgaattgcgagatggatagggcttgagtgcccccagccctgctgataccaaatgcctttaagatacagcctttcccatcctaatctacaaaggaaacaggaaaaaggaacttaaaactccctgtgctcagacagaaatgagactgttacagcctgcttctgtgctgttccttcttgcctctaacttgtaaacaagacgtagtaggacgatgctaatggaaagtcacaaaccgctgggtttttgaaaggatccttgggacctcatgcacatttgtggaaactggatggagagatttggggaagcatggactctttagccagcttagttctctgtggagtcagcttgctcctttctggaactgtggaaggtgccatggacttgatcttgatcaattccctacctcttgtatctgatgctgaaacatctctcacctgcattgcctctgggtggcgcccccatgagcccatcaccataggaagggactttgaagccttaatgaaccagcaccaggatccgctggaagttactcaagatgtgaccagagaatgggctaaaaaagttgtttggaagagagaaaaggctagtaagatcaatggtgcttatttctgtgaagggcgagttcgaggagaggcaatcaggatacgaaccatgaagatgcgtcaacaagcttccttcctaccagctactttaactatgactgtggacaagggagataacgtgaacatatctttcaaaaaggtattgattaaagaagaagatgcagtgatttacaaaaatggttccttcatccattcagtgccccggcatgaagtacctgatattctagaagtacacctgcctcatgctcagccccaggatgctggagtgtactcggccaggtatataggaggaaacctcttcacctcggccttcaccaggctgatagtccggagatgtgaagcccagaagtggggacctgaatgcaaccatctctgtactgcttgtatgaacaatggtgtctgccatgaagatactggagaatgcatttgccctcctgggtttatgggaaggacgtgtgagaaggcttgtgaactgcacacgtttggcagaacttgtaaagaaaggtgcagtggacaagagggatgcaagtcttatgtgttctgtctccctgacccctatgggtgttcctgtgccacaggctggaagggtctgcagtgcaatgaagcatgccaccctggtttttacgggccagattgtaagcttaggtgcagctgcaacaatggggagatgtgtgatcgcttccaaggatgtctctgctctccaggatggcaggggctccagtgtgagagagaaggcatacagaggatgaccccaaagatagtggatttgccagatcatatagaagtaaacagtggtaaatttaatcccatttgcaaagcttctggctggccgctacctactaatgaagaaatgaccctggtgaagccggatgggacagtgctccatccaaaagactttaaccatacggatcatttctcagtagccatattcaccatccaccggatcctcccccctgactcaggagtttgggtctgcagtgtgaacacagtggctgggatggtggaaaagcccttcaacatttctgttaaagttcttccaaagcccctgaatgccccaaacgtgattgacactggacataactttgctgtcatcaacatcagctctgagccttactttggggatggaccaatcaaatccaagaagcttctatacaaacccgttaatcactatgaggcttggcaacatattcaagtgacaaatgagattgttacactcaactatttggaacctcggacagaatatgaactctgtgtgcaactggtccgtcgtggagagggtggggaagggcatcctggacctgtgagacgcttcacaacagcttctatcggactccctcctccaagaggtctaaatctcctgcctaaaagtcagaccactctaaatttgacctggcaaccaatatttccaagctcggaagatgacttttatgttgaagtggagagaaggtctgtgcaaaaaagtgatcagcagaatattaaagttccaggcaacttgacttcggtgctacttaacaacttacatcccagggagcagtacgtggtccgagctagagtcaacaccaaggcccagggggaatggagtgaagatctcactgcttggacccttagtgacattcttcctcctcaaccagaaaacatcaagatttccaacattacacactcctcagctgtgatttcttggacaatattggatggctattctatttcttctattactatccgttacaaggttcaaggcaagaatgaagaccagcacgttgatgtgaagataaagaatgccaccatcactcagtatcagctcaagggcctagagcctgaaacagcataccaggtggacatttttgcagagaacaacatagggtcaagcaacccagccttttctcatgaactggtgaccctcccagaatctcaagcaccagcggacctcggaggggggaagatgctgcttatagccatccttggctctgctggaatgacctgcctgactgtgctgttggcctttctgatcatattgcaattgaagagggcaaatgtgcaaaggagaatggcccaagccttccaaaacgtgagggaagaaccagctgtgcagttcaactcagggactctggccctaaacaggaaggtcaaaaacaacccagatcctacaatttatccagtgcttgactggaatgacatcaaatttcaagatgtgattggggagggcaattttggccaagttcttaaggcgcgcatcaagaaggatgggttacggatggatgctgccatcaaaagaatgaaagaatatgcctccaaagatgatcacagggactttgcaggagaactggaagttctttgtaaacttggacaccatccaaacatcatcaatctcttaggagcatgtgaacatcgaggctacttgtacctggccattgagtacgcgccccatggaaaccttctggacttccttcgcaagagccgtgtgctggagacggacccagcatttgccattgccaatagcaccgcgtccacactgtcctcccagcagctccttcacttcgctgccgacgtggcccggggcatggactacttgagccaaaaacagtttatccacagggatctggctgccagaaacattttagttggtgaaaactatgtggcaaaaatagcagattttggattgtcccgaggtcaagaggtgtatgtgaaaaagacaatgggaaggctcccagtgcgctggatggccatcgagtcactgaattacagtgtgtacacaaccaacagtgatgtatggtcctatggtgtgttactatgggagattgttagcttaggaggcacaccctactgcgggatgacttgtgcagaactctacgagaagctgccccagggctacagactggagaagcccctgaactgtgatgatgaggtgtatgatctaatgagacaatgctggcgggagaagccttatgagaggccatcatttgcccagatattggtgtccttaaacagaatgttagaggagcgaaagacctacgtgaataccacgctttatgagaagtttacttatgcaggaattgactgttctgctgaagaagcggcctaggacagaacatctgtataccctctgtttccctttcactggcatgggagacccttgacacctgctgagaaaacatgcctctgccaaaggatgtgatatataagtgtacatatgtgctgtacacctgggaccttcaccactgtagatcccatgcatggatctatgtagtatgctctgactctaataggactgtatatactgttttaagaatgggctgaaatcagaatgcctgtttgtggtttcatatgcaataatatatttttttaaaaatgtggacttcataggaaggcgtgagtacaattagtataatgcataactcattgttgtcctagatattttgatatttacctttatgttgaatgctattaaatgttttcctgtgtcaaagtaaaatattgttaataaacctaacaatgaccctgatagtacaggttaagtgagagaactatatgaattctaacaagtcataggttaatatttaagacactgaaaaatctaagtgatataaatcagattcttctctctcaattttatccctcacctgtagcagccagtcccgtttcatttagtcatgtgaccactctgtcttgtgtttccacagcctgcaagtcagtccaggatgctaacatctaaaaatagacttaaatctcattgcttacaagcctaagaatctttagagaagtatacataagtttaggataaaataatgggattttcttttcttttctctggtaatattgacttgtatattttaagaaataacagaaagcctgggtgacatttgggagacatgtgacatttatatattgaattaatatccctacatgtattgcacattgtaaaaagttttagttttgatgagttgtgagtttaccttgtatactgtaggcacactttgcactgatatatcatgagtgaataaatgtcttgcctactcacgtctcat

SEQ ID NO: 21379 - DNA, 3935 bp, Homo sapiens
  ENST00000406359
agacagaaatgagactgttacagcctgcttctgtgctgttccttcttgcctctaacttgtaaacaagacgtagtaggacgatgctaatggaaagtcacaaaccgctgggtttttgaaaggatccttgggacctcatgcacatttgtggaaactggatggagagatttggggaagcatggactctttagccagcttagttctctgtggagtcagcttgctcctttctggaactgtggaaggtgccatggacttgatcttgatcaattccctacctcttgtatctgatgctgaaacatctctcacctgcattgcctctgggtggcgcccccatgagcccatcaccataggaagggactttgaagccttaatgaaccagcaccaggatccgctggaagttactcaagatgtgaccagagaatgggctaaaaaagttgtttggaagagagaaaaggctagtaagatcaatggtgcttatttctgtgaagggcgagttcgaggagaggcaatcaggatacgaaccatgaagatgcgtcaacaagcttccttcctaccagctactttaactatgactgtggacaagggagataacgtgaacatatctttcaaaaaggtattgattaaagaagaagatgcagtgatttacaaaaatggttccttcatccattcagtgccccggcatgaagtacctgatattctagaagtacacctgcctcatgctcagccccaggatgctggagtgtactcggccaggtatataggaggaaacctcttcacctcggccttcaccaggctgatagtccggagatgtgaagcccagaagtggggacctgaatgcaaccatctctgtactgcttgtatgaacaatggtgtctgccatgaagatactggagaatgcatttgccctcctgggtttatgggaaggacgtgtgagaaggcttgtgaactgcacacgtttggcagaacttgtaaagaaaggtgcagtggacaagagggatgcaagtcttatgtgttctgtctccctgacccctatgggtgttcctgtgccacaggctggaagggtctgcagtgcaatgaaggcatacagaggatgaccccaaagatagtggatttgccagatcatatagaagtaaacagtggtaaatttaatcccatttgcaaagcttctggctggccgctacctactaatgaagaaatgaccctggtgaagccggatgggacagtgctccatccaaaagactttaaccatacggatcatttctcagtagccatattcaccatccaccggatcctcccccctgactcaggagtttgggtctgcagtgtgaacacagtggctgggatggtggaaaagcccttcaacatttctgttaaagttcttccaaagcccctgaatgccccaaacgtgattgacactggacataactttgctgtcatcaacatcagctctgagccttactttggggatggaccaatcaaatccaagaagcttctatacaaacccgttaatcactatgaggcttggcaacatattcaagtgacaaatgagattgttacactcaactatttggaacctcggacagaatatgaactctgtgtgcaactggtccgtcgtggagagggtggggaagggcatcctggacctgtgagacgcttcacaacagcttctatcggactccctcctccaagaggtctaaatctcctgcctaaaagtcagaccactctaaatttgacctggcaaccaatatttccaagctcggaagatgacttttatgttgaagtggagagaaggtctgtgcaaaaaagtgatcagcagaatattaaagttccaggcaacttgacttcggtgctacttaacaacttacatcccagggagcagtacgtggtccgagctagagtcaacaccaaggcccagggggaatggagtgaagatctcactgcttggacccttagtgacattcttcctcctcaaccagaaaacatcaagatttccaacattacacactcctcagctgtgatttcttggacaatattggatggctattctatttcttctattactatccgttacaaggttcaaggcaagaatgaagaccagcacgttgatgtgaagataaagaatgccaccatcactcagtatcagctcaagggcctagagcctgaaacagcataccaggtggacatttttgcagagaacaacatagggtcaagcaacccagccttttctcatgaactggtgaccctcccagaatctcaagcaccagcggacctcggaggggggaagatgctgcttatagccatccttggctctgctggaatgacctgcctgactgtgctgttggcctttctgatcatattgcaattgaagagggcaaatgtgcaaaggagaatggcccaagccttccaaaacgtgagggaagaaccagctgtgcagttcaactcagggactctggccctaaacaggaaggtcaaaaacaacccagatcctacaatttatccagtgcttgactggaatgacatcaaatttcaagatgtgattggggagggcaattttggccaagttcttaaggcgcgcatcaagaaggatgggttacggatggatgctgccatcaaaagaatgaaagaatatgcctccaaagatgatcacagggactttgcaggagaactggaagttctttgtaaacttggacaccatccaaacatcatcaatctcttaggagcatgtgaacatcgaggctacttgtacctggccattgagtacgcgccccatggaaaccttctggacttccttcgcaagagccgtgtgctggagacggacccagcatttgccattgccaatagcaccgcgtccacactgtcctcccagcagctccttcacttcgctgccgacgtggcccggggcatggactacttgagccaaaaacagtttatccacagggatctggctgccagaaacattttagttggtgaaaactatgtggcaaaaatagcagattttggattgtcccgaggtcaagaggtgtatgtgaaaaagacaatgggaaggctcccagtgcgctggatggccatcgagtcactgaattacagtgtgtacacaaccaacagtgatgtatggtcctatggtgtgttactatgggagattgttagcttaggaggcacaccctactgcgggatgacttgtgcagaactctacgagaagctgccccagggctacagactggagaagcccctgaactgtgatgatgaggtgtatgatctaatgagacaatgctggcgggagaagccttatgagaggccatcatttgcccagatattggtgtccttaaacagaatgttagaggagcgaaagacctacgtgaataccacgctttatgagaagtttacttatgcaggaattgactgttctgctgaagaagcggcctaggacagaacatctgtataccctctgtttccctttcactggcatgggagacccttgacacctgctgagaaaacatgcctctgccaaaggatgtgatatataagtgtacatatgtgctgtacacctgggaccttcaccactgtagatcccatgcatggatctatgtagtatgctctgactctaataggactgtatatactgttttaagaatgggctgaaatcagaatgcctgtttgtggtttcatatgcaataatatatttttttaaaaatgtggacttcataggaaggcgtgagtacaattagtataatgcataactcattgttgtcctagatattttgatatttacctttatgttgaatgctattaaatgttttcctgtgtcaaagtaaaatattgttaataaacctaacaatgaccctgatagtacaggttaagtgagagaactatatgaattctaacaagtcataggttaatatttaagacactgaaaaatctaagtgatataaatcagattc

SEQ ID NO: 21380 - DNA, 1543 bp, Homo sapiens
  ENST00000519080
gttccttcttgcctctaacttgtaaacaagacgtagtaggacgatgctaatggaaagtcacaaaccgctgggtttttgaaaggatccttgggacctcatgcacatttgtggaaactggatggagagatttggggaagcatggactctttagccagcttagttctctgtggagtcagcttgctcctttctgtgccccggcatgaagtacctgatattctagaagtacacctgcctcatgctcagccccaggatgctggagtgtactcggccaggtatataggaggaaacctcttcacctcggccttcaccaggctgatagtccggagatgtgaagcccagaagtggggacctgaatgcaaccatctctgtactgcttgtatgaacaatggtgtctgccatgaagatactggagaatgcatttgccctcctgggtttatgggaaggacgtgtgagaaggcttgtgaactgcacacgtttggcagaacttgtaaagaaaggtgcagtggacaagagggatgcaagtcttatgtgttctgtctccctgacccctatgggtgttcctgtgccacaggctggaagggtctgcagtgcaatgaaggcatacagaggatgaccccaaagatagtggatttgccagatcatatagaagtaaacagtggtaaatttaatcccatttgcaaagcttctggctggccgctacctactaatgaagaaatgaccctggtgaagccggatgggacagtgctccatccaaaagactttaaccatacggatcatttctcagtagccatattcaccatccaccggatcctcccccctgactcaggagtttgggtctgcagtgtgaacacagtggctgggatggtggaaaagcccttcaacatttctgttaaagttcttccaaagcccctgaatgccccaaacgtgattgacactggacataactttgctgtcatcaacatcagctctgagccttactttggggatggaccaatcaaatccaagaagcttctatacaaacccgttaatcactatgaggcttggcaacatattcaagtgacaaatgagattgttacactcaactatttggaacctcggacagaatatgaactctgtgtgcaactggtccgtcgtggagagggtggggaagggcatcctggacctgtgagacgcttcacaacagcttctatcggactccctcctccaagaggtctaaatctcctgcctaaaagtcagaccactctaaatttgacctggcaaccaatatttccaagctcggaagatgacttttatgttgaagtggagagaaggtctgtgcaaaaaagtgatcagcagaatattaaagttccaggcaacttgacttcggtgctacttaacaacttacatcccagggagcagtacgtggtccgagctagagtcaacaccaaggcccagggggaatggagtgaagatctcactgcttggacccttagtgacattcttcctcctcaaccagaaaacatcaagatttccaacattacacactcctcagctgtgatttctt

SEQ ID NO: 21381 - DNA, 4666 bp, Homo sapiens
  ENST00000615002
agtttcccgcctatgagaggatacccctattgtttctgaaaatgctgaccgggacccacacttccaacaaaaattcctctgcccctacagcagcagcaaaagcagcagcagaagcaacagcaacagataagtgttttgatgaattgcgagatggatagggcttgagtgcccccagccctgctgataccaaatgcctttaagatacagcctttcccatcctaatctacaaaggaaacaggaaaaaggaacttaaaactccctgtgctcagacagaaatgagactgttacagcctgcttctgtgctgttccttcttgcctctaacttgtaaacaagacgtagtaggacgatgctaatggaaagtcacaaaccgctgggtttttgaaaggatccttgggacctcatgcacatttgtggaaactggatggagagatttggggaagcatggactctttagccagcttagttctctgtggagtcagcttgctcctttctggaactgtggaaggtgccatggacttgatcttgatcaattccctacctcttgtatctgatgctgaaacatctctcacctgcattgcctctgggtggcgcccccatgagcccatcaccataggaagggactttgaagccttaatgaaccagcaccaggatccgctggaagttactcaagatgtgaccagagaatgggctaaaaaagttgtttggaagagagaaaaggctagtaagatcaatggtgcttatttctgtgaagggcgagttcgaggagaggcaatcaggatacgaaccatgaagatgcgtcaacaagcttccttcctaccagctactttaactatgactgtggacaagggagataacgtgaacatatctttcaaaaaggtattgattaaagaagaagatgcagtgatttacaaaaatggttccttcatccattcagtgccccggcatgaagtacctgatattctagaagtacacctgcctcatgctcagccccaggatgctggagtgtactcggccaggtatataggaggaaacctcttcacctcggccttcaccaggctgatagtccggagatgtgaagcccagaagtggggacctgaatgcaaccatctctgtactgcttgtatgaacaatggtgtctgccatgaagatactggagaatgcatttgccctcctgggtttatgggaaggacgtgtgagaaggcttgtgaactgcacacgtttggcagaacttgtaaagaaaggtgcagtggacaagagggatgcaagtcttatgtgttctgtctccctgacccctatgggtgttcctgtgccacaggctggaagggtctgcagtgcaatgaaggcatacagaggatgaccccaaagatagtggatttgccagatcatatagaagtaaacagtggtaaatttaatcccatttgcaaagcttctggctggccgctacctactaatgaagaaatgaccctggtgaagccggatgggacagtgctccatccaaaagactttaaccatacggatcatttctcagtagccatattcaccatccaccggatcctcccccctgactcaggagtttgggtctgcagtgtgaacacagtggctgggatggtggaaaagcccttcaacatttctgttaaagttcttccaaagcccctgaatgccccaaacgtgattgacactggacataactttgctgtcatcaacatcagctctgagccttactttggggatggaccaatcaaatccaagaagcttctatacaaacccgttaatcactatgaggcttggcaacatattcaagtatccatggagaaacagaggctgactaaagcaaatagtgacaaatgagattgttacactcaactatttggaacctcggacagaatatgaactctgtgtgcaactggtccgtcgtggagagggtggggaagggcatcctggacctgtgagacgcttcacaacagcttctatcggactccctcctccaagaggtctaaatctcctgcctaaaagtcagaccactctaaatttgacctggcaaccaatatttccaagctcggaagatgacttttatgttgaagtggagagaaggtctgtgcaaaaaagtgatcagcagaatattaaagttccaggcaacttgacttcggtgctacttaacaacttacatcccagggagcagtacgtggtccgagctagagtcaacaccaaggcccagggggaatggagtgaagatctcactgcttggacccttagtgacattcttcctcctcaaccagaaaacatcaagatttccaacattacacactcctcagctgtgatttcttggacaatattggatggctattctatttcttctattactatccgttacaaggttcaaggcaagaatgaagaccagcacgttgatgtgaagataaagaatgccaccatcactcagtatcagctcaagggcctagagcctgaaacagcataccaggtggacatttttgcagagaacaacatagggtcaagcaacccagccttttctcatgaactggtgaccctcccagaatctcaagcaccagcggacctcggaggggggaagatgctgcttatagccatccttggctctgctggaatgacctgcctgactgtgctgttggcctttctgatcatattgcaattgaagagggcaaatgtgcaaaggagaatggcccaagccttccaaaacgtgagggaagaaccagctgtgcagttcaactcagggactctggccctaaacaggaaggtcaaaaacaacccagatcctacaatttatccagtgcttgactggaatgacatcaaatttcaagatgtgattggggagggcaattttggccaagttcttaaggcgcgcatcaagaaggatgggttacggatggatgctgccatcaaaagaatgaaagaatatgcctccaaagatgatcacagggactttgcaggagaactggaagttctttgtaaacttggacaccatccaaacatcatcaatctcttaggagcatgtgaacatcgaggctacttgtacctggccattgagtacgcgccccatggaaaccttctggacttccttcgcaagagccgtgtgctggagacggacccagcatttgccattgccaatagcaccgcgtccacactgtcctcccagcagctccttcacttcgctgccgacgtggcccggggcatggactacttgagccaaaaacagtttatccacagggatctggctgccagaaacattttagttggtgaaaactatgtggcaaaaatagcagattttggattgtcccgaggtcaagaggtgtatgtgaaaaagacaatgggaaggctcccagtgcgctggatggccatcgagtcactgaattacagtgtgtacacaaccaacagtgatgtatggtcctatggtgtgttactatgggagattgttagcttaggaggcacaccctactgcgggatgacttgtgcagaactctacgagaagctgccccagggctacagactggagaagcccctgaactgtgatgatgaggtgtatgatctaatgagacaatgctggcgggagaagccttatgagaggccatcatttgcccagatattggtgtccttaaacagaatgttagaggagcgaaagacctacgtgaataccacgctttatgagaagtttacttatgcaggaattgactgttctgctgaagaagcggcctaggacagaacatctgtataccctctgtttccctttcactggcatgggagacccttgacacctgctgagaaaacatgcctctgccaaaggatgtgatatataagtgtacatatgtgctgtacacctgggaccttcaccactgtagatcccatgcatggatctatgtagtatgctctgactctaataggactgtatatactgttttaagaatgggctgaaatcagaatgcctgtttgtggtttcatatgcaataatatatttttttaaaaatgtggacttcataggaaggcgtgagtacaattagtataatgcataactcattgttgtcctagatattttgatatttacctttatgttgaatgctattaaatgttttcctgtgtcaaagtaaaatattgttaataaacctaacaatgaccctgatagtacaggttaagtgagagaactatatgaattctaacaagtcataggttaatatttaagacactgaaaaatctaagtgatataaatcagattcttctctctcaattttatccctcacctgtagcagccagtcccgtttcatttagtcatgtgaccactctgtcttgtgtttccacagcctgcaagtcagtccaggatgctaacatctaaaaatagacttaaatctcattgcttacaagcctaagaatctttagagaagtatacataagtttaggataaaataatgggattttcttttcttttctctggtaatattgacttgtatattttaagaaataacagaaagcctgggtgacatttgggagacatgtgacatttatatattgaattaatatccctacatgtattgcacattgtaaaaagttttagttttgatgagttgtgagtttaccttgtatactgtaggcacactttgcactgatatatcatgagtgaataaatgtcttgcctactcacgtctc

SEQ ID NO: 21382 - DNA, 2782 bp, Homo sapiens
  ENST00000358204
attggctgcccggccccctttgttcccgggtccgggccgcaggcccgctgcggcggactgggcggcggaagttcgacggcgccgggcgagtggctgttgagcggcgccgcgggagttccgcaggtttcccgtgttcgcagcggagccggaggccagctgaacccggccgtgggatcccggataggaggaggaggggacccataggacgcgttaacatggacctggaaaacaaagtgaagaagatgggcttaggtcacgagcaaggatttggagccccttgtttaaaatgcaaagaaaaatgtgaaggattcgaactgcacttctggagaaaaatatgtcgtaactgcaagtgtggccaagaagagcatgatgtcctcttgagcaatgaagaggatcgaaaagtgggaaaactttttgaagacaccaagtataccactctgattgcaaaactaaagtcagatggaattcccatgtataaacgcaatgttatgatattgacgaatccagttgctgccaagaagaatgtctccatcaatacagttacctatgagtgggctcctcctgtccagaatcaagcattggccaggcagtacatgcagatgctacccaaggaaaagcagccagtagcaggctcagagggggcacagtaccggaagaagcagctggcaaagcagctccctgcacatgaccaggacccttcaaagtgccatgagttgtctcccagagaggtgaaggagatggagcagtttgtgaagaaatataagagcgaagctctgggagtaggagatgtcaaacttccctgtgagatggatgcccaaggccccaaacaaatgaacattcctggaggggatagaagcaccccagcagcagtgggggccatggaggacaaatctgctgagcacaaaagaactcaatattcctgctattgctgcaaactgagtatgaaagaaggtgacccagccatctatgccgaaagggctggctatgataaactgtggcacccagcttgttttgtctgcagcacctgccatgaactcctggttgacatgatttatttttggaagaatgagaagctatactgtggcagacattactgtgacagcgagaaaccccgatgtgctggctgtgacgagctgatattcagcaatgagtatacccaggcagaaaaccagaattggcacctgaaacacttctgctgctttgactgtgatagcattctagctggggagatatacgtgatggtcaatgacaagcccgtgtgcaagccctgctatgtgaagaatcacgctgtggtgtgtcaaggatgccacaatgccatcgacccagaagtgcagcgggtgacctataacaatttcagctggcatgcatccacagagtgctttctgtgctcttgctgcagcaaatgcctcattgggcagaagttcatgccagtagaagggatggttttctgttcagtggaatgtaagaagaggatgtcttaggaggagggcacccagaagtatcgagccatagctatccaaagtggtctgcatttctactgtaaaatgcaatttgaaaaaaataaaacgcaaaaaaagaaactgtaaaggaaaccaagagattttgtttaatttttttggccattttttcttcatcaattttttttcggtctcaacttttaaacttggtttaagcatttgatttgtaaaacagtaaataattgtatctttccatagcttttcaaatgtgaaatcatttttggaagcttggatctcattaaacttcatgtctctattccatttgtgccacacacttaaaagttagtgtactgaatggaaagatgagcattcctagttctacacttcttttttccccctcatgtgtaaaatgaaaagaaaactaaatttgccctaataccaaggcgctacgtttattgcctcgtcttattcactgacctttgtaatgatacacagtgaattctttttgacaaagagaaatgcagtgtagtatgcagagctgctgttttaatgcctatgcatttactctttcctgatttaggcagaggtggcattttctttattgcatttctctatttttttaatgtaccctaccttcagtattctctttgtaagttggtgacttgcatctgtggccttgaatattttattatcacatgtggcataacagtatccacactttttagttctttatttttttttttttattttgagcaattctcctgcctcagcctcccaaatagctgggattacaggtgcatgccaccacacccagctaatttttgtatttttagtagagacaggttttcaccatgttagccaggctggtctcaaactcctgacctcagatgatccgcctgccttggcctcccaaagtgctgggattacaggtgtgggagccaccatgcctgacccacacactttttacttgtatagatgatttttggcttggacataaaagccaagccacccatttgcttttaatccaaagaacatgtatagtttttgtacccagagactatgatttatattgattgcacttgcctgccatgatttagataagattttttttgcatggtttttattctttcctaatggatcctgttttataatacttccaagcctgtccatggatatatcaaatgtcttcacttgtatattttcatggctaggtatttctaatgtttattcttccctgtgtacttctacacatagctatgcactatgaaaattaaatggaatgaatgatatgtatattactcaaaataaagtttctttcactttaa

SEQ ID NO: 21383 - DNA, 873 bp, Homo sapiens
  ENST00000461440
ccccctttgttcccgggtccgggccgcaggcccgctgcggcggactgggcggcggaagttcgacggcgccgggcgagtggctgttgagcggcgccgcgggagttccgcaggtttcccgtgttcgcagcggagccggaggccagctgaacccggccgtgggatcccggataggaggaggaggggacccataggacgcgttaacatggacctggaaaacaaagtgaagaagatgggcttaggtcacgagcaaggatttggagccccttgtttaaaatgcaaagaaaaatgtgaaggattcgaactgcacttctggagaaaaatatgtcgtaactgcaagtgtggccaagaagagcatgatgtcctcttgagcaatgaagaggatcgaaaagtgggaaaactttttgaagacaccaagtataccactctgattgcaaaactaaagtcagatggaattcccatgtataaacgcaatgttatgatattgacgaatccagttgctgccaagaagaatgtctccatcaatacagttacctatgagtgggctcctcctgtccagaatcaagcattggtaaatgatatggaacagagagtttctttattgaagttcctggagtatttatttggggcagtttctttgatgacctaatcaacttcacacatcccagatctgttattcttccggggttctcattactttgacttctgattcctgttctagtcttttgaatgtaagactagatacttcataaaatttttccaactccctagatatgtttacctttttgagggaatggtctaacgttcttaataattagatggaaatcagatgttttatatcaatctagtaactcttctagcttagtcttgagagga

SEQ ID NO: 21384 - DNA, 577 bp, Homo sapiens
  ENST00000455989
gctgcggcggactgggcggcggaagttcgacggcgccgggcgagtggctgttgagcggcgccgcgggagttccgcaggtttcccgtgttcgcagcggagccggaggccagctgaacccggccgtgggatcccggataggaggaggaggggacccataggacgcgttaacatggacctggaaaacaaagtgaagaagaaaaatatgtcgtaactgcaagtgtggccaagaagagcatgatgtcctcttgagcaatgaagaggatcgaaaagtgggaaaactttttgaagacaccaagtataccactctgattgcaaaactaaagtcagatggaattcccatgtataaacgcaatgttatgatattgacgaatccagttgctgccaagaagaatgtctccatcaatacagttacctatgagtgggctcctcctgtccagaatcaagcattggccaggcagtacatgcagatgctacccaaggaaaagcagccagtagcaggctcagagggggcacagtaccggaagaagcagctggcaaagcagctccctgcacatgaccaggacccttcaaagtgcca

SEQ ID NO: 21385 - DNA, 1022 bp, Homo sapiens
  ENST00000492891
actgggcggcggaagttcgacggcgccgggcgagtggctgttgagcggcgccgcgggagttccgcaggtttcccgtgttcgcagcggagccggaggccagctgaacccggccgtgggatcccggataggaggaggaggggacccataggacgcgttaacatggacctggaaaacaaagtgaagaagatgggcttaggtcacgagcaaggatttggagccccttgtttaaaatgcaaagaaaaatgtgaaggattcgaactgcacttctggagtcctgctattgctgcaaactgagtatgaaagaaggtgacccagccatctatgccgaaagggctggctatgataaactgtggcacccagcttgttttgtctgcagcacctgccatgaactcctggttgacatgatttatttttggaagaatgagaagctatactgtggcagacattactgtgacagcgagaaaccccgatgtgctggctgtgacgagctgatattcagcaatgagtatacccaggcagaaaaccagaattggcacctgaaacacttctgctgctttgactgtgatagcattctagctggggagatatacgtgatggtcaatgacaagcccgtgtgcaagccctgctatgtgaagaatcacgctgtggtgtgtcaaggatgccacaatgccatcgacccagaagtgcagcgggtgacctataacaatttcagctggcatgcatccacagagtgctttctgtgctcttgctgcagcaaatgcctcattgggcagaagttcatgccagtagaagggatggttttctgttcagtggaatgtaagaagaggatgtcttaggaggagggcacccagaagtatcgagccatagctatccaaagtggtctgcatttctactgtaaaatgcaatttgaaaaaaataaaacgcaaaaaaagaaactgtaaaggaaaccaagagattttgtttaatttttttggccattttttcttcatcaattttttttcggtctcaacttttaaacttgg

SEQ ID NO: 21386 - DNA, 961 bp, Homo sapiens
  ENST00000496871
aagttcgacggcgccgggcgagtggctgttgagcggcgccgcgggagttccgcaggtttcccgtgttcgcagcggagccggaggccagctgaacccggccgtgggatcccggataggaggaggaggggacccataggacgcgttaacatggacctggaaaacaaagtgaagaagaaaaatatgtcgtaactgcaagtgtggccaagaagagcatgatgtcctcttgagcaatgaagaggatcgaaaagtgggaaaactttttgaagacaccaagtataccactctgattgcaaaactaaagtcagatggaattcccatgtataaacgcaatgttatgatattgacgaatccagttgctgccaagaagaatgtctccatcaatacagttacctatgagtgggctcctcctgtccagaatcaagcattggtaaatgatatggaacagagagtttctttattgaagttcctggagtatttatttggggcagtttctttgatgacctaatcaacttcacacatcccagatctgttattcttccggggttctcattactttgacttctgattcctgttctagtcttttgaatgtaagactagatacttcataaaatttttccaactccctagatatgtttacctttttgagggaatggtctaacgttcttaataattagatggaaatcagatgttttatatcaatctagtaactcttctagcttagtcttgagaggatttatcttaagatggtaaagaagagaatttttgtcatagtttagaactgaaaaaaatattcaacattatctttgtgtttttttcatttcctttattaatactatataagaccaaaaagatcacagttttatatcaagctccttccactattataacaaccaaatgaaacatttggaagtcttttaaggttagttaaatcattaaagtgaattttgcgatatcatttttt

SEQ ID NO: 21387 - DNA, 2763 bp, Homo sapiens
  ENST00000393481
aataaataggaggttttgagggctgtttatgagcgcattccattacagtgtctttcagcggagccagagctcagccaatcctaattaagaagcaatttcagctgcagtcattgcttattataataattgtgacatttttatagccctacattgtctttctcaaagtaacggattcaggaggagtccttttctgagtagagtccacagaagaggtattctattgatgggcttaggtcacgagcaaggatttggagccccttgtttaaaatgcaaagaaaaatgtgaaggattcgaactgcacttctggagaaaaatatgtcgtaactgcaagtgtggccaagaagagcatgatgtcctcttgagcaatgaagaggatcgaaaagtgggaaaactttttgaagacaccaagtataccactctgattgcaaaactaaagtcagatggaattcccatgtataaacgcaatgttatgatattgacgaatccagttgctgccaagaagaatgtctccatcaatacagttacctatgagtgggctcctcctgtccagaatcaagcattggccaggcagtacatgcagatgctacccaaggaaaagcagccagtagcaggctcagagggggcacagtaccggaagaagcagctggcaaagcagctccctgcacatgaccaggacccttcaaagtgccatgagttgtctcccagagaggtgaaggagatggagcagtttgtgaagaaatataagagcgaagctctgggagtaggagatgtcaaacttccctgtgagatggatgcccaaggccccaaacaaatgaacattcctggaggggatagaagcaccccagcagcagtgggggccatggaggacaaatctgctgagcacaaaagaactcaatattcctgctattgctgcaaactgagtatgaaagaaggtgacccagccatctatgccgaaagggctggctatgataaactgtggcacccagcttgttttgtctgcagcacctgccatgaactcctggttgacatgatttatttttggaagaatgagaagctatactgtggcagacattactgtgacagcgagaaaccccgatgtgctggctgtgacgagctgatattcagcaatgagtatacccaggcagaaaaccagaattggcacctgaaacacttctgctgctttgactgtgatagcattctagctggggagatatacgtgatggtcaatgacaagcccgtgtgcaagccctgctatgtgaagaatcacgctgtggtgtgtcaaggatgccacaatgccatcgacccagaagtgcagcgggtgacctataacaatttcagctggcatgcatccacagagtgctttctgtgctcttgctgcagcaaatgcctcattgggcagaagttcatgccagtagaagggatggttttctgttcagtggaatgtaagaagaggatgtcttaggaggagggcacccagaagtatcgagccatagctatccaaagtggtctgcatttctactgtaaaatgcaatttgaaaaaaataaaacgcaaaaaaagaaactgtaaaggaaaccaagagattttgtttaatttttttggccattttttcttcatcaattttttttcggtctcaacttttaaacttggtttaagcatttgatttgtaaaacagtaaataattgtatctttccatagcttttcaaatgtgaaatcatttttggaagcttggatctcattaaacttcatgtctctattccatttgtgccacacacttaaaagttagtgtactgaatggaaagatgagcattcctagttctacacttcttttttccccctcatgtgtaaaatgaaaagaaaactaaatttgccctaataccaaggcgctacgtttattgcctcgtcttattcactgacctttgtaatgatacacagtgaattctttttgacaaagagaaatgcagtgtagtatgcagagctgctgttttaatgcctatgcatttactctttcctgatttaggcagaggtggcattttctttattgcatttctctatttttttaatgtaccctaccttcagtattctctttgtaagttggtgacttgcatctgtggccttgaatattttattatcacatgtggcataacagtatccacactttttagttctttatttttttttttttattttgagcaattctcctgcctcagcctcccaaatagctgggattacaggtgcatgccaccacacccagctaatttttgtatttttagtagagacaggttttcaccatgttagccaggctggtctcaaactcctgacctcagatgatccgcctgccttggcctcccaaagtgctgggattacaggtgtgggagccaccatgcctgacccacacactttttacttgtatagatgatttttggcttggacataaaagccaagccacccatttgcttttaatccaaagaacatgtatagtttttgtacccagagactatgatttatattgattgcacttgcctgccatgatttagataagattttttttgcatggtttttattctttcctaatggatcctgttttataatacttccaagcctgtccatggatatatcaaatgtcttcacttgtatattttcatggctaggtatttctaatgtttattcttccctgtgtacttctacacatagctatgcactatgaaaattaaatggaatgaatgatatgtatattactcaaaataaagtttctttcactttaa

SEQ ID NO: 21388 - DNA, 1175 bp, Homo sapiens
  ENST00000485009
acattgtctttctcaaagtaacggattcaggaggagtccttttctgagtagagtccacagaagaggtattctattgatgggcttaggtcacgagcaaggatttggagccccttgtttaaaatgcaaagaaaaatgtgaaggattcgaactgcacttctggagaaaaatatgtcgtaactgcaagtgtggccaagaagagcatgatgtcctcttgagcaatgaagaggatcgaaaagtgggaaaactttttgaagacaccaagtataccactctgattgcaaaactaaagtcagatggaattcccatgtataaacgcaatgttatgatattgacgaatccagttgctgccaagaagaatgtctccatcaatacagttacctatgagtgggctcctcctgtccagaatcaagcattggtaaatgatatggaacagagagtttctttattgaagttcctggagtatttatttggggcagtttctttgatgacctaatcaacttcacacatcccagatctgttattcttccggggttctcattactttgacttctgattcctgttctagtcttttgaatgtaagactagatacttcataaaatttttccaactccctagatatgtttacctttttgagggaatggtctaacgttcttaataattagatggaaatcagatgttttatatcaatctagtaactcttctagcttagtcttgagaggatttatcttaagatggtaaagaagagaatttttgtcatagtttagaactgaaaaaaatattcaacattatctttgtgtttttttcatttcctttattaatactatataagaccaaaaagatcacagttttatatcaagctccttccactattataacaaccaaatgaaacatttggaagtcttttaaggttagttaaatcattaaagtgaattttgcgatatcattttttatgtaataaaaatgttcctggtcctacagaccattccaaacatgtctgcctaaaagtttatgttttctttcaattgtacatttgtttatttagcttaagtaaacagtagtaactcagatcttacaaactgaaaaaatatataatttcatggagagaaagtgttactttttacccaactaaatctatttagtgtaccgtttttgagttttaacttcttaatatactg

SEQ ID NO: 21389 - DNA, 699 bp, Homo sapiens
  ENST00000393484
gcaccccagcagcagtgggggccatggaggacaaatctgctgagcacaaaagaactcaatattcctgctattgctgcaaactgagtatgaaagaaggtgacccagccatctatgccgaaagggctggctatgataaactgtggcacccagcttgttttgtctgcagcacctgccatgaactcctggttgacatgatttatttttggaagaatgagaagctatactgtggcagacattactgtgacagcgagaaaccccgatgtgctggctgtgacgagctgatattcagcaatgagtatacccaggcagaaaaccagaattggcacctgaaacacttctgctgctttgactgtgatagcattctagctggggagatatacgtgatggtcaatgacaagcccgtgtgcaagccctgctatgtgaagaatcacgctgtggtgagaagtgttctaaggatatggttgcctcagcctgctttaggacttgagtttatgcttttcttaaagcctcttacaaatgggaaacagaaagcagtcctcctaagtagaaagcaaattattcctaccacagggtgttaaaatcaaggcaattcaaaaacaatacatgcattgactatgagccacctcaagatttctacttgtgaaatttacaatatcaattataggtactgcttaataataaaatcctcacttaaaaaaa

SEQ ID NO: 21390 - DNA, 331 bp, Homo sapiens
  ENST00000494384
gtgggggccatggaggacaaatctgctgagcacaaaagaactcaatatctgatattcagcaatgagtatacccaggcagaaaaccagaattggcacctgaaacacttctgctgctttgactgtgatagcattctagctggggagatatacgtgatggtcaatgacaagcccgtgtgcaagccctgctatgtgaagaatcacgctgtggtgagaagtgttctaaggatatggttgcctcagcctgctttaggacttgagtttatgcttttcttaaagcctcttacaaatgggaaacagaaagcagtcctcctaagtagaaagcaaattattc

SEQ ID NO: 21391 - DNA, 911 bp, Homo sapiens
  ENST00000496912
cccgtctctactaaaaatacaaaaaaattagccgggcgtggtggcaggcgcctgtagtcccagctactcgggaggctgaggcaggagaacggcgtgaacccaggaggcggagcttgcaatgagccgagatagcaccactggactccagcctgggcgacagagtgagactcagtctcaaaaaaaaaaaaagaaagaaagaaaagaaatggcagtcttctaatgactaggttgttctggatggcttccctttcagtcctgctattgctgcaaactgagtatgaaagaaggtgacccagccatctatgccgaaagggctggctatgataaactgtggcacccagcttgttttgtctgcagcacctgccatgaactcctggttgacatgatttatttttggaagaatgagaagctatactgtggcagacattactgtgacagcgagaaaccccgatgtgctggctgtgacgagctgatattcagcaatgagtatacccaggcagaaaaccagaattggcacctgaaacacttctgctgctttgactgtgatagcattctagctggggagatatacgtgatggtcaatgacaagcccgtgtgcaagccctgctatgtgaagaatcacgctgtggtgtgtcaaggatgccacaatgccatcgacccagaagtgcagcgggtgacctataacaatttcagctggcatgcatccacagagtgctttctgtgctcttgctgcagcaaatgcctcattgggcagaagttcatgccagtagaagggatggttttctgttcagtggaatgtaagaagaggatgtcttaggaggagggcacccagaagtatcgagccatagctatccaaagtggtctgcatttctactgtaaaatgcaatttgaaaaaaataaaacgcaaaaaa

SEQ ID NO: 21392 - DNA, 488 bp, Homo sapiens
  ENST00000463746
ccctttcagtcctgctattgctgcaaactgagtatgaaagaaggtgacccagccatctatgccgaaagggctggctatgataaactgtggcacccagcttgttttgtctgcagcacctgccatgaactcctggttgacatgatttatttttggaagaatgagaagctatactgtggcagacattactgtgacagcgagaaaccccgatgtgctggctgtgacgagctgatattcagcaatgagtatacccaggcagaaaaccagaattggcacctgaaacacttctgctgctttgactgtgatagcattctagctggggagatatacgtgatggtcaatgacaagcccgtgtgcaagccctgctatgtgaagaatcacgctgtggtgagaagtgttctaaggatatggttgcctcagcctgctttaggacttgagtttatgcttttcttaaagcctcttacaaatgggaaacagaaagcagtcctcct

SEQ ID NO: 21393 - DNA, 1057 bp, Homo sapiens
  ENST00000470612
gtgcgctaggaccgcggcgcgccgccctccgccgttatatgaggccccgctccggccccacgcggaacccgcggctccgagccttcgccggcgtcccgacccgaggccggacccgaggccagtcccgccgctgcgcagccgaagccagtgcggggcctgagagggacgcgcgccccggggcccccgccgcgggcaccatgggcgctgcccactccgcgtctgaggaggtgcgggagctcgagggcaagaccggcttctcatcggatcagatcgagcagctccatcggagatttaagcagctgagtggagatcagcctaccattcgcaaggagaacttcaacaatgtcccggacctggagctcaaccccatccgatccaaaattgttcgtgccttcttcgacaacaggaacctgcgcaagggacccagtggcctggctgatgagatcaatttcgaggacttcctgaccatcatgtcctacttccggcccatcgacaccaccatggacgaggaacaggtggagctgtcccggaaggagaagctgagatttctgttccacatgtacgactcggacagcgacggccgcatcactctggaagaatatcgaaatgtaaagtggtcgaggagctgctgtcgggaaaccctcacatcgagaaggagtccgctcgctccatcgccgacggggccatgatggaggcggccagcgtgtgcatggggcagatggagcctgatcaggtgtacgaggggatcaccttcgaggacttcctgaagatctggcaggggatcgacattgagaccaagatgcacgtccgcttccttaacatggaaaccatggccctctgccactgacccaccgccacctccgcggagaaactgcactttgcaatggggccgcctccccgcgtagctggagcagcccaggcccggcggacagcctcttcctgcagcgccggtacatagccaaggctcgtctgcgcaccttgtgtcttgtagggtatggtatgtgggacttcgctgtttttatctccaataaaaaaaaaaaaaaggtttgttaattaa

SEQ ID NO: 21394 - DNA, 1041 bp, Homo sapiens
  ENST00000335209
accgcggcgcgccgccctccgccgttatatgaggccccgctccggccccacgcggaacccgcggctccgagccttcgccggcgtcccgacccgaggccggacccgaggccagtcccgccgctgcgcagccgaagccagtgcggggcctgagagggacgcgcgccccggggcccccgccgcgggcaccatgggcgctgcccactccgcgtctgaggaggtgcgggagctcgagggcaagaccggcttctcatcggatcagatcgagcagctccatcggagatttaagcagctgagtggagatcagcctaccattcgcaaggagaacttcaacaatgtcccggacctggagctcaaccccatccgatccaaaattgttcgtgccttcttcgacaacaggaacctgcgcaagggacccagtggcctggctgatgagatcaatttcgaggacttcctgaccatcatgtcctacttccggcccatcgacaccaccatggacgaggaacaggtggagctgtcccggaaggagaagctgagatttctgttccacatgtacgactcggacagcgacggccgcatcactctggaagaatatcgaaatgtggtcgaggagctgctgtcgggaaaccctcacatcgagaaggagtccgctcgctccatcgccgacggggccatgatggaggcggccagcgtgtgcatggggcagatggagcctgatcaggtgtacgaggggatcaccttcgaggacttcctgaagatctggcaggggatcgacattgagaccaagatgcacgtccgcttccttaacatggaaaccatggccctctgccactgacccaccgccacctccgcggagaaactgcactttgcaatggggccgcctccccgcgtagctggagcagcccaggcccggcggacagcctcttcctgcagcgccggtacatagccaaggctcgtctgcgcaccttgtgtcttgtagggtatggtatgtgggacttcgctgtttttatctccaataaaaaaaaaaaaaaggtttgttaatta

SEQ ID NO: 21395 - DNA, 422 bp, Homo sapiens
  ENST00000549210
ccacatgtacgactcggacagcgacggccgcatcactctggaagaatatcgaaatgtaaagtggtcgaggagctgctgtcgggaaaccctcacatcgagaaggagtccgctcgctccatcgccgacggggccatgatggaggcggccagcgtgtgcatggggcagatgatctggcaggggatcgacattgagaccaagatgcacgtccgcttccttaacatggaaaccatggccctctgccactgacccaccgccacctccgcggagaaactgcactttgcaatggggccgcctccccgcgtagctggagcagcccaggcccggcggacagcctcttcctgcagcgccggtacatagccaaggctcgtctgcgcaccttgtgtcttgtagggtatggtatgtgggacttcgctgtttttatc

SEQ ID NO: 21396 - DNA, 854 bp, Homo sapiens
  ENST00000462502
cggctccgagccttcgccggcgtcccgacccgaggccggacccgaggccagtcccgccgctgcgcagccgaagccagtgcggggcctgagagggacgcgcgccccggggcccccgccgcgggcaccatgggcgctgcccactccgcgtctgaggaggtgcgggagctcgagggcaagaccggcttctcatcggatcagatcgagcagctccatcggagatttaagcagctgagtggagatcagcctaccattcgcaaggagaacttcaacaatgtcccggacctggagctcaaccccatccgatccaaaattgttcgtgccttcttcgacaacaggaacctgcgcaagggacccagtggcctggctgatgagatcaatttcgaggacttcctgaccatcatgtcctacttccggcccatcgacaccaccatggacgaggaacaggtggagctgtcccggaaggagaagctgagatcttgtggcttcctgggactagaagggggttgtgcggtggatgtgaaacaaggcccttgatgcaaagacctgggttccagtgtggcccgtctcaccagccatgtgaccttgaaccttgacccagaacgtggttctgttccacatgtacgactcggacagcgacggccgcatcactctggaagaatatcgaaatgtggtcgaggagctgctgtcgggaaaccctcacatcgagaaggagtccgctcgctccatcgccgacggggccatgatggaggcggccagcgtgtgcatggggcagatggtgagcgcccctgcagccctcccgagacgcgcagtgcctttcccgcttatggtctgcgtttctggaaggcctcatgggg

SEQ ID NO: 21397 - DNA, 367 bp, Homo sapiens
  ENST00000535198
caaagacagagtggaatccggtgccctcacctccttttaaatcctggttctcagagaaaggactcaggaacctgcgcaagggacccagtggcctggctgatgagatcaatttcgaggacttcctgaccatcatgtcctacttccggcccatcgacaccaccatggacgaggaacaggtggagctgtcccggaaggagaagctgagatttctgttccacatgtacgactcggacagcgacggccgcatcactctggaagaatatcgaaatgtggtcgaggagctgctgtcgggaaaccctcacatcgagaaggagtccgctcgctccatcgccgacggggccatgatggaggcggccagcgtgtgcat

SEQ ID NO: 21398 - DNA, 841 bp, Homo sapiens
  ENST00000482176
gctccggccccacgcggaacccgcggctccgagccttcgccggcgtcccgacccgaggccggacccgaggccagtcccgccgctgcgcagccgaagccagtgcggggcctgagagggacgcgcgccccggggcccccgccgcgggcaccatgggcgctgcccactccgcgtctgaggaggtgcgggagctcgagggcaagaccggctatggagtcttgctctgccacccaggctggagttcagtggtgctatctcagctcactgcaacctccgcctcctgggttcaaacgattctcctgcgtcagcctccccagaagctgggactacagtctcatcggatcagatcgagcagctccatcggagatttaagcagctgagtggagatcagcctaccattcgcaaggagaacttcaacaatgtcccggacctggagctcaaccccatccgatccaaaattgttcgtgccttcttcgacaacaggaacctgcgcaagggacccagtggcctggctgatgagatcaatttcgaggacttcctgaccatcatgtcctacttccggcccatcgacaccaccatggacgaggaacaggtggagctgtcccggaaggagaagctgagatgtgcgtgccactgagtccccttgctcacacctggcctggggtgcagcctcccctaagacctcagaacgcaaggcgcctctgcagcaggaggctgggtgtgcattggcttgggggcttggagggcttggggccaccagccctcgtccctgtgaggctggcattgctgtctcccgttcccggcaccttcatcctaaacattcctcagcagcttgtggcttcct

SEQ ID NO: 21399 - DNA, 307 bp, Homo sapiens
  ENST00000552139
agagcactttgcccggagcccagcgtcctcccctgagttcgctgagtctcccgggaccagcaaaggctgcgcgccccgcatcggcccggaggcggggagccctgggaggcctggccgagctgcccgcagggaaatggcggagaaagcgcttctctgcccgagttcagccgggctggggacttggccctgggtcctgaactcggcatggccagttctgcctctggctgtggaccagggtgtggactggagaccgcgggggccagtctcatcggatcagatcgagcagctccatcggagatttaagcag

SEQ ID NO: 21400 - DNA, 936 bp, Homo sapiens
  ENST00000541210
gttatatgaggccccgctccggccccacgcggaacccgcggctccgagccttcgccggcgtcccgacccgaggccggacccgaggccagtcccgccgctgcgcagccgaagccagtgcggggcctgagagggacgcgcgccccggggcccccgccgcgggcaccatgggcgctgcccactccgcgtctgaggaggtgcgggagctcgagggcaagaccggcttctcatcggatcagatcgagcagctccatcggagatttaagcagctgagtggagatcagcctaccattcggaacctgcgcaagggacccagtggcctggctgatgagatcaatttcgaggacttcctgaccatcatgtcctacttccggcccatcgacaccaccatggacgaggaacaggtggagctgtcccggaaggagaagctgagatttctgttccacatgtacgactcggacagcgacggccgcatcactctggaagaatatcgaaatgtggtcgaggagctgctgtcgggaaaccctcacatcgagaaggagtccgctcgctccatcgccgacggggccatgatggaggcggccagcgtgtgcatggggcagatggagcctgatcaggtgtacgaggggatcaccttcgaggacttcctgaagatctggcaggggatcgacattgagaccaagatgcacgtccgcttccttaacatggaaaccatggccctctgccactgacccaccgccacctccgcggagaaactgcactttgcaatggggccgcctccccgcgtagctggagcagcccaggcccggcggacagcctcttcctgcagcgccggtacatagccaaggctcgtctgcgcaccttgtgtcttgtagggtatggtatgtgggacttcgctgtttttatctccaataaaaaaaaaaaaaaggtttgttaatt

SEQ ID NO: 21401 - DNA, 4927 bp, Homo sapiens
  ENST00000389934
atcagtccgcattccccgcacccacccacgtcttcccgggagtcgtatcccgagcatggaggttactgagaccgttatttcttcatggcctgcctagcttaagcagtagctggaaaagatgtctcgggctgttcgtcttccagtcccctgtcctgttcaacttggtaccttaagaaatgactccctggaagctcagcttcatgagtatgtcaaacaagggaactatgtgaaagtgaagaaaattcttaagaaaggaatttatgttgatgcagttaactccttgggccaaacagcactttttgttgcggcgttattgggccttaggaaattcgttgatgttctggtggattatggatcagatccaaatcaccgctgctttgatgggagcacccctgtccatgcagcagcattttcgggcaatcagtggatccttagcaaactgctggatgcaggaggtgacctgcgactccacgatgagaggggtcaaaacccgaagacttgggctttgacagcaggaaaggagcgtagcacccagatagtggagttcatgcagcgctgtgcctcacacatgcaggccatcatccagggcttctcttacgacctcctgaagaagatagactccccgcagcggcttgtctacagcccgtcctggtgtgggggcctcgtgcagggaaaccctaatggctctcctaaccgactgcttaaagctggagtcatttctgctcaaaatatctacagctttggttttgggaagttttatcttactggggcgacacagatggcctatctaggatctcttccggtcattggagaaaaggaagtgattcaagctgatgatgagcccaccttctctttcttcagcggcccctacatggtcatgaccaacctagtgtggaatgggagcagggtcacagtgaaagagctgaatctccccacccacccacactgcagcaggctgcggctggccgacttgttaattgccgagcaggaacacagcagcaagctgcggcacccctacttgctacagttgatggctgtgtgtctctcccaggacctagagaaaacccgccttgtgtacgagcgcatcactatcggcacattgttcagtgtccttcatgaacgacggtcccagttcccagtgctgcacatggaggtgattgtgcacctgctgctccagatatctgatgccctgagatacctgcatttccaggggtttatccaccgctccctcagctcctatgctgtccatatcatctccccaggtgaagcgaggctgaccaacctggagtacatgttggaaagcgaggacagaggtgtacagagggacctgactcgagtgccccttcctacgcagctatacaactgggccgcaccagaagtgatcttacagaaggcagccacagtgaaatcagacatctacagcttttctatgatcatgcaggagattttaacagatgacataccctggaagggcttagatggctcagttgttaaaaaagccgtagtctcggggaattatttagaagctgatgtcaggcttccgaaaccttactatgatattgttaagtcaggcatccacgtcaagcagaaagaccgaactatgaaccttcaagatatccggtatattctgaagaatgacttaaaggattttactggagcccagagaactcaaccaaccgagagccccagagtgcagagatacggactccatcccgatgtcaatgtctatctaggactgacttcagaacaccccagagagacacctgacatggaaatcatagaactaaaggaaatgggcagtcaacctcattcaccaagggttcactctttattcactgaggggacactagatcctcaggccccagatccatgtctgatggccagggagactcagaatcaagatgctccttgccctgctccatttatggcagaagaggccagcagccccagcacaggtcagccaagcctctgcagtttcgaaatcaacgagatctactcaggctgcttgattttggaagatgacatagaagagcctccaggagctgcttcatctttggaggcagacggacctaaccaggtagatgaactgaaatccatggaagaagagctggataagatggagagagaggcgtgttgttttggcagtgaggatgagagctcttcaaaagctgagacagagtactcttttgatgactgggactggcaaaacggttcactcagttcactcagccttcctgagtcaaccagagaagccaagagcaatttgaacaacatgtccacgactgaggagtatctcatcagtaagtgtgtgctggatctaaagattatgcagacaataatgcacgagaatgatgataggctgaggaatatcgagcagatattagatgaagtcgagatgaaacagaaggaacaggaagagcgcatgtctttatgggccacttcaagagagtttacaaatgcctacaagttacctctggccgtgggccctccatctttaaactatattcctcctgtcctacagctttcagggggtcagaagccagacaccagtggcaactacccaaccctaccaagatttccaagaatgctgccgactctttgtgaccctggaaaacagaacacagatgaacaatttcagtgcactcaaggagccaaggacagtttggaaacaagcaggatccaaaataccagtagccagggaagacctagagagtccactgcccaagccaaagccacacagtttaatagtgcactcttcactctgtcaagccaccggcagggaccttctgcatcacccagctgtcactgggactctaccaggatgagtgtggaacctgtttcttctgaaatctataatgcagagtccagaaataaagatgatggaaaggtacacttaaaatggaaaatggaggtgaaagaaatggcaaagaaagcagctactggacagctcacagtacctccttggcatcctcagagtagtctgactttagagagcgaggctgaaaatgagcccgacgccctgctgcagccccccattaggagcccagaaaacacggattggcagcgagttattgagtatcatagggaaaatgatgagcccagaggaaatggcaagtttgacaagacgggcaacaatgactgtgacagtgaccagcatggcagacagcccaggcttggaagcttcaccagtatcaggcacccatctcccagacaaaaggagcaaccagagcatagtgaagccttccaagcaagttctgacacattggtggctgtagagaaatcttacagtcatcagtccatgcaatcaacttgttcaccagagtcttctgaggatataacagatgaatttttaactccagacggtgaatatttttactcctcgactgctcaagaaaacttagctctagagacctcgagtcccatagaagaggactttgaaggaatacaaggtgcatttgcccaacctcaagtctctggtgaggaaaagttccaaatgagaaaaattcttggaaagaatgctgagattttgcccaggtctcaatttcaacctgtacgaagtactgaagatgaacaagaagagacatcaaaggagtcaccaaaggaactgaaagagaaagacatatcattgacggatattcaagacctgtctagtatctcctatgaaccagacagctcttttaaggaagcttcatgcaaaacacccaaaataaaccatgcacctaccagtgtcagcactccactcagcccagggtccgtttcttcagctgccagtcagtataaagactgccttgaaagtatcacatttcaggttaagacagagtttgcctcttgctggaacagtcaagaatttattcaaactttgtctgatgactttataagtgtccgagagagagcaaagaaactggattctctccttacttcctctgaaactcccccttcaagactgactggtcttaaaagattgtcttcatttattggggctggatcccccagccttgttaaggcatgtgactcatcaccaccccatgccacccagagaaggagcctgcctaaagtagaagccttctcacagcatcacattgatgagctgccaccaccatctcaggagctacttgatgacattgagctcttgaaacagcagcagggctcatccacggtgttgcatgagaacacagcaagtgatggaggaggcactgcaaatgatcaaaggcacttagaagaacaagaaactgacagtaaaaaagaagatagtagtatgcttttgtccaaagaaactgaagatcttggagaggacacagagagagctcactctactctggatgaggacctggaaagatggctgcagccacctgaggagagcgtggagctacaagaccttcccaagggctctgaaagggagacaaatatcaaagatcaaaaagttggtgaagagaaaagaaaaagggaagatagcattacaccagaaagaaggaaatcagagggtgttctagggacttctgaagaagatgaactaaaatcctgtttttggaagcgactaggttggtccgaatcatccaggataatcgtgctggatcagagtgacttgtcagactgattggaattggatcatagacggactcctggcctgagtttgagtgtcctggttgtaagctcctttcttctctttctgcttcagttgctgtcagggcagcagttccagttctgtaagtctcactttgttcagctgccacaatagacatcatcgtttggccctctctgttagcagcacattcaaccatttgttttcagtcagatttctgaaaagtgagaggtagttttgatagtaaaaatttttggttgtgcctagaatggctttggttttgttgatgttaattttcaaaaactttaactcttgttatataataaaatgtttaattttaataacaga

SEQ ID NO: 21402 - DNA, 673 bp, Homo sapiens
  ENST00000584699
tgaagaattctgctgtgaacatgagtgtacggatatctctttgagatcctgctttcaattcttttggatatatacccagaaatggtattactggatcatatgagctcactctactctggatgaggacctggaaagatggctgcagccacctgaggagagcgtggagctacaagaccttcccaagggctctgaaagggagacaaatatcaaagatcaaaaagttggtgaagagaaaagaaaaagggaagatagcattacaccagaaagaaggaaatcagagggtgttctagggacttctgaagaaggataatcgtgctggatcagagtgacttgtcagactgattggaattggatcatagacggactcctggcctgagtttgagtgtcctggttgtaagctcctttcttctctttctgcttcagttgctgtcagggcagcagttccagttctgtaagtctcactttgttcagctgccacaatagacatcatcgtttggccctctctgttagcagcacattcaaccatttgttttcagtcagatttctgaaaagtgagaggtagttttgatagtaaaaatttttggttgtgcctagaatggctttggttttgttgatgttaattttcaaaaactttaactcttgttatataataaaatgtttaattttaataaca

SEQ ID NO: 21403 - DNA, 4911 bp, Homo sapiens
  ENST00000240361
ttcccgggagtcgtatcccgagcatggaggttactgagaccgttatttcttcatggcctgcctagcttaagcagtagctggaaaagatgtctcgggctgttcgtcttccagtcccctgtcctgttcaacttggtaccttaagaaatgactccctggaagctcagcttcatgagtatgtcaaacaagggaactatgtgaaagtgaagaaaattcttaagaaaggaatttatgttgatgcagttaactccttgggccaaacagcactttttgttgcggcgttattgggccttaggaaattcgttgatgttctggtggattatggatcagatccaaatcaccgctgctttgatgggagcacccctgtccatgcagcagcattttcgggcaatcagtggatccttagcaaactgctggatgcaggaggtgacctgcgactccacgatgagaggggtcaaaacccgaagacttgggctttgacagcaggaaaggagcgtagcacccagatagtggagttcatgcagcgctgtgcctcacacatgcaggccatcatccagggcttctcttacgacctcctgaagaagatagactccccgcagcggcttgtctacagcccgtcctggtgtgggggcctcgtgcagggaaaccctaatggctctcctaaccgactgcttaaagctggagtcatttctgctcaaaatatctacagctttggttttgggaaggctatgccttggtttcagttttatcttactggggcgacacagatggcctatctaggatctcttccggtcattggagaaaaggaagtgattcaagctgatgatgagcccaccttctctttcttcagcggcccctacatggtcatgaccaacctagtgtggaatgggagcagggtcacagtgaaagagctgaatctccccacccacccacactgcagcaggctgcggctggccgacttgttaattgccgagcaggaacacagcagcaagctgcggcacccctacttgctacagttgatggctgtgtgtctctcccaggacctagagaaaacccgccttgtgtacgagcgcatcactatcggcacattgttcagtgtccttcatgaacgacggtcccagttcccagtgctgcacatggaggtgattgtgcacctgctgctccagatatctgatgccctgagatacctgcatttccaggggtttatccaccgctccctcagctcctatgctgtccatatcatctccccaggtgaagcgaggctgaccaacctggagtacatgttggaaagcgaggacagaggtgtacagagggacctgactcgagtgccccttcctacgcagctatacaactgggccgcaccagaagtgatcttacagaaggcagccacagtgaaatcagacatctacagcttttctatgatcatgcaggagattttaacagatgacataccctggaagggcttagatggctcagttgttaaaaaagccgtagtctcggggaattatttagaagctgatgtcaggcttccgaaaccttactatgatattgttaagtcaggcatccacgtcaagcagaaagaccgaactatgaaccttcaagatatccggtatattctgaagaatgacttaaaggattttactggagcccagagaactcaaccaaccgagagccccagagtgcagagatacggactccatcccgatgtcaatgtctatctaggactgacttcagaacaccccagagagacacctgacatggaaatcatagaactaaaggaaatgggcagtcaacctcattcaccaagggttcactctttattcactgaggggacactagatcctcaggccccagatccatgtctgatggccagggagactcagaatcaagatgctccttgccctgctccatttatggcagaagaggccagcagccccagcacaggtcagccaagcctctgcagtttcgaaatcaacgagatctactcaggctgcttgattttggaagatgacatagaagagcctccaggagctgcttcatctttggaggcagacggacctaaccaggtagatgaactgaaatccatggaagaagagctggataagatggagagagaggcgtgttgttttggcagtgaggatgagagctcttcaaaagctgagacagagtactcttttgatgactgggactggcaaaacggttcactcagttcactcagccttcctgagtcaaccagagaagccaagagcaatttgaacaacatgtccacgactgaggagtatctcatcagtaagtgtgtgctggatctaaagattatgcagacaataatgcacgagaatgatgataggctgaggaatatcgagcagatattagatgaagtcgagatgaaacagaaggaacaggaagagcgcatgtctttatgggccacttcaagagagtttacaaatgcctacaagttacctctggccgtgggccctccatctttaaactatattcctcctgtcctacagctttcagggggtcagaagccagacaccagtggcaactacccaaccctaccaagatttccaagaatgctgccgactctttgtgaccctggaaaacagaacacagatgaacaatttcagtgcactcaaggagccaaggacagtttggaaacaagcaggatccaaaataccagtagccagggaagacctagagagtccactgcccaagccaaagccacacagtttaatagtgcactcttcactctgtcaagccaccggcagggaccttctgcatcacccagctgtcactgggactctaccaggatgagtgtggaacctgtttcttctgaaatctataatgcagagtccagaaataaagatgatggaaaggtacacttaaaatggaaaatggaggtgaaagaaatggcaaagaaagcagctactggacagctcacagtacctccttggcatcctcagagtagtctgactttagagagcgaggctgaaaatgagcccgacgccctgctgcagccccccattaggagcccagaaaacacggattggcagcgagttattgagtatcatagggaaaatgatgagcccagaggaaatggcaagtttgacaagacgggcaacaatgactgtgacagtgaccagcatggcagacagcccaggcttggaagcttcaccagtatcaggcacccatctcccagacaaaaggagcaaccagagcatagtgaagccttccaagcaagttctgacacattggtggctgtagagaaatcttacagtcatcagtccatgcaatcaacttgttcaccagagtcttctgaggatataacagatgaatttttaactccagacggtgaatatttttactcctcgactgctcaagaaaacttagctctagagacctcgagtcccatagaagaggactttgaaggaatacaaggtgcatttgcccaacctcaagtctctggtgaggaaaagttccaaatgagaaaaattcttggaaagaatgctgagattttgcccaggtctcaatttcaacctgtacgaagtactgaagatgaacaagaagagacatcaaaggagtcaccaaaggaactgaaagagaaagacatatcattgacggatattcaagacctgtctagtatctcctatgaaccagacagctcttttaaggaagcttcatgcaaaacacccaaaataaaccatgcacctaccagtgtcagcactccactcagcccagggtccgtttcttcagctgccagtcagtataaagactgccttgaaagtatcacatttcaggttaagacagagtttgcctcttgctggaacagtcaagaatttattcaaactttgtctgatgactttataagtgtccgagagagagcaaagaaactggattctctccttacttcctctgaaactcccccttcaagactgactggtcttaaaagattgtcttcatttattggggctggatcccccagccttgttaaggcatgtgactcatcaccaccccatgccacccagagaaggagcctgcctaaagtagaagccttctcacagcatcacattgatgagctgccaccaccatctcaggagctacttgatgacattgagctcttgaaacagcagcagggctcatccacggtgttgcatgagaacacagcaagtgatggaggaggcactgcaaatgatcaaaggcacttagaagaacaagaaactgacagtaaaaaagaagatagtagtatgcttttgtccaaagaaactgaagatcttggagaggacacagagagagctcactctactctggatgaggacctggaaagatggctgcagccacctgaggagagcgtggagctacaagaccttcccaagggctctgaaagggagacaaatatcaaagatcaaaaagttggtgaagagaaaagaaaaagggaagatagcattacaccagaaagaaggaaatcagagggtgttctagggacttctgaagaagatgaactaaaatcctgtttttggaagcgactaggttggtccgaatcatccaggataatcgtgctggatcagagtgacttgtcagactgattggaattggatcatagacggactcctggcctgagtttgagtgtcctggttgtaagctcctttcttctctttctgcttcagttgctgtcagggcagcagttccagttctgtaagtctcactttgttcagctgccacaatagacatcatcgtttggccctctctgttagcagcacattcaaccatttgttttcagtcagatttctgaaaagtgagaggtagttttgatagtaaaaatttttggttgtgcctagaatggctttggttttgttgatgttaattttcaaaaactttaactcttgttatataataaaatgtttaattttaataaca

SEQ ID NO: 21404 - DNA, 4773 bp, Homo sapiens
  ENST00000349033
ttcccgggagtcgtatcccgagcatggaggttactgagaccgttatttcttcatggcctgcctagcttaagcagtagctggaaaagatgtctcgggctgttcgtcttccagtcccctgtcctgttcaacttggtaccttaagaaatgactccctggaagctcagcttcatgagtatgtcaaacaagggaactatgtgaaagtgaagaaaattcttaagaaaggaatttatgttgatgcagttaactccttgggccaaacagcactttttgttgcggcgttattgggccttaggaaattcgttgatgttctggtggattatggatcagatccaaatcaccgctgctttgatgggagcacccctgtccatgcagcagcattttcgggcaatcagtggatccttagcaaactgctggatgcaggaggtgacctgcgactccacgatgagaggggtcaaaacccgaagacttgggctttgacagcaggaaaggagcgtagcacccagatagtggagttcatgcagcgctgtgcctcacacatgcaggccatcatccagggcttctcttacgacctcctgaagaagatagactccccgcagcggcttgtctacagcccgtcctggtgtgggggcctcgtgcagggaaaccctaatggctctcctaaccgactgcttaaagctggagtcatttctgctcaaaatatctacagctttggttttgggaagttttatcttactggggcgacacagatggcctatctaggatctcttccggtcattggagaaaaggaagtgattcaagctgatgatgagcccaccttctctttcttcagcggcccctacatggtcatgaccaacctagtgtggaatgggagcagggtcacagtgaaagagctgaatctccccacccacccacactgcagcaggctgcggctggccgacttgttaattgccgagcaggaacacagcagcaagctgcggcacccctacttgctacagttgatggctgtgtgtctctcccaggacctagagaaaacccgccttgtgtacgagcgcatcactatcggcacattgttcagtgtccttcatgaacgacggtcccagttcccagtgctgcacatggaggtgattgtgcacctgctgctccagatatctgatgccctgagatacctgcatttccaggggtttatccaccgctccctcagctcctatgctgtccatatcatctccccaggtgaagcgaggctgaccaacctggagtacatgttggaaagcgaggacagaggtgtacagagggacctgactcgagtgccccttcctacgcagctatacaactgggccgcaccagaagtgatcttacagaaggcagccacagtgaaatcagacatctacagcttttctatgatcatgcaggagattttaacagatgacataccctggaagggcttagatggctcagttgttaaaaaagccgtagtctcggggaattatttagaagctgatgtcaggcttccgaaaccttactatgatattgttaagtcaggcatccacgtcaagcagaaagaccgaactatgaaccttcaagatatccggtatattctgaagaatgacttaaaggattttactggagcccagagaactcaaccaaccgagagccccagagtgcagagatacggactccatcccgatgtcaatgtctatctaggactgacttcagaacaccccagagagacacctgacatggaaatcatagaactaaaggaaatgggcagtcaacctcattcaccaagggttcactctttattcactgaggggacactagatcctcaggccccagatccatgtctgatggccagggagactcagaatcaagatgctccttgccctgctccatttatggcagaagaggccagcagccccagcacaggtcagccaagcctctgcagtttcgaaatcaacgagatctactcaggctgcttgattttggaagatgacatagaagagcctccaggagctgcttcatctttggaggcagacggacctaaccaggtagatgaactgaaatccatggaagaagagctggataagatggagagagaggcgtgttgttttggcagtgaggatgagagctcttcaaaagctgagacagagtactcttttgatgactgggactggcaaaacggttcactcagttcactcagccttcctgagtcaaccagagaagccaagagcaatttgaacaacatgtccacgactgaggagtatctcatcagtaagtgtgtgctggatctaaagattatgcagacaataatgcacgagaatgatgataggctgaggaatatcgagcagatattagatgaagtcgagatgaaacagaaggaacaggaagagcgcatgtctttatgggccacttcaagagagtttacaaatgcctacaagttacctctggccgtgggccctccatctttaaactatattcctcctgtcctacagctttcagggggtcagaagccagacaccagtggcaactacccaaccctaccaagatttccaagaatgctgccgactctttgtgaccctggaaaacagaacacagatgaacaatttcagtgcactcaaggagccaaggacagtttggaaacaagcaggatccaaaataccagtagccagggaagacctagagagtccactgcccaagccaaagccacacagtttaatagtgcactcttcactctgtcaagccaccggcagggaccttctgcatcacccagctgtcactgggactctaccaggatgagtgtggaacctgtttcttctgaaatctataatgcagagtccagaaataaagatgatggaaaggtacacttaaaatggaaaatggaggtgaaagaaatggcaaagaaagcagctactggacagctcacagtacctccttggcatcctcagagtagtctgactttagagagcgaggctgaaaatgagcccgacgccctgctgcagccccccattaggagcccagaaaacacggattggcagcgagttattgagtatcatagggaaaatgatgagcccagaggaaatggcaagtttgacaagacgggcaacaatgactgtgacagtgaccagcatggcagacagcccaggcttggaagcttcaccagtatcaggcacccatctcccagacaaaaggagcaaccagagcatagtgaagccttccaagcaagttctgacacattggtggctgtagagaaatcttacagtacctcgagtcccatagaagaggactttgaaggaatacaaggtgcatttgcccaacctcaagtctctggtgaggaaaagttccaaatgagaaaaattcttggaaagaatgctgagattttgcccaggtctcaatttcaacctgtacgaagtactgaagatgaacaagaagagacatcaaaggagtcaccaaaggaactgaaagagaaagacatatcattgacggatattcaagacctgtctagtatctcctatgaaccagacagctcttttaaggaagcttcatgcaaaacacccaaaataaaccatgcacctaccagtgtcagcactccactcagcccagggtccgtttcttcagctgccagtcagtataaagactgccttgaaagtatcacatttcaggttaagacagagtttgcctcttgctggaacagtcaagaatttattcaaactttgtctgatgactttataagtgtccgagagagagcaaagaaactggattctctccttacttcctctgaaactcccccttcaagactgactggtcttaaaagattgtcttcatttattggggctggatcccccagccttgttaaggcatgtgactcatcaccaccccatgccacccagagaaggagcctgcctaaagtagaagccttctcacagcatcacattgatgagctgccaccaccatctcaggagctacttgatgacattgagctcttgaaacagcagcagggctcatccacggtgttgcatgagaacacagcaagtgatggaggaggcactgcaaatgatcaaaggcacttagaagaacaagaaactgacagtaaaaaagaagatagtagtatgcttttgtccaaagaaactgaagatcttggagaggacacagagagagctcactctactctggatgaggacctggaaagatggctgcagccacctgaggagagcgtggagctacaagaccttcccaagggctctgaaagggagacaaatatcaaagatcaaaaagttggtgaagagaaaagaaaaagggaagatagcattacaccagaaagaaggaaatcagagggtgttctagggacttctgaagaagatgaactaaaatcctgtttttggaagcgactaggttggtccgaatcatccaggataatcgtgctggatcagagtgacttgtcagactgattggaattggatcatagacggactcctggcctgagtttgagtgtcctggttgtaagctcctttcttctctttctgcttcagttgctgtcagggcagcagttccagttctgtaagtctcactttgttcagctgccacaatagacatcatcgtttggccctctctgttagcagcacattcaaccatttgttttcagtcagatttctgaaaagtgagaggtagttttgatagtaaaaatttttggttgtgcctagaatggctttggttttgttgatgttaattttcaaaaactttaactcttgttatataataaaatgtttaattttaataaca

SEQ ID NO: 21405 - DNA, 4834 bp, Homo sapiens
  ENST00000582740
attccccgcacccacccacgtcttcccgggagtcgtatcccgagcatggaggttactgagaccgttatttcttcatggcctgcctagcttaagcagtagctggaaaagatgtctcgggctgttcgtcttccagtcccctgtcctgttcaacttggtaccttaagaaatgactccctggaagctcagcttcatgagtatgtcaaacaagggaactatgtgaaagtgaagaaaattcttaagaaagctctggagttgccacaaacagcgttgagatcagaggaagagtggagaagcaaggaggagaattaacagagcattgctgcatcctgcagtgcggaggagggaagaaattggaatcggcctgggaatttatgttgatgcagttaactccttgggccaaacagcactttttgttgcggcgttattgggccttaggaaattcgttgatgttctggtggattatggatcagatccaaatcaccgctgctttgatgggagcacccctgtccatgcagcagcattttcgggcaatcagtggatccttagcaaactgctggatgcaggaggtgacctgcgactccacgatgagaggggtcaaaacccgaagacttgggctttgacagcaggaaaggagcgtagcacccagatagtggagttcatgcagcgctgtgcctcacacatgcaggccatcatccagggcttctcttacgacctcctgaagaagatagactccccgcagcggcttgtctacagcccgtcctggtgtgggggcctcgtgcagggttttatcttactggggcgacacagatggcctatctaggatctcttccggtcattggagaaaaggaagtgattcaagctgatgatgagcccaccttctctttcttcagcggcccctacatggtcatgaccaacctagtgtggaatgggagcagggtcacagtgaaagagctgaatctccccacccacccacactgcagcaggctgcggctggccgacttgttaattgccgagcaggaacacagcagcaagctgcggcacccctacttgctacagttgatggctgtgtgtctctcccaggacctagagaaaacccgccttgtgtacgagcgcatcactatcggcacattgttcagtgtccttcatgaacgacggtcccagttcccagtgctgcacatggaggtgattgtgcacctgctgctccagatatctgatgccctgagatacctgcatttccaggggtttatccaccgctccctcagctcctatgctgtccatatcatctccccaggtgaagcgaggctgaccaacctggagtacatgttggaaagcgaggacagaggtgtacagagggacctgactcgagtgccccttcctacgcagctatacaactgggccgcaccagaagtgatcttacagaaggcagccacagtgaaatcagacatctacagcttttctatgatcatgcaggagattttaacagatgacataccctggaagggcttagatggctcagttgttaaaaaagccgtagtctcggggaattatttagaagctgatgtcaggcttccgaaaccttactatgatattgttaagtcaggcatccacgtcaagcagaaagaccgaactatgaaccttcaagatatccggtatattctgaagaatgacttaaaggattttactggagcccagagaactcaaccaaccgagagccccagagtgcagagatacggactccatcccgatgtcaatgtctatctaggactgacttcagaacaccccagagagacacctgacatggaaatcatagaactaaaggaaatgggcagtcaacctcattcaccaagggttcactctttattcactgaggggacactagatcctcaggccccagatccatgtctgatggccagggagactcagaatcaagatgctccttgccctgctccatttatggcagaagaggccagcagccccagcacaggtcagccaagcctctgcagtttcgaaatcaacgagatctactcaggctgcttgattttggaagatgacatagaagagcctccaggagctgcttcatctttggaggcagacggacctaaccaggtagatgaactgaaatccatggaagaagagctggataagatggagagagaggcgtgttgttttggcagtgaggatgagagctcttcaaaagctgagacagagtactcttttgatgactgggactggcaaaacggttcactcagttcactcagccttcctgagtcaaccagagaagccaagagcaatttgaacaacatgtccacgactgaggagtatctcatcagtaagtgtgtgctggatctaaagattatgcagacaataatgcacgagaatgatgataggctgaggaatatcgagcagatattagatgaagtcgagatgaaacagaaggaacaggaagagcgcatgtctttatgggccacttcaagagagtttacaaatgcctacaagttacctctggccgtgggccctccatctttaaactatattcctcctgtcctacagctttcagggggtcagaagccagacaccagtggcaactacccaaccctaccaagatttccaagaatgctgccgactctttgtgaccctggaaaacagaacacagatgaacaatttcagtgcactcaaggagccaaggacagtttggaaacaagcaggatccaaaataccagtagccagggaagacctagagagtccactgcccaagccaaagccacacagtttaatagtgcactcttcactctgtcaagccaccggcagggaccttctgcatcacccagctgtcactgggactctaccaggatgagtgtggaacctgtttcttctgaaatctataatgcagagtccagaaataaagatgatggaaaggtacacttaaaatggaaaatggaggtgaaagaaatggcaaagaaagcagctactggacagctcacagtacctccttggcatcctcagagtagtctgactttagagagcgaggctgaaaatgagcccgacgccctgctgcagccccccattaggagcccagaaaacacggattggcagcgagttattgagtatcatagggaaaatgatgagcccagaggaaatggcaagtttgacaagacgggcaacaatgactgtgacagtgaccagcatggcagacagcccaggcttggaagcttcaccagtatcaggcacccatctcccagacaaaaggagcaaccagagcatagtgaagccttccaagcaagttctgacacattggtggctgtagagaaatcttacagtacctcgagtcccatagaagaggactttgaaggaatacaaggtgcatttgcccaacctcaagtctctggtgaggaaaagttccaaatgagaaaaattcttggaaagaatgctgagattttgcccaggtctcaatttcaacctgtacgaagtactgaagatgaacaagaagagacatcaaaggagtcaccaaaggaactgaaagagaaagacatatcattgacggatattcaagacctgtctagtatctcctatgaaccagacagctcttttaaggaagcttcatgcaaaacacccaaaataaaccatgcacctaccagtgtcagcactccactcagcccagggtccgtttcttcagctgccagtcagtataaagactgccttgaaagtatcacatttcaggttaagacagagtttgcctcttgctggaacagtcaagaatttattcaaactttgtctgatgactttataagtgtccgagagagagcaaagaaactggattctctccttacttcctctgaaactcccccttcaagactgactggtcttaaaagattgtcttcatttattggggctggatcccccagccttgttaaggcatgtgactcatcaccaccccatgccacccagagaaggagcctgcctaaagtagaagccttctcacagcatcacattgatgagctgccaccaccatctcaggagctacttgatgacattgagctcttgaaacagcagcagggctcatccacggtgttgcatgagaacacagcaagtgatggaggaggcactgcaaatgatcaaaggcacttagaagaacaagaaactgacagtaaaaaagaagatagtagtatgcttttgtccaaagaaactgaagatcttggagaggacacagagagagctcactctactctggatgaggacctggaaagatggctgcagccacctgaggagagcgtggagctacaagaccttcccaagggctctgaaagggagacaaatatcaaagatcaaaaagttggtgaagagaaaagaaaaagggaagatagcattacaccagaaagaaggaaatcagagggtgttctagggacttctgaagaagatgaactaaaatcctgtttttggaagcgactaggttggtccgaatcatccaggataatcgtgctggatcagagtgacttgtcagactgattggaattggatcatagacggactcctggcctgagtttgagtgtcctggttgtaagctcctttcttctctttctgcttcagttgctgtcagggcagcagttccagttctgtaagtctcactttgttcagctgccacaatagacatcatcgtttggccctctctgttagcagcacattcaaccatttgttttcagtcagatttctgaaaagtgagaggtagttttgatagtaaaaatttttggttgtgcctagaatggctttggttttgttgatgttaattttcaaaaactttaactcttgttatataataaaatgtttaattttaataaca

SEQ ID NO: 21406 - DNA, 676 bp, Homo sapiens
  ENST00000581147
taaggaagcttcatgcaaaacacccaaaataaaccatgcacctaccagtgtcagcactccactcagcccagggtccgtttcttcagctgccagtcagtataaagactgccttgaaagtatcacatttcaggttaagacagagtttgcctcttgctggaacagtcaagaatttattcaaactttgtctgatgactttataagtgtccgagagagagcaaagaaactggattctctccttacttcctctgaaactcccccttcaagactgactggtcttaaaagattgtcttcatttattggggctggatcccccagccttgttaaggcatgtgactcatcaccaccccatgccacccagagaaggagcctgcctaaagtagaagccttctcacagcatcacattgatgagctgccaccaccatctcaggagctacttgatgacattgttgctgtgtaaaccttccattcacctcctccatttcagcagctgtgttaccagactttgtcctgggctctggccttatggtgctgctgcaccccagcacagtctgcagaagccttccctcatttcacttatgggaattatctggaccaggtttctagagctcttgaaacagcagcagggctcatccacggtgttgcatgagaacacagcaagtgatggaggaggcactgc

SEQ ID NO: 21407 - DNA, 5232 bp, Homo sapiens
  ENST00000258991
gtcgcgcggccgggagcacgggcgccggcatagtacaatgaggcagccagcggatcttggagcctgagcccttgtgaagccggcaatgacaagtctgtatggtcgccatgccgagaaaaccactgacatgccaaaaccatcagcccctaaagtgcacgtgcagaggtccgtgtcccgagataccatcgccattcacttctcggcatccggcgaggaggaggaggaagaggaggaggagttcagggagtactttgaggaggggctggatgaccaaagcattgtaacagggctggaagccaaggaagacctctatcttgaaccccaagttggccatgaccccgccggccctgctgcctcgcctgtcctggcagatggactgtccgtgtcccaggcccctgccattttgcccgtctccaagaacactgtaaagctgttggagtcccctgttccagcagcacaagtattaagtacagtgccattggctgtgtccccagggtcgtcttcgtcggggcccttagctagctctcccagtgtgtcatccctttctgagcagaaaaccagttcttcctccccattgtcctctccttctaagtctcccatcctctcatccagtgcctcaacctccaccctttccagtgcaaaacccttcatgagccttgtgaagtccctgtcgaccgaggtggagccaaaagaatccccacaccccgcaaggcacaggcacttgatgaagacattagtcaagtctctgtccacggacacttcccggcaggagtcggatacagtgtcctataagccacctgattccaaactgaacttacacctgttcaagcagttcacacagccccgaaacacaggtggagattccaaaactgcaccttcttccccactgacttctccctctgatactcgttccttttttaaagtgcccgaaatggaggctaaaattgaagatactaaacgacgcctttcagaagtcatctatgagccttttcagctccttagtaaaattataggggaagaaagtggcagccataggcccaaagccttatcttcaagtgcttcagaactctccaatctgtccagcttgaatgggcacttggaaagcaataacaactacagcatcaaggaggaggagtgtgattctgagggggatggctacggaagtgattccaacatccccagaagtgaccacccaaagtccactggtgagcccacaagagagatagaactgaaaagttcccaggggagcagtctgaaggatttaggcctgaagacaagttctctagttctggagaaatgttctttgtctgccttagtgagcaaagaagatgaagagttttgtgaactgtacactgaggacttcgatttggaaacggagggggagagtaaagttgataagctctcagatattcctctcaagccagaggtgctcgcggaagatggtgtggtccttgacagtgaggacgaggtggactcggccgtgcagcacccggaattgccagtgaagacgttgggcttctttataatgtgtgtctatgtgtacctcatcctccccctcccccactatgtgagtggactctttctgggaattggccttggattcatgactgcagtttgcgtgatttggttttttacaccaccaagtgctcataaatatcacaagttacacaaaaatctgcgacactggaacacaagatctctggatatcaaagaacctgaaatactgaagggatggatgaatgagatttacaactatgatccagaaacctaccatgcgactttgacacattcagtctttgttcgacttgagggtggaaccttaagactttcaaagcccaataaaaatatatccaggagggccagctacaatgaacccaagccagaggtcacctacatcagccagaaaatctatgacctctcagacagcaagatttatcttgtacctaaaactttggctcgaaagcgaatctggaataaaaagtaccccatttgtatcgagcttggtcagcaagatgactttatgtctaaagctcagactgataaggagacttcagaagagaagccgccagctgagggaagtgaggaccctaagaagccaccccgccctcaggagggaacaagatctagccagcgagatcagatactctatctctttgggagaactggccgagaaaaagaggaatggtttaggagatttattctggcatctaagctaaagtcggaaatcaagaagtcatcgggtgtctctggaggtaaaccagcccccgtcttcttggctccagggcttttgcctgcacacagcagacacaacagtccgtccgggcacctgacccacagccgcagcagcagcaaaggcagtgtggaggagatcatgtcacagccaaagcagaaggagctggcaggcagcgtgcggcagaagatgcttctcgactacagcgtgtacatgggcaggtgtgtcccccaggaaagccgaagcccccagaggagccccctgcagagtgcggagagcagccccacagctgggaagaagttgccagaggttccaccctctgaggaggaagaacaggaagcctgggtgaatgccttgcttggaagaatattttgggacttcttaggagagaaatactggtctgatctggtgtctaagaagatccaaatgaaactcagcaaaataaagctcccctactttatgaatgagctcactctgacggaacttgacatgggcgtggctgtgccaaaaatcctccaggccttcaagccttacgttgatcaccaaggactctggattgatttggaaatgtcctacaatgggtcctttctgatgactctcgagaccaaaatgaatttgaccaaactaggtaaagagcctcttgttgaagccctgaaggttggagaaattggcaaagaaggttgcaggccccgggcattctgtctggcggacagcgatgaggaatcctccagcgctggctcctccgaggaagacgatgccccagagcccagcgggggagacaaacagctcctcccaggggctgaagggtacgttggaggtcatcgaacaagtaagattatgaggtttgttgataaaattaccaagtcaaaatatttccaaaaagcaacagagacagagtttattaaaaagaagatcgaagaagtctccaacacacccctgctgctcactgttgaagtacaagaatgtagaggaaccttggcggtcaacattccaccacccccgactgaccgagtatggtatggtttccgaaagccaccacatgtggagctgaaagctcggccaaaacttggagagagagaagtgactttagttcatgtgacagactggatagagaagaaactggagcaagagtttcagaaagtttttgtcatgccaaacatggatgatgtttatatcactataatgcactcagccatggaccctcgctctacttcctgcctcctgaaagacccacctgtggaggctgctgatcagccatgatgggtgatgtcagatgttccccatattgtgacatcgagctggatgtgtggggttcttggccgccatctgtactgtagcactggcctctgtgccacagctactgtttcttaaaggactgcttctgccctctgcctgccagtgcccattccactgtgaggtgtcattccctgcatctagtgacaactgtctggattgcctgctgcaaagctttgatttggcaaaggagaccatggaagaatcatggtggatccagaagttatacgtgacccacaccatggcttttaaaagtctacccatgtttgtggcagcaaatgagcacagtaagagcaaagctgaacaacttgcctcctctactcctccaaagcttttcttcaggcagccggtgcacagtggactttttcacttctatactttgtatgcggccttccacacttccagagaatgtcagtgtgcaatgtgtctggagggtggggagaggaattctgtgagccttttcatttcggtgacagaagagatgggcagagcaacttattttccacattaaattgtgcatttgggaagcaagtagccatagtacacacacaacacgctatcagcttgggtaaggacagtgggatttatgtgaacatcaggcaaagccatgagatcaaaccatcccaagcctttcaccaatgaggtacaaccacctgggggctagctaatcttgaatgttttcctgagacaggagcgtatgtgaaaacatcaaacactgcacatgacaggatgggtcctctcatacagatgggatggggttagaaagccagagccagtttttccatctggcgtttcctgtgtcctccaggtttatatgggaatcgaaacagtttgttaatctgattgggagagttccatgggcagatttcccttcctgaaggccaaaacggagaactgctctctttaattatttcaagagtcaagaccaaaagtttgctcagcatcacactacatctcaaaattaatgttgccaacttaattttgtgcatttgtgtcagaatgtttagtttacaaggttgggggctctctttgcttcgagaagtaaacctaataccatttttttattgtttaaagctgcattcaacgtcaaaattaccttgggtaacttttgataacttacatgtgtggacaaagctaatagtggttttttaaacagcaccttgcctgaacatgactttaaagaaattaatatattgaaaacatgtttgaacccttattttaattgcaccattaaaacatttgacttaaattgtttgaccattccagttggtgtactgttctgatttttcgttgtgtaggccgatctgcctgtcagagtccacgtgtcctggtcactggtctttataattgttgtgcaataactaaaggctaaggactagatgcactatcgtgtaaagagattacacatgactgtaccatgttgcacttaatcaaatagtatgtggggatttaaaatcgcttgcattgtttcacaaaataaatatctcaatgtcaaatactagataagcatctaagtcatttctacggaatcctgttcagataggggcacaataaaatgagtacagagcaccggggccctcacctggcaatcgcagctttcatttactgcgttgatcactgcccagtcctaaggctacaaagccatcctcactacatccttcaaactatgtgccattatcttcagcccacatttaaagaatccagtgaaa

SEQ ID NO: 21408 - DNA, 5124 bp, Homo sapiens
  ENST00000584498
ctcccagtgcacagggctggggccactgccgggccttcagttccacactggcatgtgtgctgtgcccttgggtgcctttggctcctgttggtcaggcgataactgtccccgtgggcctctggtggcccaaggacagcatcaggaaaaccaaaggactgcagctgcagggagataggccctgagccccactgccttcccttgtccatgtaactgtgtccttgtcaaaaatacaatgaccagcctctgcttggtgaccatttggttgtgtaatagtgttcagagactactctgtcccttgttcattttgtcccatttaagtctctgggctcagacacagccctgccagtactttctgaagcaaagccacggtccagggaggaagctgctttctataggcccgaggctcagcccagaagcccccaggtcccctccgacgggaactggacccctcacctctgcgggtaatccagcaaccccacacctctggaactgagtatctgccctggagagctgagtgagggacactgctgtcccatgaggctttcccttacttcagtcaaaggaatggtctttagacatgtatttttccggaaaatttcctgggttctcatgtcagttgcttcctagagtctcctgagactttttgtgtgtgtgtgtgtatgtggttgttggctttttctgtgaccctcaggagatagggcaggtgtggagtgaaatacgtaatttcactggaaaggagtcatgagtcaaaactcacttggagggttactaagccagaaagcatcagagttgctgaattaagccagagccaagggacttgcctcaacatcccatcatcagtgagaagtggccatgtcaccagtataagctgtcacctcactcttgcaaccatccgctctttctgttcatcctcccgtgtggctccgctgcactgctggttgaaatcactgcattttatgtgcgcatcacactcccacctcctgtccttctgacgcatgctcaaaagcaacctcttctgggtccaaggcctctgtggtcctgtcagaggccttggtgctgaagagtgtcctgagcatctgcgctgatccaaggattcttggattgggcctcttctggtttgggtgggttggagagaatgacgagatgtagttaacagttacatcccgaccctgttgtggttgagtgtgtgtgcatgggtgtgtgtgttctctttctaagcagagcttgggtgagggcaggcagtggtggtgactctctctctgtccagttgcaggccccgggcattctgtctggcggacagcgatgaggaatcctccagcgctggctcctccgaggaagacgatgccccagagcccagcgggggagacaaacagctcctcccaggggctgaagggtacgttggaggtcatcgaacaagtaagattatgaggtttgttgataaaattaccaagtcaaaatatttccaaaaagcaacagagacagagtttattaaaaagaagatcgaagaagtctccaacacacccctgctgctcactgttgaagtacaagaatgtagaggaaccttggcggtcaacattccaccacccccgactgaccgagtatggtatggtttccgaaagccaccacatgtggagctgaaagctcggccaaaacttggagagagagaagtgactttagttcatgtgacagactggatagagaagaaactggagcaagagtttcaggtaaacctctagtgttatctagtatttcacaccaagtatagaagctctgggtttagccgaggttctgaacttcagctgggtcaggatcctcttttgaaaatctgatggtgaccttcatcccggaagagtattacatttgatcaaatatgggaataaaacttcaggtacagtatcaaagccctgaaacttatccacagaacattactaagtcatcttcagaggaaacccaaaagatttgggtcagagcaaaatgatgatgtcttttcccagcaagcctgccaggactgtcaggctttgttttctcttatgcaaggcctggccttgcccaactcttagcacccggcctgtgggcagggaggctgccccctgttcttgtgtgctgttcaccttgctcagtttgttcagttcaacaaacattcctggaaacccttctgtgtgccaggtaccacctgccctgggagtccaaagatgaatctggcctctccctcccctgggtagcttctagtgtagtctgggagttcattaagccagagcttactctctcagcttttctttctgcatttggccaccaaaggtaatagcagtatagctgaggccctaggatgagctatttccatcaaacttttatcagatatttgaagcacagttgtctgtcggggttttatggattagcaaactatttacttttaatgaaattcaccttttgaagaagacctacattctttttgcagtggtatattttgagttactgccttaaaaaaatcctcttatttaaaaactagagattaaacataactgataaccaatttctgaaaaagcttaatgtcatcaccaaatagaaaagtactttgaacctactgaggggaaagaacatcatgccttttatttttccctttttctttcttttttttttttttttttttaagacagagtcttgctgtgtcgcccaggctggagtgcaatggcgccatctcggctcactgcaaactccgtcccccaggttcacaccattctcatgcctcagcctcccgagtagctgggactacaggcacccgccaccacacccagctaattttttgtatttttagtagagatgggggtttcactgtattagccaggatggtctcgatctcctaacctcgtgatctgcccacctcggcctcccaaagtgctgggattacaggtgtgagctaccatgcctggcctaattttttggtatttttagttgagacagggtttcaccatgttggccaggctggtcttgaactctggacctcagatgatctgcctgccttggcctcccaaagtactgggattacaggcgtgaaccatcgcacctggccattagcttacattttatcgctaggatttattaataaaaggataattcacatggaatatgtgttctagacatagtaactgggaactactgtgaacagcttaagccaattctcttaaattgttggatatatatcagtgcatatgggcaaccttattatatgtatacaaaatcaaaggccacttctgcctccgagctgatatattagaggattctcgtatccatgcgctggtatgattcctcaactctttctaaagtatgtatggtgggagaattagtttggaatgcatagcaagtttttatatgtacttttaaaaatcagtctaagccctaaaattatcagaacaaaggagggtgacagcctggcaaggcattcttccacatagctgttctttaatatcttcctacagaaagtttttgtcatgccaaacatggatgatgtttatatcactataatgcactcagccatggaccctcgctctacttcctgcctcctgaaagacccacctgtggaggctgctgatcagccatgatgggtgatgtcagatgttccccatattgtgacatcgagctggatgtgtggggttcttggccgccatctgtactgtagcactggcctctgtgccacagctactgtttcttaaaggactgcttctgccctctgcctgccagtgcccattccactgtgaggtgtcattccctgcatctagtgacaactgtctggattgcctgctgcaaagctttgatttggcaaaggagaccatggaagaatcatggtggatccagaagttatacgtgacccacaccatggcttttaaaagtctacccatgtttgtggcagcaaatgagcacagtaagagcaaagctgaacaacttgcctcctctactcctccaaagcttttcttcaggcagccggtgcacagtggactttttcacttctatactttgtatgcggccttccacacttccagagaatgtcagtgtgcaatgtgtctggagggtggggagaggaattctgtgagccttttcatttcggtgacagaagagatgggcagagcaacttattttccacattaaattgtgcatttgggaagcaagtagccatagtacacacacaacacgctatcagcttgggtaaggacagtgggatttatgtgaacatcaggcaaagccatgagatcaaaccatcccaagcctttcaccaatgaggtacaaccacctgggggctagctaatcttgaatgttttcctgagacaggagcgtatgtgaaaacatcaaacactgcacatgacaggatgggtcctctcatacagatgggatggggttagaaagccagagccagtttttccatctggcgtttcctgtgtcctccaggtttatatgggaatcgaaacagtttgttaatctgattgggagagttccatgggcagatttcccttcctgaaggccaaaacggagaactgctctctttaattatttcaagagtcaagaccaaaagtttgctcagcatcacactacatctcaaaattaatgttgccaacttaattttgtgcatttgtgtcagaatgtttagtttacaaggttgggggctctctttgcttcgagaagtaaacctaataccatttttttattgtttaaagctgcattcaacgtcaaaattaccttgggtaacttttgataacttacatgtgtggacaaagctaatagtggttttttaaacagcaccttgcctgaacatgactttaaagaaattaatatattgaaaacatgtttgaacccttattttaattgcaccattaaaacatttgacttaaattgtttgaccattccagttggtgtactgttctgatttttcgttgtgtaggccgatctgcctgtcagagtccacgtgtcctggtcactggtctttataattgttgtgcaataactaaaggctaaggactagatgcactatcgtgtaaagagattacacatgactgtaccatgttgcacttaatcaaatagtatgtggggatttaaaatcgcttgcattgtttcacaaaataaatatctcaatgtcaa

SEQ ID NO: 21409 - DNA, 4852 bp, Homo sapiens
  ENST00000583097
gacaatggaggaagcttccctcagtttacagcagaaccccaggctcagggaggtgaagtggggagctccgtcactgtcatttgagggccatttgagggctgtggtcctccgtggagctcctccctctgctgcctcatggcctcactcgagcctgagcccttgtgaagccggcaatgacaagtctgtatggtcgccatgccgagaaaaccactgacatgccaaaaccatcagcccctaaagtgcacgtgcagaggtccgtgtcccgagataccatcgccattcacttctcggcatccggcgaggaggaggaggaagaggaggaggagttcagggagtactttgaggaggggctggatgaccaaagcattgtaacagggctggaagccaaggaagacctctatcttgaaccccaagttggccatgaccccgccggccctgctgcctcgcctgtcctggcagatggactgtccgtgtcccaggcccctgccattttgcccgtctccaagaacactgtaaagctgttggagtcccctgttccagcagcacaagtattaagtacagtgccattggctgtgtccccagggtcgtcttcgtcggggcccttagctagctctcccagtgtgtcatccctttctgagcagaaaaccagttcttcctccccattgtcctctccttctaagtctcccatcctctcatccagtgcctcaacctccaccctttccagtgcaaaacccttcatgagccttgtgaagtccctgtcgaccgaggtggagccaaaagaatccccacaccccgcaaggcacaggcacttgatgaagacattagtcaagtctctgtccacggacacttcccggcaggagtcggatacagtgtcctataagccacctgattccaaactgaacttacacctgttcaagcagttcacacagccccgaaacacaggtggagattccaaaactgcaccttcttccccactgacttctccctctgatactcgttccttttttaaagtgcccgaaatggaggctaaaattgaagatactaaacgacgcctttcagaagtcatctatgagccttttcagctccttagtaaaattataggggaagaaagtggcagccataggcccaaagccttatcttcaagtgcttcagaactctccaatctgtccagcttgaatgggcacttggaaagcaataacaactacagcatcaaggaggaggagtgtgattctgagggggatggctacggaagtgattccaacatccccagaagtgaccacccaaagtccactggtgagcccacaagagagatagaactgaaaagttcccaggggagcagtctgaaggatttaggcctgaagacaagttctctagttctggagaaatgttctttgtctgccttagtgagcaaagaagatgaagagttttgtgaactgtacactgaggacttcgatttggaaacggagggggagagtaaagttgataagctctcagatattcctctcaagccagaggtgctcgcggaagatggtgtggtccttgacagtgaggacgaggtggactcggccgtgcagcacccggaattgccagtgaagacgttgggcttctttataatgtgtgtctatgtgtacctcatcctccccctcccccactatgtgagtggactctttctgggaattggccttggattcatgactgcagtttgcgtgatttggttttttacaccaccaagtgctcataaatatcacaagttacacaaaaatctgcgacactggaacacaagatctctggatatcaaagaacctgaaatactgaagggatggatgaatgagatttacaactatgatccagaaacctaccatgcgactttgacacattcagtctttgttcgacttgagggtggaaccttaagactttcaaagcccaataaaaatatatccaggagggccagctacaatgaacccaagccagaggtcacctacatcagccagaaaatctatgacctctcagacagcaagatttatcttgtacctaaaactttggctcgaaagcgaatctggaataaaaagtaccccatttgtatcgagcttggtcagcaagatgactttatgtctaaagctcagactgataaggagacttcagaagagaagccgccagctgagggaagtgaggaccctaagaagccaccccgccctcaggagggaacaagatctagccagcgagatcagatactctatctctttgggagaactggccgagaaaaagaggaatggtttaggagatttattctggcatctaagctaaagtcggaaatcaagaagtcatcgggtgtctctggaggtaaaccagggcttttgcctgcacacagcagacacaacagtccgtccgggcacctgacccacagccgcagcagcagcaaaggcagtgtggaggagatcatgtcacagccaaagcagaaggagctggcaggcagcgtgcggcagaagatgcttctcgactacagcgtgtacatgggcaggtgtgtcccccaggaaagccgaagcccccagaggagccccctgcagagtgcggagagcagccccacagctgggaagaagttgccagaggttccaccctctgaggaggaagaacaggaagcctgggtgaatgccttgcttggaagaatattttgggacttcttaggagagaaatactggtctgatctggtgtctaagaagatccaaatgaaactcagcaaaataaagctcccctactttatgaatgagctcactctgacggaacttgacatgggcgtggctgtgccaaaaatcctccaggccttcaagccttacgttgatcaccaaggactctggattgatttggaaatgtcctacaatgggtcctttctgatgactctcgagaccaaaatgaatttgaccaaactaggtaaagagcctcttgttgaagccctgaaggttggagaaattggcaaagaaggttgcaggccccgggcattctgtctggcggacagcgatgaggaatcctccagcgctggctcctccgaggaagacgatgccccagagcccagcgggggagacaaacagctcctcccaggggctgaagggtacgttggaggtcatcgaacaagtaagattatgaggtttgttgataaaattaccaagtcaaaatatttccaaaaagcaacagagacagagtttattaaaaagaagatcgaagaagtctccaacacacccctgctgctcactgttgaagtacaagaatgtagaggaaccttggcggtcaacattccaccacccccgactgaccgagtatggtatggtttccgaaagccaccacatgtggagctgaaagctcggccaaaacttggagagagagaagtgactttagttcatgtgacagactggatagagaagaaactggagcaagagtttcagaaagtttttgtcatgccaaacatggatgatgtttatatcactataatgcactcagccatggaccctcgctctacttcctgcctcctgaaagacccacctgtggaggctgctgatcagccatgatgggtgatgtcagatgttccccatattgtgacatcgagctggatgtgtggggttcttggccgccatctgtactgtagcactggcctctgtgccacagctactgtttcttaaaggactgcttctgccctctgcctgccagtgcccattccactgtgaggtgtcattccctgcatctagtgacaactgtctggattgcctgctgcaaagctttgatttggcaaaggagaccatggaagaatcatggtggatccagaagttatacgtgacccacaccatggcttttaaaagtctacccatgtttgtggcagcaaatgagcacagtaagagcaaagctgaacaacttgcctcctctactcctccaaagcttttcttcaggcagccggtgcacagtggactttttcacttctatactttgtatgcggccttccacacttccagagaatgtcagtgtgcaatgtgtctggagggtggggagaggaattctgtgagccttttcatttcggtgacagaagagatgggcagagcaacttattttccacattaaattgtgcatttgggaagcaagtagccatagtacacacacaacacgctatcagcttgggtaaggacagtgggatttatgtgaacatcaggcaaagccatgagatcaaaccatcccaagcctttcaccaatgaggtacaaccacctgggggctagctaatcttgaatgttttcctgagacaggagcgtatgtgaaaacatcaaacactgcacatgacaggatgggtcctctcatacagatgggatggggttagaaagccagagccagtttttccatctggcgtttcctgtgtcctccaggtttatatgggaatcgaaacagtttgttaatctgattgggagagttccatgggcagatttcccttcctgaaggccaaaacggagaactgctctctttaattatttcaagagtcaagaccaaaagtttgctcagcatcacactacatctcaaaattaatgttgccaacttaattttgtgcatttgtgtcagaatgtttagtttacaaggttgggggctctctttgcttcgagaagtaaacctaataccatttttttattgtttaaagctgcattcaacgtcaaaattaccttgggtaacttttgataacttacatgtgtggacaaagctaatagtggttttttaaacagcaccttgcctgaacatgactttaaagaaattaatatattgaaaacatgtttgaacccttattttaattgcaccattaaaacatttgacttaaattgtttgaccatt

SEQ ID NO: 21410 - DNA, 4825 bp, Homo sapiens
  ENST00000584379
ggggcggcgtgtgcccgggggcgggcgggcggcagggcagcaggaccgcggccggtgccccagccgaagccggagtcgcgcggccgggagcacgggcgccggcatagtacaatgaggcagccagcggatcttggagcctgagcccttgtgaagccggcaatgacaagtctgtatggtcgccatgccgagaaaaccactgacatgccaaaaccatcagcccctaaagtgcacgtgcagaggtccgtgtcccgagataccatcgccattcacttctcggcatccggcgaggaggaggaggaagaggaggaggagttcagggagtactttgaggaggggctggatgaccaaagcattgtaacagggctggaagccaaggaagacctctatcttgaaccccaagttggccatgaccccgccggccctgctgcctcgcctgtcctggcagatggactgtccgtgtcccaggcccctgccattttgcccgtctccaagaacactgtaaagctgttggagtcccctgttccagcagcacaagtattaagtacagtgccattggctgtgtccccagggtcgtcttcgtcggggcccttagctagctctcccagtgtgtcatccctttctgagcagaaaaccagttcttcctccccattgtcctctccttctaagtctcccatcctctcatccagtgcctcaacctccaccctttccagtgcaaaacccttcatgagccttgtgaagtccctgtcgaccgaggtggagccaaaagaatccccacaccccgcaaggcacaggcacttgatgaagacattagtcaagtctctgtccacggacacttcccggcaggagtcggatacagtgtcctataagccacctgattccaaactgaacttacacctgttcaagcagttcacacagccccgaaacacaggtggagattccaaaactgcaccttcttccccactgacttctccctctgatactcgttccttttttaaagtgcccgaaatggaggctaaaattgaagatactaaacgacgcctttcagaagtcatctatgagccttttcagctccttagtaaaattataggggaagaaagtggcagccataggcccaaagccttatcttcaagtgcttcagaactctccaatctgtccagcttgaatgggcacttggaaagcaataacaactacagcatcaaggaggaggagtgtgattctgagggggatggctacggaagtgattccaacatccccagaagtgaccacccaaagtccactggtgagcccacaagagagatagaactgaaaagttcccaggggagcagtctgaaggatttaggcctgaagacaagttctctagttctggagaaatgttctttgtctgccttagtgagcaaagaagatgaagagttttgtgaactgtacactgaggacttcgatttggaaacggagggggagagtaaagttgataagctctcagatattcctctcaagccagaggtgctcgcggaagatggtgtggtccttgacagtgaggacgaggtggactcggccgtgcagcacccggaattgccagtgaagacgttgggcttctttataatgtgtgtctatgtgtacctcatcctccccctcccccactatgtgagtggactctttctgggaattggccttggattcatgactgcagtttgcgtgatttggttttttacaccaccaagtgctcataaatatcacaagttacacaaaaatctgcgacactggaacacaagatctctggatatcaaagaacctgaaatactgaagggatggatgaatgagatttacaactatgatccagaaacctaccatgcgactttgacacattcagtctttgttcgacttgagggtggaaccttaagactttcaaagcccaataaaaatatatccaggagggccagctacaatgaacccaagccagaggtcacctacatcagccagaaaatctatgacctctcagacagcaagatttatcttgtacctaaaactttggctcgaaagcgaatctggaataaaaagtaccccatttgtatcgagcttggtcagcaagatgactttatgtctaaagctcagactgataaggagacttcagaagagaagccgccagctgagggaagtgaggaccctaagaagccaccccgccctcaggagggaacaagatctagccagcgagatcagatactctatctctttgggagaactggccgagaaaaagaggaatggtttaggagatttattctggcatctaagctaaagtcggaaatcaagaagtcatcgggtgtctctggaggtaaaccagggcttttgcctgcacacagcagacacaacagtccgtccgggcacctgacccacagccgcagcagcagcaaaggcagtgtggaggagatcatgtcacagccaaagcagaaggagctggcaggcagcgtgcggcagaagatgcttctcgactacagcgtgtacatgggcaggtgtgtcccccaggaaagccgaagcccccagaggagccccctgcagagtgcggagagcagccccacagctgggaagaagttgccagaggttccaccctctgaggaggaagaacaggaagcctgggtgaatgccttgcttggaagaatattttgggacttcttaggagagaaatactggtctgatctggtgtctaagaagatccaaatgaaactcagcaaaataaagctcccctactttatgaatgagctcactctgacggaacttgacatgggcgtggctgtgccaaaaatcctccaggccttcaagccttacgttgatcaccaaggactctggattgatttggaaatgtcctacaatgggtcctttctgatgactctcgagaccaaaatgaatttgaccaaactaggtaaagagcctcttgttgaagccctgaaggttggagaaattggcaaagaaggttgcaggccccgggcattctgtctggcggacagcgatgaggaatcctccagcgctggctcctccgaggaagacgatgccccagagcccagcgggggagacaaacagctcctcccaggggctgaagggtacgttggaggtcatcgaacaagtaagattatgaggtttgttgataaaattaccaagtcaaaatatttccaaaaagcaacagagacagagtttattaaaaagaagatcgaagaagtctccaacacacccctgctgctcactgttgaagtacaagaatgtagaggaaccttggcggtcaacattccaccacccccgactgaccgagtatggtatggtttccgaaagccaccacatgtggagctgaaagctcggccaaaacttggagagagagaagtgactttagttcatgtgacagactggatagagaagaaactggagcaagagtttcagaaagtttttgtcatgccaaacatggatgatgtttatatcactataatgcactcagccatggaccctcgctctacttcctgcctcctgaaagacccacctgtggaggctgctgatcagccatgatgggtgatgtcagatgttccccatattgtgacatcgagctggatgtgtggggttcttggccgccatctgtactgtagcactggcctctgtgccacagctactgtttcttaaaggactgcttctgccctctgcctgccagtgcccattccactgtgaggtgtcattccctgcatctagtgacaactgtctggattgcctgctgcaaagctttgatttggcaaaggagaccatggaagaatcatggtggatccagaagttatacgtgacccacaccatggcttttaaaagtctacccatgtttgtggcagcaaatgagcacagtaagagcaaagctgaacaacttgcctcctctactcctccaaagcttttcttcaggcagccggtgcacagtggactttttcacttctatactttgtatgcggccttccacacttccagagaatgtcagtgtgcaatgtgtctggagggtggggagaggaattctgtgagccttttcatttcggtgacagaagagatgggcagagcaacttattttccacattaaattgtgcatttgggaagcaagtagccatagtacacacacaacacgctatcagcttgggtaaggacagtgggatttatgtgaacatcaggcaaagccatgagatcaaaccatcccaagcctttcaccaatgaggtacaaccacctgggggctagctaatcttgaatgttttcctgagacaggagcgtatgtgaaaacatcaaacactgcacatgacaggatgggtcctctcatacagatgggatggggttagaaagccagagccagtttttccatctggcgtttcctgtgtcctccaggtttatatgggaatcgaaacagtttgttaatctgattgggagagttccatgggcagatttcccttcctgaaggccaaaacggagaactgctctctttaattatttcaagagtcaagaccaaaagtttgctcagcatcacactacatctcaaaattaatgttgccaacttaattttgtgcatttgtgtcagaatgtttagtttacaaggttgggggctctctttgcttcgagaagtaaacctaataccatttttttattgtttaaagctgcattcaacgtcaaaattaccttgggtaacttttgataacttacatgtgtggacaaagctaatagtggttttttaaacagcaccttgcctgaacatgactttaaagaaattaatatattgaaaacatgtttgaacccttattttaattgcaccattaaaacatttgacttaaa

SEQ ID NO: 21411 - DNA, 1966 bp, Homo sapiens
  ENST00000583501
tgggaattggccttggattcatgactgcagtttgcgtgatttggttttttacaccaccaagtgctcataaatatcacaagttacacaaaaatctgcgacactggaacacaagatctctggatatcaaagaacctgaaatactgaagggatggatgaatgagatttacaactatgatccagaaacctaccatgcgactttgacacattcagtctttgttcgacttgagggtggaaccttaagactttcaaagcccaataaaaatatatccaggagggccagctacaatgaacccaagccagaggtcacctacatcagccagaaaatctatgacctctcagacagcaagatttatcttgtacctaaaactttggctcgaaagcgaatctggaataaaaagtaccccatttgtatcgagcttggtcagcaagatgactttatgtctaaagctcagactgataaggagacttcagaagagaagccgccagctgagggaagtgaggaccctaagaagccaccccgccctcaggagggaacaagatctagccagcgagatcagatactctatctctttgggagaactggccgagaaaaagaggaatggtttaggagatttattctggcatctaagctaaagtcggaaatcaagaagtcatcgggtgtctctggaggtaaaccagggcttttgcctgcacacagcagacacaacagtccgtccgggcacctgacccacagccgcagcagcagcaaaggcagtgtggaggagatcatgtcacagccaaagcagaaggagctggcaggcagcgtgcggcagaagatgcttctcgactacagcgtgtacatgggcaggtgtgtcccccaggaaagccgaagcccccagaggagccccctgcagagtgcggagagcagccccacagctgggaagaagttgccagaggttccaccctctgaggaggaagaacaggaagcctgggtgaatgccttgcttggaagaatattttgggacttcttaggagagaaatactggtctgatctggtgtctaagaagatccaaatgaaactcagcaaaataaagctcccctactttatgaatgagctcactctgacggaacttgacatgggcgtggctgtgccaaaaatcctccaggccttcaagccttacgttgatcaccaaggactctggattgatttggaaatgtcctacaatgggtcctttctgatgactctcgagaccaaaatgaatttgaccaaactaggtaaagagcctcttgttgaagccctgaaggttggagaaattggcaaagaagggccccgggcattctgtctggcggacagcgatgaggaatcctccagcgctggctcctccgaggaagacgatgccccagagcccagcgggggagacaaacagctcctcccaggggctgaagggtacgttggaggtcatcgaacaagtaagattatgaggtttgttgataaaattaccaagtcaaaatatttccaaaaagcaacagagacagagtttattaaaaagaagatcgaagaagtctccaacacacccctgctgctcactgttgaagtacaagaatgtagaggaaccttggcggtcaacattccaccacccccgactgaccgagtatggtatggtttccgaaagccaccacatgtggagctgaaagctcggccaaaacttggagagagagaagtgactttagttcatgtgacagactggatagagaagaaactggagcaagagtttcagaaagtttttgtcatgccaaacatggatgatgtttatatcactataatgcactcagccatggaccctcgctctacttcctgcctcctgaaagacccacctgtggaggctgctgatcagccatgatgggtgatgtcagatgttccccatattgtgacatcgagctggatgtgtggggttcttggccgccatctgtactgtagcactggcct

SEQ ID NO: 21412 - DNA, 561 bp, Homo sapiens
  ENST00000581812
tctgggtccaaggcctctgtggtcctgtcagaggccttggtgctgaagagtgtcctgagcatctgcgctgatccaaggattcttggattgggcctcttctggtttggttgcaggccccgggcattctgtctggcggacagcgatgaggaatcctccagcgctggctcctccgaggaagacgatgccccagagcccagcgggggagacaaacagctcctcccaggggctgaagggtacgttggaggtcatcgaacaagtaagattatgaggtttgttgataaaattaccaagtcaaaatatttccaaaaagcaacagagacagagtttattaaaaagaagatcgaagaagtctccaacacacccctgctgctcactgttgaagtacaagaatgtagaggaaccttggcggtcaacattccaccacccccgactgaccgagtatggtatggtttccgaaagccaccacatgtggagctgaaagctcggccaaaacttggagagagagaagtgactttagttcatgtgacagactggatagagaagaaactggagcaagagttt

SEQ ID NO: 21413 - DNA, 555 bp, Homo sapiens
  ENST00000577489
tcttcattgtgtgaatagcccccgtcttcttggctccagggcttttgcctgcacacagcagacacaacagtccgtccgggcacctgacccacagccgcagcagcagcaaaggcagtgtggaggagatcatgtcacagccaaagcagaaggagctggcaggcagcgtgcggcagaagatgcttctcgactacagcgtgtacatgggcaggtgtgtcccccaggaaagccgaagcccccagaggagccccctgcagagtgcggagagcagccccacagctgggaagaagttgccagaggttccaccctctgaggaggaagaacaggaagcctgggtgaatgccttgcttggaagaatattttgggacttcttaggagagaaatactggtctgatctggtgtctaagaagatccaaatgaaactcagcaaaataaagctcccctactttatgaatgagctcactctgacggaacttgacatgggcgtggctgtgccaaaaatcctccaggccttcaagccttacgttgatcaccaagttgcaggccccgggcattctg

SEQ ID NO: 21414 - DNA, 563 bp, Homo sapiens
  ENST00000583922
aaggtagattatgttggactttctgtggtgtgctaagcattcagcacccgtacctgggagacttggccctacctgtaggcatctctgcagtgggtgcagtcctgagtgtggagcaaggtggaccggaagcagctgttcctctgctcttgcctgcagttgtttgctttagtgtttggatgcgggcagatctttcaccttttttcctgataagaggagacagagactactggccttacagccaggtggtcaaacatgacaactcggagttgctgtgtgcaaaacctgcctgaaccccatctccagcgagatttgatgatgtttccccattcaaaggaacaaccacgcctcaggaccatacaaggagaggacttcatgaaacagagcctgagcccttgtgaagccggcaatgacaagtctgtatggtcgccatgccgagaaaaccactgacatgccaaaaccatcagcccctaaagtgcacgtgcagaggtccgtgtcccgagataccatcgccattcacttctcggcatccggcgaggaggaggaggaagaggaggaggagttca

SEQ ID NO: 21415 - DNA, 458 bp, Homo sapiens
  ENST00000583738
gtgccccagccgaagccggagtcgcgcggccgggagcacgggcgccggcatagtacaatgaggcagccagcggatcttggcagaaacaaccttatacaaagtggttccgtggaggagagaattaccatgttatagtcctcaggaaggcttttgttcctggaaaggataccattgaatagtgacatctgagttttaaggtaataacagaaaaaacttggaaataaacatcccattatttgacctccaaggcagaagactggcaccaaggaaatggcagcttcgtccctttcctgtcttgggcattgagcctgagcccttgtgaagccggcaatgacaagtctgtatggtcgccatgccgagaaaaccactgacatgccaaaaccatcagcccctaaagtgcacgtgcagaggtccgtgtcccgagataccatcgccattcacttctcggcatccggcga

SEQ ID NO: 21416 - DNA, 4852 bp, Homo sapiens
  ENST00000615733
gacaatggaggaagcttccctcagtttacagcagaaccccaggctcagggaggtgaagtggggagctccgtcactgtcatttgagggccatttgagggctgtggtcctccgtggagctcctccctctgctgcctcatggcctcactcgagcctgagcccttgtgaagccggcaatgacaagtctgtatggtcgccatgccgagaaaaccactgacatgccaaaaccatcagcccctaaagtgcacgtgcagaggtccgtgtcccgagataccatcgccattcacttctcggcatccggcgaggaggaggaggaagaggaggaggagttcagggagtactttgaggaggggctggatgaccaaagcattgtaacagggctggaagccaaggaagacctctatcttgaaccccaagttggccatgaccccgccggccctgctgcctcgcctgtcctggcagatggactgtccgtgtcccaggcccctgccattttgcccgtctccaagaacactgtaaagctgttggagtcccctgttccagcagcacaagtattaagtacagtgccattggctgtgtccccagggtcgtcttcgtcggggcccttagctagctctcccagtgtgtcatccctttctgagcagaaaaccagttcttcctccccattgtcctctccttctaagtctcccatcctctcatccagtgcctcaacctccaccctttccagtgcaaaacccttcatgagccttgtgaagtccctgtcgaccgaggtggagccaaaagaatccccacaccccgcaaggcacaggcacttgatgaagacattagtcaagtctctgtccacggacacttcccggcaggagtcggatacagtgtcctataagccacctgattccaaactgaacttacacctgttcaagcagttcacacagccccgaaacacaggtggagattccaaaactgcaccttcttccccactgacttctccctctgatactcgttccttttttaaagtgcccgaaatggaggctaaaattgaagatactaaacgacgcctttcagaagtcatctatgagccttttcagctccttagtaaaattataggggaagaaagtggcagccataggcccaaagccttatcttcaagtgcttcagaactctccaatctgtccagcttgaatgggcacttggaaagcaataacaactacagcatcaaggaggaggagtgtgattctgagggggatggctacggaagtgattccaacatccccagaagtgaccacccaaagtccactggtgagcccacaagagagatagaactgaaaagttcccaggggagcagtctgaaggatttaggcctgaagacaagttctctagttctggagaaatgttctttgtctgccttagtgagcaaagaagatgaagagttttgtgaactgtacactgaggacttcgatttggaaacggagggggagagtaaagttgataagctctcagatattcctctcaagccagaggtgctcgcggaagatggtgtggtccttgacagtgaggacgaggtggactcggccgtgcagcacccggaattgccagtgaagacgttgggcttctttataatgtgtgtctatgtgtacctcatcctccccctcccccactatgtgagtggactctttctgggaattggccttggattcatgactgcagtttgcgtgatttggttttttacaccaccaagtgctcataaatatcacaagttacacaaaaatctgcgacactggaacacaagatctctggatatcaaagaacctgaaatactgaagggatggatgaatgagatttacaactatgatccagaaacctaccatgcgactttgacacattcagtctttgttcgacttgagggtggaaccttaagactttcaaagcccaataaaaatatatccaggagggccagctacaatgaacccaagccagaggtcacctacatcagccagaaaatctatgacctctcagacagcaagatttatcttgtacctaaaactttggctcgaaagcgaatctggaataaaaagtaccccatttgtatcgagcttggtcagcaagatgactttatgtctaaagctcagactgataaggagacttcagaagagaagccgccagctgagggaagtgaggaccctaagaagccaccccgccctcaggagggaacaagatctagccagcgagatcagatactctatctctttgggagaactggccgagaaaaagaggaatggtttaggagatttattctggcatctaagctaaagtcggaaatcaagaagtcatcgggtgtctctggaggtaaactcagggcttttgccgcacacagcagacacaacagtccgtccgggcacctgacccacagccgcagcagcagcaaaggcagtgtggaggagatcatgtcacagccaaagcagaaggagctggcaggcagcgtgcggcagaagatgcttctcgactacagcgtgtacatgggcaggtgtgtcccccaggaaagccgaagcccccagaggagccccctgcagagtgcggagagcagccccacagctgggaagaagttgccagaggttccaccctctgaggaggaagaacaggaagcctgggtgaatgccttgcttggaagaatattttgggacttcttaggagagaaatactggtctgatctggtgtctaagaagatccaaatgaaactcagcaaaataaagctcccctactttatgaatgagctcactctgacggaacttgacatgggcgtggctgtgccaaaaatcctccaggccttcaagccttacgttgatcaccaaggactctggattgatttggaaatgtcctacaatgggtcctttctgatgactctcgagaccaaaatgaatttgaccaaactaggtaaagagcctcttgttgaagccctgaaggttggagaaattggcaaagaaggttgcaggccccgggcattctgtctggcggacagcgatgaggaatcctccagcgctggctcctccgaggaagacgatgccccagagcccagcgggggagacaaacagctcctcccaggggctgaagggtacgttggaggtcatcgaacaagtaagattatgaggtttgttgataaaattaccaagtcaaaatatttccaaaaagcaacagagacagagtttattaaaaagaagatcgaagaagtctccaacacacccctgctgctcactgttgaagtacaagaatgtagaggaaccttggcggtcaacattccaccacccccgactgaccgagtatggtatggtttccgaaagccaccacatgtggagctgaaagctcggccaaaacttggagagagagaagtgactttagttcatgtgacagactggatagagaagaaactggagcaagagtttcagaaagtttttgtcatgccaaacatggatgatgtttatatcactataatgcactcagccatggaccctcgctctacttcctgcctcctgaaagacccacctgtggaggctgctgatcagccatgatgggtgatgtcagatgttccccatattgtgacatcgagctggatgtgtggggttcttggccgccatctgtactgtagcactggcctctgtgccacagctactgtttcttaaaggactgcttctgccctctgcctgccagtgcccattccactgtgaggtgtcattccctgcatctagtgacaactgtctggattgcctgctgcaaagctttgatttggcaaaggagaccatggaagaatcatggtggatccagaagttatacgtgacccacaccatggcttttaaaagtctacccatgtttgtggcagcaaatgagcacagtaagagcaaagctgaacaacttgcctcctctactcctccaaagcttttcttcaggcagccggtgcacagtggactttttcacttctatactttgtatgcggccttccacacttccagagaatgtcagtgtgcaatgtgtctggagggtggggagaggaattctgtgagccttttcatttcggtgacagaagagatgggcagagcaacttattttccacattaaattgtgcatttgggaagcaagtagccatagtacacacacaacacgctatcagcttgggtaaggacagtgggatttatgtgaacatcaggcaaagccatgagatcaaaccatcccaagcctttcaccaatgaggtacaaccacctgggggctagctaatcttgaatgttttcctgagacaggagcgtatgtgaaaacatcaaacactgcacatgacaggatgggtcctctcatacagatgggatggggttagaaagccagagccagtttttccatctggcgtttcctgtgtcctccaggtttatatgggaatcgaaacagtttgttaatctgattgggagagttccatgggcagatttcccttcctgaaggccaaaacggagaactgctctctttaattatttcaagagtcaagaccaaaagtttgctcagcatcacactacatctcaaaattaatgttgccaacttaattttgtgcatttgtgtcagaatgtttagtttacaaggttgggggctctctttgcttcgagaagtaaacctaataccatttttttattgtttaaagctgcattcaacgtcaaaattaccttgggtaacttttgataacttacatgtgtggacaaagctaatagtggttttttaaacagcaccttgcctgaacatgactttaaagaaattaatatattgaaaacatgtttgaacccttattttaattgcaccattaaaacatttgacttaaattgtttgaccatt

SEQ ID NO: 21417 - DNA, 734 bp, Homo sapiens
  ENST00000532135
ggaggagcttcccagacgtgtagagcttatgaagtttaggaagcagcttcccagacatgtagagcttatggagaggtgagggagccaatctcagccacattcagcttcctggagagaatgaccaaagggcgacgcttcaacccaccttcagacaaggatgggagatggttccctcacatcgggctaacgcaaaagacaccagaatccatcaccagtgctacgtcaaaagagccccagagtccacacttgcctcggcaagcggaggggaagctgccgcccatatacaaagtccgggagaagcaagcagtgaataaccagttccccttctccgtgcatgacaatcggcacagcttggagaactctggatgctaccttgactccgaaagaatgacagcaacggacccacagggagaaccagacaagagacaagagttctatgagccggtgaggacccagtccattcctcatccaggcctgagaactaatgcacccctccttgcagtgtgagctctttgggagcaagtttctgtcacccattccccagagtcctgactaatagaatgtgtattagttgggaagaaaaggaccttttgtcttagcctagctagttagtaaccaccaggatttattcagcattcttggaaaaataaatttccagctatggagaaatcctcttattctgcttgcctgtgtgggcgcaggtattaatagggctatctccctggcaggaagaa

SEQ ID NO: 21418 - DNA, 438 bp, Homo sapiens
  ENST00000526819
agtaaagatcaggaacaaggaggaggaggagcttcccagacgtgtagagcttatgaagtttaggaagcagcttcccagacatgtagagcttatggagaggtgagggagccaatctcagccacattcagcttcctggagagaatgaccaaagggcgacgcttcaacccaccttcagacaaggatgggagatggttccctcacatcgggctaacgcaaaagacaccagaatccatcaccagtgctacgtcaaaagagccccagagtccacacttgcctcggcaagcggaggggaagctgccgcccatatacaaagtccgggagaagcaagcagtgaataaccagttccccttctccgtgcatgacaatcggcacagcttggagaactctggatgctaccttgactcctttgcagatggcctatcgtgggacttctctttg

SEQ ID NO: 21419 - DNA, 922 bp, Homo sapiens
  ENST00000368821
ggaagaggctgagaagtaaagatcaggaacaaggaggaggaggagcttcccagacgtgtagagcttatgaagtttaggaagcagcttcccagacatgtagagcttatggagaggtgagggagccaatctcagccacattcagcttcctggagagaatgaccaaagggcgacgcttcaacccaccttcagacaaggatgggagatggttccctcacatcgggctaacgcaaaagacaccagaatccatcaccagtgctacgtcaaaagagccccagagtccacacttgcctcggcaagcggaggggaagctgccgcccatatacaaagtccgggagaagcaagcagtgaataaccagttccccttctccgtgcatgacaatcggcacagcttggagaactctggatgctaccttgactccggcctgggacgtaagaagatctctccagataagaggcaacatgtttcaagaaattttaatctctgggcatgtgactatgttccatcttgtcttgatggcttttcaaataaccaaatatcatacgtatataaagaagccatggtggtctcaagcttcagacgctttccacgatgctataaagagatatggaacgcttttacatttcttcctgagagaagctatacagaggttttgaaaaagaagcccaaagtaaggttcactgttgacaaaaaggttgtttcttcactggagtcctaatcctcccagaagatttttgatgaattttgtaatactggtatttcatcagacatcctaaaagtatatgttttctgatccagcaccactatttaatttttaaagtacttttatgatttttataaggtcaaaaaacattcaaatccttgtgaaatgaatttgtgatgacatacgcatgtgtaaataaacttttcagatggccacattta

SEQ ID NO: 21420 - DNA, 689 bp, Homo sapiens
  ENST00000560827
ggccagggaagcgcgccgctgggggccgggaggagtccggcccggctggtggagagcaggaaaacgtgggggaggtgctggcgagagaaagagaacttgcgtgaggaggaggaggagaaaccaaatttaataatatttggcgtggaaatgggatttgggcgggggaggcatcttcaaagcaagtaaagagaaatcaacattatcccccttcccctgcacatgcatgtgaggattacttcctccctgagtaaatgaagagaactgaagcaggcgtttaaatgcagaattgcaggcaaaaacagctgacgtggttcaacaagctaaggaaataataagagatcggcaagaagtacgatctaggcctgtttcaacacaaatgaaatcatgtgatgacgaagatgattacagtttaagaggtctgttaccatctgaagggatagttcatcttcattcagaaactaagccaaagaccaaaaacattgatcctgtaaacaaggttcaaaacaaattacactctgcaaataaaggaaggaaaacaaattcaagtgttaaattgaaatactctgatgtccaaactgccgacgatgttgccattccagaggatttctcagacttttcccttgcaaaaacaattagcaaaattgaagggcaactggaggaagaaggcttacctgaatatatagatgata

SEQ ID NO: 21421 - DNA, 1433 bp, Homo sapiens
  ENST00000352903
gtaaccgcgtcgcagtcgccgaagatggcggggcgaagtctgtgtctcacgagaagcagcgttccagggactccgttcccgccacccgttcagcaaccctctacacctggacccgacctcctcgccttggaggaagaatataagcgtttaaatgcagaattgcaggcaaaaacagctgacgtggttcaacaagctaaggaaataataagagatcggcaagaagtacgatctaggcctgtttcaacacaaatgaaatcatgtgatgacgaagatgattacagtttaagaggtctgttaccatctgaagggatagttcatcttcattcagaaactaagccaaagaccaaaaacattgatcctgtaaacaaggttcaaaacaaattacactctgcaaataaaggaaggaaaacaaattcaagtgttaaattgaaatactctgatgtccaaactgccgacgatgttgccattccagaggatttctcagacttttcccttgcaaaaacaattagcaaaattgaagggcaactggaggaagaaggcttacctgaatatatagatgatattttttctggtgttagtaatgacattggaacagaagcacagatcagatttctaaaggccaaactccatgttatgcaggaggaattggataatgttgtatgtgaatgcaataaaaaggaggatgaaattcagaatttaaagtctcaagtaaaaaattttgaagaagattttatgagacagcagcgaacaattaatatgcaacagtctcaagtagaaaaatacaaaactcttttcgaagaagcaaacaaaaagtatgatggattacagcaacagttgtcttcagtagaaagggaattagaaaataaaagaagactgcaaaaacaggctgcaagtagtcaaagtgccacagaggttcgcttgaatagagctctagaagaagcagaaaagtataaactggagttaagtaaattaaggcaaaataacaaggacatagcaaatgaagaacacaaaaaaattgaagtgttaaaatcagaaaacaagaagctagaaaaacaaaaaggagaattaatgatagggttcaagaaacagttaaaattaattgatgttttaaaaaggcaaaagatgcatattgaagctgccaagatgctatctttcactgaggaggaatttatgaaagcacttgaatggggaaattcataagtgatctacttcagttagtctctatgacaataagaaaactaaggctcagagaaaaagccaaaactagtacttgcatgacacctagtcaagtcctagtagtattcgactttcattttgtggatcaatttttatttggaaaatagcagcaattctcgtaggagtcagattaaaacgtctacaactaccttgaataacttcaactatcaggataattaaaactgcaaaccactgga

SEQ ID NO: 21422 - DNA, 1768 bp, Homo sapiens
  ENST00000537232
gcagtcgccgaagatggcggggcgaagtctgtgtctcacgagaagcagcgttccagggactccgttcccgccacccgttcagcaaccctctacacctggacccgacctcctcgccttggaggaagaatataagtaagaaattcggcggttgaacttttccttctttctttcatctgaatgaggctgcttacaagtacttttttctggagactggctggatcttcgggaccactcactctgcagcattcccttctcgtcatctcgttcacctgccgtttatcctttctttgtctttgatctgagtagttcgcctgcgtattagaagatatttgaagtgggcgaaaatttagcccaagcgtttaaatgcagaattgcaggcaaaaacagctgacgtggttcaacaagctaaggaaataataagagatcggcaagaagtacgatctaggcctgtttcaacacaaatgaaatcatgtgatgacgaagatgattacagtttaagaggtctgttaccatctgaagggatagttcatcttcattcagaaactaagccaaagaccaaaaacattgatcctgtaaacaaggttcaaaacaaattacactctgcaaataaaggaaggaaaacaaattcaagtgttaaattgaaatactctgatgtccaaactgccgacgatgttgccattccagaggatttctcagacttttcccttgcaaaaacaattagcaaaattgaagggcaactggaggaagaaggcttacctgaatatatagatgatattttttctggtgttagtaatgacattggaacagaagcacagatcagatttctaaaggccaaactccatgttatgcaggaggaattggataatgttgtatgtgaatgcaataaaaaggaggatgaaattcagaatttaaagtctcaagtaaaaaattttgaagaagattttatgagacagcagcgaacaattaatatgcaacagtctcaagtagaaaaatacaaaactcttttcgaagaagcaaacaaaaagtatgatggattacagcaacagttgtcttcagtagaaagggaattagaaaataaaagaagactgcaaaaacaggctgcaagtagtcaaagtgccacagaggttcgcttgaatagagctctagaagaagcagaaaagtataaactggagttaagtaaattaaggcaaaataacaaggacatagcaaatgaagaacacaaaaaaattgaagtgttaaaatcagaaaacaagaagctagaaaaacaaaaaggagaattaatgatagggttcaagaaacagttaaaattaattgatgttttaaaaaggcaaaagatgcatattgaagctgccaagatgctatctttcactgaggaggaatttatgaaagcacttgaatggggaaattcataagtgatctacttcagttagtctctatgacaataagaaaactaaggctcagagaaaaagccaaaactagtacttgcatgacacctagtcaagtcctagtagtattcgactttcattttgtggatcaatttttatttggaaaatagcagcaattctcgtaggagtcagattaaaacgtctacaactaccttgaataacttcaactatcaggataattaaaactgcaaaccactggacaaacaggacattgtttgtgctactttctttttcaaaggacagcgctatatggcttagcaaatgaagtctctccaccttttcttatcacctgccacacctaaaggtattcctgttaacagcat

SEQ ID NO: 21423 - DNA, 2297 bp, Homo sapiens
  ENST00000561221
cgaagatggcggggcgaagtctgtgtctcacgagaagcagcgttccagggactccgttcccgccacccgttcagcaaccctctacacctggacccgacctcctcgccttggaggaagaatataagcgtttaaatgcagaattgcaggcaaaaacagctgacgtggttcaacaagctaaggaaataataagagatcggcaagaagtacgatctaggcctgtttcaacacaaatgaaatcatgtgatgacgaagatgattacagtttaagaggtctgttaccatctgaagggatagttcatcttcattcagaaactaagccaaagaccaaaaacattgatcctgtaaacaaggttcaaaacaaattacactctgcaaataaaggaaggaaaacaaattcaagtgttaaattgaaatactctgatgtccaaactgccgacgatgttgccattccagaggatttctcagacttttcccttgcaaaaacaattagcaaaattgaagggcaactggaggaagaaggcttacctgaatatatagatgatattttttctggtgttagtaatgacattggaacagaagcacagatcagatttctaaaggccaaactccatgttatgcaggaggaattggataatgttgtatgtgaatgcaataaaaaggaggatgaaattcagaatttaaagtctcaagtaaaaaattttgaagaagattttatgagacagcagcgaacaattaatatgcaacagtctcaagtagaaaaatacaaaactcttttcgaagaagcaaacaaaaagtatgatggattacagcaacagttgtcttcagtagaaagggtaattatttggtatttttcctaacttaatgccacagatacaagaaaattattaaggttacacatttgtatagatgccattttgacagttcagttattttattagtatttactgaaaactctttccccttacatagaatatttttaacaactttattgagatgtaattcacccttttaaagtatgcaattcaatggcttttggtgtattcatagaattgtgcaactatcaccacaaccattttcataatccctaaaagatacttcataccctttagccaccacaccctgaccctgctcccctcaatcccttacagccctaggcaaccactattctattttatgtctcaataaatttgtctattctggaaatcacatatacgtggaatcatataatatgtggtcttttgtgactgacttttacttaagatattttcaaggttcattcatgttgcagcccctatcagtattttatttctttttattggcaagtaacattctgttatatggatataacacatttaatttatctgtttatcagttcgtagctttaggttatttgggttgtttctactgtctgacaattttaaatactttgaatattcatgtacaagtttttgtgtgcacgtatgtttctatttctcttggttatatagccaggaatggaattgctgggtcatatggaaatcctatgttgaccttttgaggaattgctgactgttttccaacctgcctgtaccattttacattcctaccagtagtgcatgaagctcctaatttctacacatcctcaccaacatctgctagattatctttttgattatagccatactgcaagtgtaaaagggttacctcattgtggttttgatttgcatttccctaataactaatgatgttgaacatcttttcatgtgcttattggcatttgtatattttctttggagaaatgtctgttaaggtctttgcccattttttaaattggatttgaaaaaattactgaataataagaacttttaagttctttatgtgtttagatacaagtcccttatcaggtatattttgcaaatagttttcccctacagtgggttgtctttcactttctttatggtactctaaaggcacaaaagttttaaattttgatgaagtccagtttatctaatatttatttggtttcctgtgcttttggtgtcatatttaaggggagaatgtattttaaataaactatcctagcttatattagtgtgccattgtgaaaataaaaatatactgtttgagattgctttgtaaaatgtagtgacgataagaattatgtaatatagcatatcccgagatttagtaagaaaatgtgccccctttattagtacccttacatttctcgtttgtatggtcatatttaaaaaccctgctttttaaacattttggtcttgtataattagctttatcttgtaataaattttaatatcaaa

SEQ ID NO: 21424 - DNA, 687 bp, Homo sapiens
  ENST00000558127
gaagatggcggggcgaagtctgtgtctcacggtcagttcaactccaggctcctggggagcgtctgggttccggcgactaggacgcctaacttcctttaacttcgggtctgaaagtctgtggctcttttacagagaagcagcgttccagggactccgttcccgccacccgttcagcaaccctctacacctggacccgacctcctcgccttggaggaagaatataagtaagaaattcggcggttgaacttttccttctttctttcatctgaatgaggctgcttacaagtacttttttctggagactggctggatcttcgggaccactcactctgcagcattcccttctcgtcatctcgttcacctgccgtttatcctttctttgtctttgatctgagtagttcgcctgcgtattagaagatatttgaagtgggcgaaaatttagcccaagcgtttaaatgcagaattgcaggcaaaaacagctgacgtggttcaacaagctaaggaaataatatgttaaattgaaatactctgatgtccaaactgccgacgatgttgccattccagaggatttctcagacttttcccttgcaaaaacaattagcaaaattgaagggcaactggaggaagaaggcttacctgaatatatagatgatattttttctggtgttagtaatgacattggaacag

SEQ ID NO: 21425 - DNA, 4440 bp, Homo sapiens
  ENST00000558083
gaagatggcggggcgaagtctgtgtctcacggtcagttcaactccaggctcctggggagcgtctgggttccggcgactaggacgcctaacttcctttaacttcgggtctgaaagtctgtggctcttttacagagaagcagcgttccagggactccgttcccgccacccgttcagcaaccctctacacctggacccgacctcctcgccttggaggaagaatataagcgtttaaatgcagaattgcaggcaaaaacagctgacgtggttcaacaagctaaggaaataataagagatcggcaagaagtacgatctaggcctgtttcaacacaaatgaaatcatgtgatgacgaagatgattacagtttaagaggtctgttaccatctgaagggatagttcatcttcattcagaaactaagccaaagaccaaaaacattgatcctgtaaacaaggttcaaaacaaattacactctgcaaataaaggaaggaaaacaaattcaagtgttaaattgaaatactctgatgtccaaactgccgacgatgttgccattccagaggatttctcagacttttcccttgcaaaaacaattagcaaaattgaagggcaactggaggaagaaggcttacctgaatatatagatgatattttttctggtgttagtaatgacattggaacagaagcacagatcagatttctaaaggccaaactccatgttatgcaggaggaattggataatgttgtatgtgaatgcaataaaaaggaggatgaaattcagaatttaaagtctcaagtaaaaaattttgaagaagattttatgagacagcagcgaacaattaatatgcaacagtctcaagtagaaaaatacaaaactcttttcgaagaagcaaacaaaaagtatgatggattacagcaacagttgtcttcagtagaaagggtaattatttggtatttttcctaacttaatgccacagatacaagaaaattattaaggttacacatttgtatagatgccattttgacagttcagttattttattagtatttactgaaaactctttccccttacatagaatatttttaacaactttattgagatgtaattcacccttttaaagtatgcaattcaatggcttttggtgtattcatagaattgtgcaactatcaccacaaccattttcataatccctaaaagatacttcataccctttagccaccacaccctgaccctgctcccctcaatcccttacagccctaggcaaccactattctattttatgtctcaataaatttgtctattctggaaatcacatatacgtggaatcatataatatgtggtcttttgtgactgacttttacttaagatattttcaaggttcattcatgttgcagcccctatcagtattttatttctttttattggcaagtaacattctgttatatggatataacacatttaatttatctgtttatcagttcgtagctttaggttatttgggttgtttctactgtctgacaattttaaatactttgaatattcatgtacaagtttttgtgtgcacgtatgtttctatttctcttggttatatagccaggaatggaattgctgggtcatatggaaatcctatgttgaccttttgaggaattgctgactgttttccaacctgcctgtaccattttacattcctaccagtagtgcatgaagctcctaatttctacacatcctcaccaacatctgctagattatctttttgattatagccatactgcaagtgtaaaagggttacctcattgtggttttgatttgcatttccctaataactaatgatgttgaacatcttttcatgtgcttattggcatttgtatattttctttggagaaatgtctgttaaggtctttgcccattttttaaattggatttgaaaaaattactgaataataagaacttttaagttctttatgtgtttagatacaagtcccttatcaggtatattttgcaaatagttttcccctacagtgggttgtctttcactttctttatggtactctaaaggcacaaaagttttaaattttgatgaagtccagtttatctaatatttatttggtttcctgtgcttttggtgtcatatttaaggggagaatgtattttaaataaactatcctagcttatattagtgtgccattgtgaaaataaaaatatactgtttgagattgctttgtaaaatgtagtgacgataagaattatgtaatatagcatatcccgagatttagtaagaaaatgtgccccctttattagtacccttacatttctcgtttgtatggtcatatttaaaaaccctgctttttaaacattttggtcttgtataattagctttatcttgtaataaattttaatatcaaaatcacttagacaaaatttatatgcagtaaattcacactttttagtgtacaattctatgagttttgacaaatgtatgcagtaatataactatcactataattgagacatagaacagttccatcagccccccaaaattccctgtgaatttagtgaaggccttccctaattccaccaccaggcaaccactgatctgtgtttggttcttaaattttggacttttcccaaatgtcacataaatagaatcgcattggatatagacttttgaatctgttttttttttttttttttcagttagcataaaacatttgatatggtttggctgtgtccccacccaaatttcatcttgaattcccacttgttgcgggagggagccggtgggaggtaattgaatcatgggggcaagtctttcctgtgctgttcttgtgatggcgaaaaagtctcaggagatctgatggttttaaaagggagagtttcccagtgcaaactttcttgtctgctgctatgtgagacatgccttttactttccaacatgattgtgaggcctccccagccatgtggaactgtgagtccaataaacctctctcttttgtaaattgcccagtcttgggtgtgtcttaccagcagcatgacgatgaactaatccagtaaattggtactagtagagtcaggcgctactgaaaagataccaaaaagtgttgaagtgaccttggaactgggtaagaggcagaggttggaaaagtttggagggctcagaaaaatacaggaaaatatgggaaagtttggaactccctagagacttgttgaatggctttgaccaatatactgataatgatatggacaatgaaatccaggctgaggtgatctcagatggagatgaggaacttgttaggaactagagcaaatgtgactcttgttatgttttagcaaagagactggtggcattttgtccctcccctagagatctgtggaactttgaacttgagagagatgatttagggtatctggtggaacaaatttctaagcagcaaagcactcaagaggtgacttggtgctgttaaaggcatccagttttgaaagggaaacagagcacaaaaggttggaaaatttgcagcctgagaatgcagtggaaaagaaaatcccattttctgaggagaaattcaagccggctgcagaaatttgcataagtcttgaggagctgaatgttaatccccaggacaatggggaaaatgtctcccaaggtatgcagaggtcttcacggcagcgcctcccatcacaggcccagagacctaggaggcatgattggttttgaaatgtgaggacatgagatttgggagggtcttggggtagaatatggtttggctgtgtccccacccaaatttcatcttgaattcccatgtgttgtgggagggacccagtgggaggtcattgaatcacaggggcaggtctttcctgtgctgttctcatgagagtgaataagtctcaggagatttgatggttttaaaaatgggaatttccctgcacaagctctcgtctgccaccatgtgagatgtgcctttaccttccagcatgattgtgaggcctccccagccatgtgaaactgtgagtgcagtaaatctctttcttttgtaaattgcccagtcttgggtatgtctttatcagcagcatgaaaacggactaatacaacattcaatatttatccctattatagtccattcctttttattgctgagtagtgtaaactatgaatgaatgtacttcagtttgtttccccactcatctagtaataaaagttaattatagtatttaatagtctgaacttgtgtttccagtatggtagccacttaccatatgtggctaaattgcgatgtgctataactataaagtaaaaatcagattttgaagaattcatgtaaaacagaatgaagaatgtaaaatatctcaaaatctctttaatattttttgtattggttatatgttgaaataatatttgaatatattaggttaagtgaaatatgttattaaaattaattttacctgtttgtt

SEQ ID NO: 21426 - DNA, 537 bp, Homo sapiens
  ENST00000559142
taggcgtttaaatgcagaattgcaggcaaaaacagctgacgtggttcaacaagctaaggaaataatatttttgccagtgtctgaaaagcaggaaaatacttgtacaaaaggaccccacgttatagtagaatgacagattcattacgttttctactcagagagccctgtaaaaagaatctccccctgcaaataaaaaacagaatagaaaactgggataagctaggaaaggggttggggaatggattcctacccctgcagaagcaaacaatataaggtttctcatatttaatttttatttactcactttctctttttaaaatttttaatgtttgtggttacatagtaagtgtttatggggtaaatgagatattttgatacaggcatgcattgtgtaataatcacatcatggaaaatggggtatccatcccctcaagtatttatcctttgtgttacaaaaaatccaattatactattttagttaatttaaaatgtacaattaaatgattttgactataataaacatgttgtgctgtcaaa

SEQ ID NO: 21427 - DNA, 632 bp, Homo sapiens
  ENST00000559546
accaaagatagatcctgaaggtttgtgggagaaagcttagacagtaaggtattagtgtatttctttgcttcaaagacacatatactacattttaactgctcagaaattgggatctgtgttacagtcagtggcattttgtaatcacagtggctgcactgaagctgagttttgctagagaagatttatgtttgtttctgccaaactctcagggacattactgacctgagaacactttaaataatctgatgtagtttggaccaccctggtgcgtgtgaatttagtctgcaaacttatgtgaatactacctgtgatttctttctgttgagtggatttattcgtcattgaccttttcattaggactgttgagtacctatagtgccccctaacagatatctcctatttgactccccatcttgagtattttcttctttataaagtaatggtctgtcttacaattgatgtcatcttagattcagcaaaagacagtaaatataattatttaaattcacagaagcacagatcagatttctaaaggccaaactccatgttatgcaggaggaattggataatgttgtatgtgaatgcaataaaaaggaggatgaaattcagaatttaaagtctcaagtaaaaaa

SEQ ID NO: 21428 - DNA, 2005 bp, Homo sapiens
  ENST00000560582
cagcagcgaacaattaatatgcaacagtctcaagtagaaaaatacaaaactcttttcgaagaagcaaacaaaaagtatgatggattacagcaacagttgtcttcagtagaaagggaattagaaaataaaagaagactgcaaaaacaggctgcaagtagtcaaagtgccacagaggttcgcttgaatagagctctagaagaagcagaaaagtataaactggagttaagtaaattaaggcaaaataacaagatgcatattgaagctgccaagatgctatctttcactgaggaggaatttatgaaagcacttgaatggggaaattcataagtgatctacttcagttagtctctatgacagtatgtgatggatacccattttacttattgtagtggtttgaattatttttattcttcataagtaatatatttgattatgaaagcaaaataatttcaaagaattccctttttagatttaggagattagctattagctctttttgagttgttttttaagttcttagcgtgacaattaagcacatcagataataaaattcttgactcttttcatttataattctcctcccttacagtagaccaaaaaagatgctttaaaagaaaattccaaatatttatttccctggctaaatcaagtaagtaaagttcgtaaacacagacagaaggcagttcactttggggtagagttctgtattagtcaaggtaaatatactgtcttgaggatggggatgcaaacagtgctctgtagtgttgtagaaatcggattttgaaattatcagtacaaaaataacagcttgattaaaattaatttgtatctgataattgtttacaagttatgaaattcagtgatgatttacaaaatccaaacagacaatggatacctaatgccactgaactgtaaaacaaaagttatgctgacatctagtggtaacatgcaaaaaatctatgctttacccaattttgatgatatcatttctcttcacaaatttcactcctttgttgatatactttcctgaactcttcaccaagcagatcaatatcatcctcttttttaaatactccctacgagaaaaatactttgtgggttacttttgaataccagaatatttcactaaatgcttttaagactgacagacataagattagtaaagttatctccaaggtaatgaaatctattcaacagattaatgaaactttaaaaaaatcaatacttttcaaaaaataagactttacatatatattgaatattcctagactgacccaattttctgatttatcagctctagtgtaggagcttttcataggaatctgagctcttctacaagttctactgcttggattacctagataggaaggcacttcatctatactgtaccctacccttttctttaaatagctctataatatgatataatggtgagcttcagtagattcatgcatgggattagttcttcatgcctcagttctatggctaatcagcaaacagtcaatcttgcagaaaagaatccaggtttggagttaagccatttaagcaaaccctttggaattcttcactgttctatttttcttttcccctacagtatactgcaaaaggctctttaaaacaaaattaaatatttacttaaattgcaatctaaagaataaagaattttagggataactgaagtcatttggcaccattaggacctaaaggataaaggtcatttttggatatcaagtttattaatccctcctgctgcctccacaattatttcctctacaaaaatatcaaatcccaaagaaagacattcctacaatttataatttagtttatgaaatgtattaattacatatggattttatcattaatacatcattttgtattccttaatcctttctaaccaattagactatcaagtcctgtggccaggcagtaattacctatatatctttttccttccttagcaccagagtgaatataataaaataaatatgcacttgattctactgaa

SEQ ID NO: 21429 - DNA, 582 bp, Homo sapiens
  ENST00000461628
gtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagagggtgcagagatggcagcggttctgaggcaagagtactgaaatttgctttataatttacttgattatccaagttgtgcatttgaagaaacacatccatgtttccgtagtgcttagtgctatgggtgaaagaaatcttaaagtcaagcagagaagaaaaaaataaaacccacgcatacctcagaaaagcccaattcaactcctaacatcacccaaccaccccatcccagaagaatgaaaccatggagcacaacaggtaatatcagttttcacacctctgcatccccttttaggatgctccgggatatttttccttgtgaatttcagtgaacgattcttttctatattaaacttggtttactacctgagttgcacaggta

SEQ ID NO: 21430 - DNA, 3317 bp, Homo sapiens
  ENST00000379613
tccgagcgcacacgggagctctttcccttctctcctcctcctcgcccttctcctcgccctcctcctcctcctcgccctcctcttcctcctcctcctccttgccctcctcctctccctcctccttctcctcctccacctcctctccctcctcctcctcctcctgcgctcaccgccggcagccagcactttgcgctcacccagagagtagctccacttgggtgcgagaccgagaggggcatatccgttcacgccgatccatgaaaatgctttggaaattgacggataatatcaagtacgaggactgcgaggaccgtcacgacggcaccagcaacgggacggcacggttgccccagctgggcactgtaggtcaatctccctacacgagcgccccgccgctgtcccacacccccaatgccgacttccagcccccatacttccccccaccctaccagcctatctacccccagtcgcaagatccttactcccacgtcaacgacccctacagcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagagggagaagctgtccacctagccagggactttgggtacgtgtgcgaaaccgaatttcctgccaaagcagtagctgaatttctcaaccgacaacattccgatcccaatgagcaagtgacaagaaaaaacatgctcctggctacaaaacagatatgcaaagagttcaccgacctgctggctcaggaccgatctcccctggggaactcacggcccaaccccatcctggagcccggcatccagagctgcttgacccacttcaacctcatctcccacggcttcggcagccccgcggtgtgtgccgcggtcacggccctgcagaactatctcaccgaggccctcaaggccatggacaaaatgtacctcagcaacaaccccaacagccacacggacaacaacgccaaaagcagtgacaaagaggagaagcacagaaagtgaggctctcctcccgccccgcccctcccacgcctcaccagccccccgcgcgcccaccctccggcgggtgacagctccgggatcagcaacccttcctgctgctgctactgctgctgctgctgccgccgccgccgccgccgctgcccttgggtccccccgagtctccgggactgccctctcgactgtcagtggggcagcctctccgactctgcacccgcctcgacctccccacccgctcccacacccctgtgccctcatgtggagcctaagagaacagaacaggccgtgaagccagcagagaaaagttctgccaagtttgtgaacccttttttttttaaacaaaacaacaaatcaacaacagcaacaacaacaacaaaaattaaaaacttttttctaaaaaaaaagtgaaaataaaaaaaattatatgcgcttcatgggactgagtcaccaccttcccttacatacttcagttcagattgtagccatacttaaaaaaaaaaaaaaagccaaaagatgatgacaacatttttatcagtattgtgaataaacttgaacacaaatacacgaagttccatgtcatgtcttcagttgtagaagtttttcctctttaaggtaaagcgaccaacttgaactttctctggcaacacgattcgcagttatataagggaatcagtgttcacgtctctgtatatatttatttatgtgtaatttaatgggaattgtaaatatggtgagtctgttttaagcctttttttttttatttatctgatcttgtttacctcttgtttagtgggttttgaatcttccctattagttcttcatgtggttcatggtactgatttagaaatccagtgtttgggggatttttttctctgggattcatgaatttagccctgttgtagcatgttaaaggtgacaaacagctggacaaatttttaaaaagtaaaataaaattttatctataattagtattattacatttagcttttcattgaaccgaaagaaaaaaagtgatattggaccctggaaagattttgaaacttgagtggtttgataacccttctatgtattgtagggagaaaaaaaaaagtttattttattccactgtcctcccttaaaagcatcatttgagcaataaatgaatattgtctttaaaccaagggttagggaattttcctctctctctctctctcctctctctttctgttcaaagaacttcaaacatttgggaccacctggtattctgtattttcactggccatattggaagcagttctagttgcattgtattgagttgtgctggcagtagtttccatgcctgtcaatgtatcatagtcctttgttgcccagataaataaatatttgatacgctttatgtcgatttttttttattcagtggctgtctttacccaggcgtatttttgttcttggcagtattttttattcagtatggttacagtaattgagtttaactctcccttggcaattgctccttgcaataagcagctgaacccattgtttccctcaagtataataaaaacttactttcaacttggagttcagagcagggtatcatttagatattccactgtgtctgtattcagacaaatgacacaataaaacccaatgtattcttttggataaaagattgtttgtactgctaaaggaatgacatactgtcttttccttactagaaacattaattttattattaaaaataaagttttattttatttatgttga

SEQ ID NO: 21431 - DNA, 2739 bp, Homo sapiens
  ENST00000489805
ccccactccgatttgctacactgagactcccgtcaatggactgcattgagagccggctccggcgcgagttgcctctccgcttcacgctcgatttccaggcattcttcccttattaagtattcgtgtaatattaatagtcatgaatatctgctattaggaggctccaggaacgctgcccagcgcggttattagaagctcaagcgaagccgccgctaagaaaagagggggagacacggattaaggaacacgcacgcacccacacactcacacatactttttcctttttccttttttggggtttttcatttttaaagaactttgaatcataaccagtcgcggcaggatagagaccgtgggttcgaccagctgaaggcgccgcgcgaatcggtggttcaagttcggatggatccgagccgggctcccgcgctccggggagcgtcggcgccgtgactggagtcctgggtggcgcggggctctcggcgccttttgtgtggggcgcgctcgggcggcggggcagccgggcgctccaggcttgcttgtttttttccaccctgactcgttaccccagactcttcgcagatgttagttcacagtttttcagccatggaccgtcacgacggcaccagcaacgggacggcacggttgccccagctgggcactcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagagggagaagctgtccacctagccagggactttgggtacgtgtgcgaaaccgaatttcctgccaaagcagtagctgaatttctcaaccgacaacattccgatcccaatgagcaagtgacaagaaaaaacatgctcctggctacaaaacagatatgcaaagagttcaccgacctgctggctcaggaccgatctcccctggggaactcacggcccaaccccatcctggagcccggcatccagagctgcttgacccacttcaacctcatctcccacggcttcggcagccccgcggtgtgtgccgcggtcacggccctgcagaactatctcaccgaggccctcaaggccatggacaaaatgtacctcagcaacaaccccaacagccacacggacaacaacgccaaaagcagtgacaaagaggagaagcacagaaagtgaggctctcctcccgccccgcccctcccacgcctcaccagccccccgcgcgcccaccctccggcgggtgacagctccgggatcagcaacccttcctgctgctgctactgctgctgctgctgccgccgccgccgccgccgctgcccttgggtccccccgagtctccgggactgccctctcgactgtcagtggggcagcctctccgactctgcacccgcctcgacctccccacccgctcccacacccctgtgccctcatgtggagcctaagagaacagaacaggccgtgaagccagcagagaaaagttctgccaagtttgtgaacccttttttttttaaacaaaacaacaaatcaacaacagcaacaacaacaacaaaaattaaaaacttttttctaaaaaaaaagtgaaaataaaaaaaattatatgcgcttcatgggactgagtcaccaccttcccttacatacttcagttcagattgtagccatacttaaaaaaaaaaaaaaagccaaaagatgatgacaacatttttatcagtattgtgaataaacttgaacacaaatacacgaagttccatgtcatgtcttcagttgtagaagtttttcctctttaaggtaaagcgaccaacttgaactttctctggcaacacgattcgcagttatataagggaatcagtgttcacgtctctgtatatatttatttatgtgtaatttaatgggaattgtaaatatggtgagtctgttttaagcctttttttttttatttatctgatcttgtttacctcttgtttagtgggttttgaatcttccctattagttcttcatgtggttcatggtactgatttagaaatccagtgtttgggggatttttttctctgggattcatgaatttagccctgttgtagcatgttaaaggtgacaaacagctggacaaatttttaaaaagtaaaataaaattttatctataattagtattattacatttagcttttcattgaaccgaaagaaaaaaa

SEQ ID NO: 21432 - DNA, 2035 bp, Homo sapiens
  ENST00000319516
tggcggagtgaattcctgggccagcgcgcatgcgtcggcaggtagcaacccagctctttatgaccaggtgagatgttggtgagcaggtaaaaaaggaggatttgcctaagcgattccagggagctggcccgaccgagccctccagcccatgcccggcggggaccagtcgccaggagcgcagagccgcgatgtccatacttgccaaaatgggggactggcaggaccgtcacgacggcaccagcaacgggacggcacggttgccccagctgggcactgtaggtcaatctccctacacgagcgccccgccgctgtcccacacccccaatgccgacttccagcccccatacttccccccaccctaccagcctatctacccccagtcgcaagatccttactcccacgtcaacgacccctacagcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagagggagaagctgtccacctagccagggactttgggtacgtgtgcgaaaccgaatttcctgccaaagcagtagctgaatttctcaaccgacaacattccgatcccaatgagcaagtgacaagaaaaaacatgctcctggctacaaaacagatatgcaaagagttcaccgacctgctggctcaggaccgatctcccctggggaactcacggcccaaccccatcctggagcccggcatccagagctgcttgacccacttcaacctcatctcccacggcttcggcagccccgcggtgtgtgccgcggtcacggccctgcagaactatctcaccgaggccctcaaggccatggacaaaatgtacctcagcaacaaccccaacagccacacggacaacaacgccaaaagcagtgacaaagaggagaagcacagaaagtgaggctctcctcccgccccgcccctcccacgcctcaccagccccccgcgcgcccaccctccggcgggtgacagctccgggatcagcaacccttcctgctgctgctactgctgctgctgctgccgccgccgccgccgccgctgcccttgggtccccccgagtctccgggactgccctctcgactgtcagtggggcagcctctccgactctgcacccgcctcgacctccccacccgctcccacacccctgtgccctcatgtggagcctaagagaacagaacaggccgtgaagccagcagagaaaagttctgccaagtttgtgaacccttttttttttaaacaaaacaacaaatcaacaacagcaacaacaacaacaaaaattaaaaacttttttctaaaaaaaaagtgaaaataaaaaaaattatatgcgcttcatgggactgagtcaccaccttcccttacatacttcagttcagattgtagccatacttaaaaaaaaaaaaaaagccaaaagatgatgacaacatttttatcagtattgtgaataaa

SEQ ID NO: 21433 - DNA, 2576 bp, Homo sapiens
  ENST00000379608
cacgcacgcagacacattctccctctctgcgctctctccttcggtctccctctctgcctctttctctttcacttttgcatgccctgcaaccttttaaaatgttgccccttccctgtgattcgccagacgccgcgccgcggccccccgcgcgctcgcccgctccctctctcgctcgctttttgtctctcgcgctccctctccccactccgatttgctacactgagactcccgtcaatggactgcattgagagccggctccggcgcgagttgcctctccgcttcacgctcgatttccaggcattcttcccttattaagtattcgtgtaatattaatagtcatgaatatctgctattaggaggctccaggaacgctgcccagcgcggttattagaagctcaagcgaagccgccgctaagaaaagagggggagacacggattaaggaacacgcacgcacccacacactcacacatactttttcctttttccttttttggggtttttcatttttaaagaactttgaatcataaccagtcgcggcaggatagagaccgtgggttcgaccagctgaaggcgccgcgcgaatcggtggttcaagttcggatggatccgagccgggctcccgcgctccggggagcgtcggcgccgtgactggagtcctgggtggcgcggggctctcggcgccttttgtgtggggcgcgctcgggcggcggggcagccgggcgctccaggcttgcttgtttttttccaccctgactcgttaccccagactcttcgcagatgttagttcacagtttttcagccatggaccgtcacgacggcaccagcaacgggacggcacggttgccccagctgggcactgtaggtcaatctccctacacgagcgccccgccgctgtcccacacccccaatgccgacttccagcccccatacttccccccaccctaccagcctatctacccccagtcgcaagatccttactcccacgtcaacgacccctacagcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagagggagaagctgtccacctagccagggactttgggtacgtgtgcgaaaccgaatttcctgccaaagcagtagctgaatttctcaaccgacaacattccgatcccaatgagcaagtgacaagaaaaaacatgctcctggctacaaaacagatatgcaaagagttcaccgacctgctggctcaggaccgatctcccctggggaactcacggcccaaccccatcctggagcccggcatccagagctgcttgacccacttcaacctcatctcccacggcttcggcagccccgcggtgtgtgccgcggtcacggccctgcagaactatctcaccgaggccctcaaggccatggacaaaatgtacctcagcaacaaccccaacagccacacggacaacaacgccaaaagcagtgacaaagaggagaagcacagaaagtgaggctctcctcccgccccgcccctcccacgcctcaccagccccccgcgcgcccaccctccggcgggtgacagctccgggatcagcaacccttcctgctgctgctactgctgctgctgctgccgccgccgccgccgccgctgcccttgggtccccccgagtctccgggactgccctctcgactgtcagtggggcagcctctccgactctgcacccgcctcgacctccccacccgctcccacacccctgtgccctcatgtggagcctaagagaacagaacaggccgtgaagccagcagagaaaagttctgccaagtttgtgaacccttttttttttaaacaaaacaacaaatcaacaacagcaacaacaacaacaaaaattaaaaacttttttctaaaaaaaaagtgaaaataaaaaaaattatatgcgcttcatgggactgagtcaccaccttcccttacatacttcagttcagattgtagccatacttaaaaaaaaaaaaaaa

SEQ ID NO: 21434 - DNA, 1894 bp, Homo sapiens
  ENST00000488193
cgcccttctcctcgccctcctcctcctcctcgccctcctcttcctcctcctcctccttgccctcctcctctccctcctccttctcctcctccacctcctctccctcctcctcctcctcctgcgctcaccgccggcagccagcactttgcgctcacccagagagtagctccacttgggtgcgagaccgagaggggcatatccgttcacgccgatccatgaaaatgctttggaaattgacggataatatcaagtacgaggactgcgaggaccgtcacgacggcaccagcaacgggacggcacggttgccccagctgggcactcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagagggagaagctgtccacctagccagggactttgggtacgtgtgcgaaaccgaatttcctgccaaagcagtagctgaatttctcaaccgacaacattccgatcccaatgagcaagtgacaagaaaaaacatgctcctggctacaaaacagatatgcaaagagttcaccgacctgctggctcaggaccgatctcccctggggaactcacggcccaaccccatcctggagcccggcatccagagctgcttgacccacttcaacctcatctcccacggcttcggcagccccgcggtgtgtgccgcggtcacggccctgcagaactatctcaccgaggccctcaaggccatggacaaaatgtacctcagcaacaaccccaacagccacacggacaacaacgccaaaagcagtgacaaagaggagaagcacagaaagtgaggctctcctcccgccccgcccctcccacgcctcaccagccccccgcgcgcccaccctccggcgggtgacagctccgggatcagcaacccttcctgctgctgctactgctgctgctgctgccgccgccgccgccgccgctgcccttgggtccccccgagtctccgggactgccctctcgactgtcagtggggcagcctctccgactctgcacccgcctcgacctccccacccgctcccacacccctgtgccctcatgtggagcctaagagaacagaacaggccgtgaagccagcagagaaaagttctgccaagtttgtgaacccttttttttttaaacaaaacaacaaatcaacaacagcaacaacaacaacaaaaattaaaaacttttttctaaaaaaaaagtgaaaataaaaaaaattatatgcgcttcatgggactgagtcaccaccttcccttacatacttcagttcagattgtagccatacttaaaaaaaaaaaaaaa

SEQ ID NO: 21435 - DNA, 2071 bp, Homo sapiens
  ENST00000482890
gcagattaacacagctaaaagtcggttcccggtgatttattttgatgcacgcacgagacggtatctagacttgcaggcacacacacgtctgtttttaggctcaacttcagaagcgggtgtgcagttccataggagttctgtattcgtgtccacgttgcacccaggaaaccttagcctgaacaccaatttgaactgtcagttggccctagcttcacacaaacaggagaaaaattgtttaacccctggagctgtcaagtaacctcttcaggccagcactttgcgctcacccagagagtagctccacttgggtgcgagaccgagaggggcatatccgttcacgccgatccatgaaaatgctttggaaattgacggataatatcaagtacgaggactgcgaggaccgtcacgacggcaccagcaacgggacggcacggttgccccagctgggcactgtaggtcaatctccctacacgagcgccccgccgctgtcccacacccccaatgccgacttccagcccccatacttccccccaccctaccagcctatctacccccagtcgcaagatccttactcccacgtcaacgacccctacagcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagagggagaagctgtccacctagccagggactttgggtacgtgtgcgaaaccgaatttcctgccaaagcagtagctgaatttctcaaccgacaacattccgatcccaatgagcaagtgacaagaaaaaacatgctcctggctacaaaacagatatgcaaagagttcaccgacctgctggctcaggaccgatctcccctggggaactcacggcccaaccccatcctggagcccggcatccagagctgcttgacccacttcaacctcatctcccacggcttcggcagccccgcggtgtgtgccgcggtcacggccctgcagaactatctcaccgaggccctcaaggccatggacaaaatgtacctcagcaacaaccccaacagccacacggacaacaacgccaaaagcagtgacaaagaggagaagcacagaaagtgaggctctcctcccgccccgcccctcccacgcctcaccagccccccgcgcgcccaccctccggcgggtgacagctccgggatcagcaacccttcctgctgctgctactgctgctgctgctgccgccgccgccgccgccgctgcccttgggtccccccgagtctccgggactgccctctcgactgtcagtggggcagcctctccgactctgcacccgcctcgacctccccacccgctcccacacccctgtgccctcatgtggagcctaagagaacagaacaggccgtgaagccagcagagaaaagttctgccaagtttgtgaacccttttttttttaaacaaaacaacaaatcaacaacagcaacaacaacaacaaaaattaaaaacttttttctaaaaaaaaagtg

SEQ ID NO: 21436 - DNA, 987 bp, Homo sapiens
  ENST00000466073
atgctttggaaattgacggataatatcaagtacgaggactgcgaggaccgtcacgacggcaccagcaacgggacggcacggttgccccagctgggcactgtaggtcaatctccctacacgagcgccccgccgctgtcccacacccccaatgccgacttccagcccccatacttccccccaccctaccagcctatctacccccagtcgcaagatccttactcccacgtcaacgacccctacagcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagaggacagatatgcaaagagttcaccgacctgctggctcaggaccgatctcccctggggaactcacggcccaaccccatcctggagcccggcatccagagctgcttga

SEQ ID NO: 21437 - DNA, 1014 bp, Homo sapiens
  ENST00000497266
ttaaacccaataaggctgaatctttctattttaaaccttgacttgacgtccccctttccctatccaaaccataaatcgactctgtcgagaaaaaggctcctaacagaggaagcgaaaaagacagaccccgatcctgcagttaaaaccttctttaagctggaccgtcacgacggcaccagcaacgggacggcacggttgccccagctgggcactcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagagggagaagctgtccacctagccagggactttgggtacgtgtgcgaaaccgaatttcctgccaaagcagtagctgaatttctcaaccgacaacattccgatcccaatgagcaagtgacaagaaaaaacatgctcctggctacaaaacagatatgcaaagagtt

SEQ ID NO: 21438 - DNA, 675 bp, Homo sapiens
  ENST00000475264
ggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagagggagaagtggtcatttttcctgataaatgcatccaccagatcctacagagaaggaaataaaatgcctgaaatgagaaaa

SEQ ID NO: 21439 - DNA, 1349 bp, Homo sapiens
  ENST00000478375
atgctttggaaattgacggataatatcaagtacgaggactgcgaggaccgtcacgacggcaccagcaacgggacggcacggttgccccagctgggcactgtaggtcaatctccctacacgagcgccccgccgctgtcccacacccccaatgccgacttccagcccccatacttccccccaccctaccagcctatctacccccagtcgcaagatccttactcccacgtcaacgacccctacagcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagagggtaagcgaatccacttgctaactagaaggaacttccttcttggaaaatggataatatttagtggccagatgtttggtcgtattttatgtcagttgggcagtttcatctttgcagagaatatagccagatgtgaatggaattatttcatggcaaaaagaaacatttgcatgtactcctatacctccatccttcttccttcttttcctctaccataaagttacacctccccagcctaattctgagctaaacaacgcacaagtttaagaactgcacattctccaagtttgtctcctttaaagggctcagcagtaaataacttaagttattctgacatctgcgtttgagaaatgcgtgaccattacttcctgaattaatttgggaatctttgacctgcgtcctgatttaagaccatcctgaaagctcagggttatgtgccctttcaggtctttgttttccaaacatatgc

SEQ ID NO: 21440 - DNA, 417 bp, Homo sapiens
  ENST00000498450
cgccgatccatgaaaatgctttggaaattgacggataatatcaagtacgaggactgcgagcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcaggg

SEQ ID NO: 21441 - DNA, 893 bp, Homo sapiens
  ENST00000490875
gagggcaagaaagcgaaacttggagttcccttaagcacaccgcggcgacgtctacggagtgtaaaaacccatgctctcaggcctagggtttggcctgctcaggctatggccgctgctgggagggtgtcggtgctcctggcagcccagatcctgacttcaaaccactgcactggcgacaggctgggacagccctgcagggtctagccctggaaagtcgaccattttctggacggagggcggcgccaagcctccagcccggttcagccgaggaattgtgctcagttcaggaccgtcacgacggcaccagcaacgggacggcacggttgccccagctgggcactgtaggtcaatctccctacacgagcgccccgccgctgtcccacacccccaatgccgacttccagcccccatacttccccccaccctaccagcctatctacccccagtcgcaagatccttactcccacgtcaacgacccctacagcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgc

SEQ ID NO: 21442 - DNA, 658 bp, Homo sapiens
  ENST00000473652
gtgcggcgctgggactgcagctggcggagtgaattcctgggccagcgcgcatgcgtcggcaggtagcaacccagctctttatgaccaggtgagatgttggtgagcaggtaaaaaaggaggatttgcctaagcgattccagggagctggcccgaccgagccctccagcccatgcccggcggggaccagtcgccaggagcgcagagccgcgatgtccatacttgccaaaatgggggactggcaggaccgtcacgacggcaccagcaacgggacggcacggttgccccagctgggcactcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcg

SEQ ID NO: 21443 - DNA, 1621 bp, Homo sapiens
  ENST00000474952
attaatagtcatgaatatctgctattaggaggctccaggaacgctgcccagcgcggttattagaagctcaagcgaagccgccgctaagaaaagagggggagacacggattaaggaacacgcacgcacccacacactcacacatactttttcctttttccttttttggggtttttcatttttaaagaactttgaatcataaccagtcgcggcaggatagagaccgtgggttcgaccagctgaaggcgccgcgcgaatcggtggttcaagttcggatggatccgagccgggctcccgcgctccggggagcgtcggcgccgtgactggagtcctgggtggcgcggggctctcggcgccttttgtgtggggcgcgctcgggcggcggggcagccgggcgctccaggcttgcttgtttttttccaccctgactcgttaccccagactcttcgcagatgttagttcacagtttttcagccatggaccgtcacgacggcaccagcaacgggacggcacggttgccccagctgggcactgtaggtcaatctccctacacgagcgccccgccgctgtcccacacccccaatgccgacttccagcccccatacttccccccaccctaccagcctatctacccccagtcgcaagatccttactcccacgtcaacgacccctacagcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggtaagccatttccttctgcattccaagcatgtccttacaggcagagtgctatttaaaagaacttgcagagatgtgtttattttttccaaataggatttcctaaaggctcagaattagcaaatagataggcacagaacagcaatgcttaaataatcagccttcagtatgttggtaatgccaacaggctagctttgttctgactcatgatttgaccatttaatttagtttaatgatatttggacaaacacacaaaatgtacagtagttgaactgatttggaagtggcatttcaattttgaaacagtttgatagtttaatccattgcctggatgaaggttaagaagtgtataatgctaaaatagtacaaataatttaacattaatgtaagaacagatgataagaagcactctttagtagaggaaaaaaacattcatgttcttcaatttagtttcttgttagctgtttaagggtcttagaactttgtgaattaggttaacaaaattttagcttttggttaaaattagtatcttgaagatgggaggaatattagcatacttgttcagaggagaaattgttagaaaagtgtcaagtgatttgcatggatttgtaatctgtattgtgtttagtgagtagaaataaagtttactgaattaaatgc

SEQ ID NO: 21444 - DNA, 569 bp, Homo sapiens
  ENST00000462727
cgactctgtcgagaaaaaggctcctaacagaggaagcgaaaaagacagaccccgatcctgcagttaaaaccttctttaagctggaccgtcacgacggcaccagcaacgggacggcacggttgccccagctgggcactgtaggtcaatctccctacacgagcgccccgccgctgtcccacacccccaatgccgacttccagcccccatacttccccccaccctaccagcctatctacccccagtcgcaagatccttactcccacgtcaacgacccctacagcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaa

SEQ ID NO: 21445 - DNA, 1387 bp, Homo sapiens
  ENST00000464323
aggtaaaaaaggaggatttgcctaagcgattccagggagctggcccgaccgagccctccagcccatgcccggcggggaccagtcgccaggagcgcagagccgcgatgtccatacttgccaaaatgggggactggcaggaccgtcacgacggcaccagcaacgggacggcacggttgccccagctgggcactgtaggtcaatctccctacacgagcgccccgccgctgtcccacacccccaatgccgacttccagcccccatacttccccccaccctaccagcctatctacccccagtcgcaagatccttactcccacgtcaacgacccctacagcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccggtaagaggccgcgcaaccagcgcgggagggaacacagccccctacttacctaccccagaaaggatacctggaacatacagtcggtgggcccgggttctccctagtatttccttataaaaacattttattcggaggcggagagtgagggacgttttgaggaaccacacaaagtagttgcgagttctaccccagaacaatggtttctggagctccctcaaacaatgcctgcattaccatttccaccaacacagataaatcagacgaatgtcaccattaacaatatcttcctctcgacgacagtaaactgtctcaattgctaaaagatctacttccatcgctgagtctggcgtggagatttctccctgtcctgggaatgatgttaaatgcaaccaaaagagctcattaaatgtcctcaaaatgtaaaaggaagtgtaaaagacacactaagatcattttaaccggattttataagcacaagtgaaacctaaaagttatgtgtacaccctatcctgattaaagaaaaactaagtagcaaatccaagcagagggacattaaaatgcagccttcttcttactaggggtgctaagtggtgacctcataaatcattagctaggttcccaacgcctatcagaacctgctacactccatattaaattaaatgtttcgagactattgggtaatacattatttgagttctaatttagttatcaataaatgcagtttaaaatgatttctaaataagcatggcattagcacatttactatttacaatgcaaaccaggctattgataatttgaaaatactttctggaatt

SEQ ID NO: 21446 - DNA, 617 bp, Homo sapiens
  ENST00000465858
ggggagcgcacggtgcccctgtccgaggaaagctcaagaggaggccgaggagaggaccagtgcagcgagcgggccggtcccgggcagggcgccgggtcatggaggagccgcgcagcagcgggcagccgagtcccgagtcccagactcggctgcgaagcggcggagcccgcggccagacagggccgggaagcgcctgccgcgccgagagccccacgagcgcccggacgcggtcccaagcagctcctacccgctacgcacgacccccgctgcatcccgaggaccgtcacgacggcaccagcaacgggacggcacggttgccccagctgggcactgtaggtcaatctccctacacgagcgccccgccgctgtcccacacccccaatgccgacttccagcccccatacttccccccaccctaccagcctatctacccccagtcgcaagatccttactcccacgtcaacgacccctacagcctgaaccccctgcacgcccagccgcagccgcagcacccaggctggcccggccagaggcagagccaggagtctgggctcctgcacacgcaccgggggctgcctcaccagctgtcgggcctggatcctcgcagggactacagg

SEQ ID NO: 21447 - DNA, 702 bp, Homo sapiens
  ENST00000486038
ctgggccagcgcgcatgcgtcggcaggtagcaacccagctctttatgaccaggtgagatgttggtgagcaggtaaaaaaggaggatttgcctaagcgattccagggagctggcccgaccgagccctccagcccatgcccggcggggaccagtcgccaggagcgcagagccgcgatgtccatacttgccaaaatgggggactggcaggccgcggacaccacaaggcatccaaggcttggctcctgtccttcctgagccccggattccgaccctggccaaggaagcatttgtccagctctctccttccaacttccagacactttcccttcgggaaacagagcggctctggccaggatggtggcggtaaaaggctctgcctgtcgccgatttcatcatcagaaccgcgaggccctgttttcgccccaaccaagaggcctggtgagggtgagattctgtgtgcccaaaagcccaggggacaattcgaatctaatgccctgaacttccccccaaaaatctgaggccttgctactcctggtcgagttctttctcttgtttcagatttaggccattaaaagtaaagttctgagaagtgcagtcttcactaagctacctggagttggagaaagaaaggccttttgcgttctgtacttttttcccttggatttattacttttatcaagagtgagctcttttatattcttct

SEQ ID NO: 21448 - DNA, 797 bp, Homo sapiens
  ENST00000344788
tttttctctttgctgaggcttacttgtccagcctattgtttgagacaacagatataagttgcgatgggagaggagcgtcggatttggtgtgtatcccccatttccaattatagatggatcattacagacagcggagtcctgagaagccagacatctgctcctcacatgaatgcactcacctcctagagaccaggctgccatcatgctctggaagcttgtggagaatgtcaagtacgaagatatctatgagatgttagtccacacctattcatccatggaccggcacgatggtgtcccgagccacagctcgcggctctcccagctgggctcggtgtcccaaggaccctactcgagcgccccgccgctgtcccacaccccgtcgtcggacttccagccgccctacttcccacccccctaccagccgctcccctaccaccagagccaggacccctactcccacgtcaacgacccctactccctgaacccactgcaccagccccagcaacatccctgggggcaacggcagcggcaagaagtgggttcggaagccggctctctcctgccccagcctcgggccgccttgccccagctctcgggccttgacccccggagggactaccactcggtccgccggccggacgtgctgctgcattcggcgcaccacggcctggacgcgggcatgggtgacagcctctcgctgcacggcctcggccatcccggaatggaagacgtccagtcagttgaagatgccaataacagcggcatgaatctattggaccagtctgtcattaaaaaag

SEQ ID NO: 21449 - DNA, 5773 bp, Homo sapiens
  ENST00000393655
tttttctctttgctgaggcttacttgtccagcctattgtttgagacaacagatataagttgcgatgggagaggagcgtcggatttggtgtgtatcccccatttccaattatagatggatcattacagacagcggagtcctgagaagccagacatctgctcctcacatgaatgcactcacctcctagagaccaggctgccatcatgctctggaagcttgtggagaatgtcaagtacgaagatatctatgaggaccggcacgatggtgtcccgagccacagctcgcggctctcccagctgggctcggtgtcccaaggaccctactcgagcgccccgccgctgtcccacaccccgtcgtcggacttccagccgccctacttcccacccccctaccagccgctcccctaccaccagagccaggacccctactcccacgtcaacgacccctactccctgaacccactgcaccagccccagcaacatccctgggggcaacggcagcggcaagaagtgggttcggaagccggctctctcctgccccagcctcgggccgccttgccccagctctcgggccttgacccccggagggactaccactcggtccgccggccggacgtgctgctgcattcggcgcaccacggcctggacgcgggcatgggtgacagcctctcgctgcacggcctcggccatcccggaatggaagacgtccagtcagttgaagatgccaataacagcggcatgaatctattggaccagtctgtcattaaaaaagttccagttcctcccaaatcggtgacttctctaatgatgaataaagacggcttcctgggaggcatgtctgtcaacaccggcgaggtgttttgctccgtcccaggccgtttgtctctgctcagttcaacttcgaagtacaaagtaactgtgggagaagttcagagacggctgtcgccccctgaatgcctcaatgcatctctcctcggcggagtcctcagaagagccaaatcgaaaaatggggggagatctttgcgagaaaggctagaaaaaatcggtttgaatttacccgcgggcaggcgcaaagcagcaaatgtcacgttactcacctccctggtggaaggagaagctgttcacttagctagggattttgggtacatttgcgaaacggagtttcccgccaaagccgtctctgagtatttgaaccggcagcacacagacccgagtgacctgcactcccgaaagaatatgctgttggccaccaagcaactttgtaaagaatttacggatctactggcgcaggaccggacaccgatagggaacagccgacccagccccatcctggagccggggatccagagctgcctcacgcacttcagcctcatcacgcacggcttcggcgccccggccatttgcgccgcgctcacggccctgcagaactatctcaccgaggcgctcaaaggcatggacaagatgttcttgaacaacaccaccactaacaggcacacgtctggggaaggcccaggtagtaaaactggcgacaaggaggagaaacacaggaaatgaaaaatttttaaaaaaagaaggaaaaatgttttaaatacaaaaggaaaaacagacaaaaatttaattttagctttaaaatattggattggctttggaagaattatattaggtagaatacacatacaatcaaaattttaaaaaaaaaagctaaataacttaaaaaaaaactgaggcgtacaacggagcaacaatatcggttctcagtgtctatttcaagatacatttggagacaaccgtccggattttccacttcggttctttcgagtttagtaatactgataataaaagaaaaccatgatttccccttccctttggaaaataaacataagactaaacatgagaaaaacgctaacttattggaagaaaatcggagaaacgttggtgtcaatgctttgagagctggttgactgagacgcacgaactttttaattttaaatatatttttaggaaactctcgcagtccccgccctccatctcacctcacccgtctcccaaccacccttttccatgttaccctcccttcctcacattgttacgggaatcttctgggatgaaaatgagtgtggttggcccttttgcgttgtttcagtcctctcggtacctccccgcccagccctgcgatcttaactcaccgggcccggctccccggccgcttgcataattagggagggcgagggcggggcgggaggcctgtggagaccaggcggaggctgcaatttttggtgccggccggcagagcaggttctggcggctgaggaaaatccggaccaataagttgattcaaacatcatcagttcctttcagaaatgttactagctcccagccttgccagcatctgcatagagagaatctcacatttattatatttgtgtcatctactaattttatgaactatagtaaaaaaaaaaaaacacacacacacacaatatgaatacgttgattagtatgtaattccttcggaggggtatgtaccatttcattctcttctgttttccaaagctttgcccgcatggtttatgagcttcttcaaagaggacttgggcttcctacacaatctataaggtacagagaaaaaaaaatccgatccctttttaatcaaagcctgtgtgtcagaattctgcaggtgcacttctttaaagaagctcaaagggaataatttagaaagtggccaatatgatggaagcagctttgaatctacatgctaacattcctcaacactccaattccggtggaggtggcaggggagggggtctgcaaaatgaattttaagggaaaagagtaaggattcttagagccctatattctaatagtattgccctgcatttaaaattgatttgatttccctgggttctttggtgattgctgtttaagcaaggaaagaagcagctttacgagtggacgtggggaggagggcggcacaagcacccacatttctgtaacaattgctttcttacaagatgctttatgaatgaggcatttttccctcccagacgtgcacttgttttggcatataatggcaaaataatgcaaagtgaagggagatgtatttcagctttgatttttaccgtctggatacatcgggactattcccagtggataaagtttcatgcatttaatatttctcacttctggcagcccagctcctttcttgggctccatcttagcattatcatgaaataagatctggaatccattgtctgcacctccgcaaaagcagtgagaaattatcccgggataagggtgaatgagagaggtctctaaatatagtgttgatacactcacctatttaacaaagtagacgagatctttgcaataccccttaaagataacgacatagatgttgttctgcaggatttatagttaggacccactcaattctccaggactcccggttttgcccccctcccgctttgccttggtgggggtggggattgggggagtggggattgcgttggggttttaggaatctgctgagagctttgcccatttttattaaaagaggaaagggaagttaggaagctcgtctcaggtcaccaaaagggcccaagcaactgttagggccacactgcagcccatctccaacccctagcttcgtttagcacttctgatcttcatggcccagccctagaactgttgagaggaatgcaatggccaagagctagacgttacggagagtgtagtcactctcttttcccagctcagaggcctgcgccttcgtccgagagctcggccgatcgcattagatgtgttctgattgcacaaggccaggagagaccacactgaaaacgatcgtctcctttccttgcagggcaacgcgccccacgcgtgtgacgtgcgagagacgcgatggacgcgccttgctcttactgtgcaggtcctgagagcgtgtgggccacaggcgcccagtcgtgttgaggacatagaatcagccgctggaggggctgccgactgcgcgggcccttcccgctctcggtctcaccctaagggctaaggcgaccgagaaagccccattctccagtaggtaatggggcggcgcccggtgggctgcaggtggggagggctcccagcgccgccagcggccacccggggcgccggctcctggagggagagtggcctagaaatatccaaggaatccgaagcttcccctcctccacctctgccagtacggaaacaccccaccgtcacaatcctaaagcggggagatgggatgggaattgtcttacttggcaaggcagggtaccttcattgccagacgccctcatttgtgtgttcctccttgctccagcgagatagaaccttttgcgcccccaaccccgtttcgtggagtgagcccactaccccttctccctccctcacttctcctttcatgtaggacccccgcccccttgctttccttagccaggcccgctacatttatctgataattgagttattaaaagatttggtttccttgggcctataaatcaataaacagtaggattaacgcaatagtttgccttttaagtcaagggagacgtttaaggcaagcccctttgagctttgttttcaaaccaaacaggtgagttgcagctctccccccggcccctgcactcttcagacatttggtccctgcccactcctaaacgctcagtcccaaaacaaaatagcgaaagacaggaggagtcaggatgtggcagtgctgccttcacactttccacttcgcaagttcttttaaaggttccaaagatctccagaccattctctgccaaaccctgccgcctcctgcacgtattgcaggtctctggggagcaagaaatgtcctgtttgggtgaggattccgtcacctaaaaagatctttaacttctcccccaaagtgggaaggtaactttctcccccttttccccaccaccttcactcctacacccccaattaccttgcattttctttccttccttctggcctccacacccatagctttcctccatccccacttaaagaaccgaagaggcttttaaagacctggctgctttgttttccttggccaaggaagccactttctctcaagcaattatttcatatcctacgaaaactttggtcgaatggaaaactcgaaacctcgagcttatctacacactgttcctctgctacaatgctttcctagttaagagtgtttatagagaatttgtcatcacatctgatatcctgtacttgtaatacattatgtggaaaggaaataaccttaaaccgtctgatgttgcctcaagagcccaaacggcgtttccccacctttgacgatgtatgtgaaattactggcttaaaaaaaaaagtatcaatttttttttaacggaatgaacactatccttctttaaatgccaaaatcgactccacctttgagttggtctctaattctctaacattgtttttgccacacaatcaagaaatatcaatctattgactcttcacgagaagagctctggagggtattcatgttaagtttgtatatatttatttatgcttaatttaatgggaatgtgtaaatatggcgagcaagtagtttgggattatttatctgtgaatctatacctctgtgaatgggtggttaaaaaacctcttgaccctagatagaatcctatctgaatttttctgttctttataaacaagctgttatggtaatgggtagaaattggtttattgtccagtgttaatctgatttacataaataaaaagattgttgtgttttca

SEQ ID NO: 21450 - DNA, 835 bp, Homo sapiens
  ENST00000489228
aattattatgaggcggtgtaggcaagcggagggaggaaggggcggccgagcagtctgagcccagcttcgggtgaaagaggactgcatctggagccccgaagaacggcagaagaaaagaggccaaaaagacagcaaagagacagatgaatagttctgtctgtgtgtgacaggcatcgccaatcttgttggggtggggggcgggtgtaattttttttttttttttttgatggcttgtcctggaaacacatcaagctcagctcctgtgtccagctcgcttctctgctggactccttgattttttttttaatcattgtttgattttgagcagtaaccaggcttttttttccagatgttagtccacacctattcatccatggaccggcacgatggtgtcccgagccacagctcgcggctctcccagctgggctcggtgtcccaaggaccctactcgagcgccccgccgctgtcccacaccccgtcgtcggacttccagccgccctacttcccacccccctaccagccgctcccctaccaccagagccaggacccctactcccacgtcaacgacccctactccctgaacccactgcaccagccccagcaacatccctgggggcaacggcagcggcaagaagtgggttcggaagccggctctctcctgccccagcctcgggccgccttgccccagctctcgggccttgacccccggagggactaccactcggtccgccggccggacgtgctgctgcattcggcgcaccacggcctggacgcgggcatgggtgacagcctctcgctgcacggcctcggccatcccggaatggaagacgtccag

SEQ ID NO: 21451 - DNA, 354 bp, Homo sapiens
  ENST00000426789
gcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagaaggtccacagatgatgctccttctcacggatgcgaggccatcaaatcactttttgtctccgctgctctctctccat

SEQ ID NO: 21452 - DNA, 4814 bp, Homo sapiens
  ENST00000420415
cctcagagcgtcgggatatcgggtggcggctcgggacggaggacgcgctagtgttcttctgtgtggcagttcagaatgatggatcaagctagatcagcattctctaacttggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccggcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatcgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacactga

SEQ ID NO: 21453 - DNA, 5111 bp, Homo sapiens
  ENST00000360110
ctcgcgagcgtacgtgcctcaggaagtgacgcacagcccccctgggggccgggggcggggccaggctataaaccgccggttaggggccgccatcccctcagagcgtcgggatatcgggtggcggctcgggacggaggacgcgctagtgttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccggcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatcgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacactga

SEQ ID NO: 21454 - DNA, 5032 bp, Homo sapiens
  ENST00000392396
agagcgtcgggatatcgggtggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccggcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatcgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggata

SEQ ID NO: 21455 - DNA, 549 bp, Homo sapiens
  ENST00000463047
agggcatatgatacgatagaacagggattctgtagaacctggaagaaagtagtcactctaggagtaggttagcttgagagaagtagcaagaatgtacttaaagcagcagataatgagatagaattggggtaaattgcggtaggaatatgttagaagcaagggtggaactgtcgtcactgttacctcgatggcgaagccagaatgtgaggctcttgctcttagaactcacgtgagtaccatagcctcgcgttgtcttgcaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagac

SEQ ID NO: 21456 - DNA, 875 bp, Homo sapiens
  ENST00000475593
ctttcctcaggtaaagctaacttttttctctttcagatgggtttcagcccagcagaagcattatctttgccagttggagtgctggagactttggatcggttggtgccactgaatggctagaggtattctttatcatcccttcccatattggacacgagcttgtgggcttaggctgttgtccagaagtgatgtttttataggtttgattttaccacttttgcctttgcgtttagtctcagtagagtccagaattgaaaatgaatccctaatgctactgtatgtgataaataaacagatttatacttattagtgttttcccttctcttctagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttctt

SEQ ID NO: 21457 - DNA, 757 bp, Homo sapiens
  ENST00000483983
agatggtctcgatctcctgaccttgtgatccacccgtctgggcctcccaaagtcctgggattacaggcgtgagccaccgtgcccggcctaactgctctgatatttttaaaaaaggtgacttggattaaagtatgcaaactcaaggagtagtacgagcccacttgagtgaagttagcttagttgctaaagagcttgataccaaaattacttttgtttacttgatgaatgggatagttgttgcacagggccactgatctagattactgtcttatttgtcaagtacttatagttgtagaagtagcagtgtgaaaattatcggaatggagaaggggcaatgataaaacaatttattttcaggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgag

SEQ ID NO: 21458 - DNA, 533 bp, Homo sapiens
  ENST00000463356
aggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggtaagtctgttcatttaaatgacaaatggagagaggctctctaaaaggaagtgatctgtatttgggaatagggcattgcaatgggaatgcctgtgctatagtcaactatgtacatattcagaggagtaaaggaaaacaagtttttaaggacaaatgacgaggattacaaaattactttgaggtaattattcttggctaccaagatcaataacaaggatgacaccagtccaaggttgacaggcagttgctaggcagattttctcacgagagaagttttttggtgcaaggttgcagtggcctttgtgtaaggttgtagtttttg

SEQ ID NO: 21459 - DNA, 540 bp, Homo sapiens
  ENST00000482479
ctgggctcaagtgatcctcccagctcggcctcccaaagtgttgggattgcagttgtgaactaccccacccggcctaggcccacttttaaaatgttaattaagaagaaaacattttttcctcaccataactaaaggaactgacaacatgagcctagttagtaataacttaaagttgagattgttttaactatcataaataatttcttttcaagaagatataatacaagttttttatttaaaaattgttatagagtaacatgttagtgactagcctgaataaataagttccaaaaggttagttttaatgataatttcttatcttacaggtgaagcatccggttactgggcaatttctatatcaggacagcaactgggccagcaaagttgagaaactcactttagacaatgctgctttccctttccttgcatattctggaatcccagcagtttctttctgtttttgcgaggtaagtctgttcatttaaatgacaaatggagagaggctctctaaaaggaagtgatctgtatttgggaataggg

SEQ ID NO: 21460 - DNA, 560 bp, Homo sapiens
  ENST00000465288
aaatatagtttctctgcaaactcttcttgtaacttaaatttgtgaatttttattttattttagaattatttttttaaaaatccaatgtttggatttacctctgaagatttttctcaagatgtgcatcatcatgcttacactgttttcaatgatctctgggtccagaagttaaggaactccaagaatgaaattgtgaaaggatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgagg

SEQ ID NO: 21461 - DNA, 570 bp, Homo sapiens
  ENST00000477148
cttatttgcagatctcctatcttgctctttgtaggttactttaaaaaaaattattcctattcttttattcttttacctggggtctcaaaaaaagattttgttagttttttttttcttttttggctcagaaaaaaaagattttggaatctgctatcttggaattagaccttctgattcatcttaagtgggataccttccatccttgtctgtgtataacctttcctcaggtaaagctaacttttttctctttcagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttcctt

SEQ ID NO: 21462 - DNA, 569 bp, Homo sapiens
  ENST00000464368
ggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaagtatccctttcattagctgtgtatgaattcaggtaaacttttttgagatggagttttgctcttgtcgcccaggctggagtgcaatggcacgatctcggctcactgcaacctctgtctcccagattcaagcgattctcctgccttagcctcctgagtagctgggattacaggtgctcactaccacacc

SEQ ID NO: 21463 - DNA, 396 bp, Homo sapiens
  ENST00000491658
taggccttggcctccttttatctcttacttgggttgcctgtcttaggtttgatctataacactcttctgtctcaagattttagagctgttccgataccataatgctcattaaatctaatgtctttgttctagggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaat

SEQ ID NO: 21464 - DNA, 524 bp, Homo sapiens
  ENST00000421258
cccctcagagcgtcgggatatcgggtggcggctcgggacggaggacgcgctagtgttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggaga

SEQ ID NO: 21465 - DNA, 546 bp, Homo sapiens
  ENST00000464011
agagcgtcgggatatcgggtggcggctcgggacggaggacgcgctagtgttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggaagcaaatgctacgctagaaaatatccgcaggacactggcggtgcagcagctcagtctcatgtttcaagggggtcttttggaaaaaactacctatgttttgaataggtagctatttgaaataaagctagtatataatttattaagtggtttaaagtatacaaaactgagatgcattatatactttaaaactacttagaatttgatgaaaaccagtattttcaaggcttacctgaaa

SEQ ID NO: 21466 - DNA, 745 bp, Homo sapiens
  ENST00000523901
aagcagtggtttctcctccttcctcccaggaagggccaggaaaatggccctggtcctggagatcttcaccctgctggcctccatctgctgggtgtcggccaatatcttcgagtaccaggtggatgcccagccccttcgtccctgtgagctgcagagggaaacggcctttctgaagcaagcagactacgtgccccagtgtgcagaggatggcagcttccagtaaggcttatgtcagcagcgaactctcaaggactgtccagtgccagaacgacggccgctcctgctggtgtgtgggtgccaacggcagtgaagtgctgggcagcaggcagccaggacggcctgtggcttgtctgtcattttgtcagctacagaaacagcagatcttactgagtggctacattaacagcacagacacctcctacctccctcagtgtcaggattcaggggactacgcgcctgttcagtgtgatgtgcagcaggtccagtgctggtgtgtggacgcagaggggatggaggtgtatgggacccgccagctggggaggccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttcctt

SEQ ID NO: 21467 - DNA, 8450 bp, Homo sapiens
  ENST00000220616
cagtggtttctcctccttcctcccaggaagggccaggaaaatggccctggtcctggagatcttcaccctgctggcctccatctgctgggtgtcggccaatatcttcgagtaccaggtggatgcccagccccttcgtccctgtgagctgcagagggaaacggcctttctgaagcaagcagactacgtgccccagtgtgcagaggatggcagcttccagactgtccagtgccagaacgacggccgctcctgctggtgtgtgggtgccaacggcagtgaagtgctgggcagcaggcagccaggacggcctgtggcttgtctgtcattttgtcagctacagaaacagcagatcttactgagtggctacattaacagcacagacacctcctacctccctcagtgtcaggattcaggggactacgcgcctgttcagtgtgatgtgcagcaggtccagtgctggtgtgtggacgcagaggggatggaggtgtatgggacccgccagctggggaggccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttatgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtg

SEQ ID NO: 21468 - DNA, 669 bp, Homo sapiens
  ENST00000520769
tgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtggtgggtttcctctgggggcttcctctttcggcctcggatcatattactttggcggtcctccagaccaacctctctggaccccattaattcaactgccttctagtgtgcccctctggcccttcaagctcaacctgtctgagaaccagtttatcatcattaacttccaacatgtttctcatcttgtgtcagacctcgttgcattttcagggagctcagggaatattaggaggctcatagatga

SEQ ID NO: 21469 - DNA, 5065 bp, Homo sapiens
  ENST00000523756
ctcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttatgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtg

SEQ ID NO: 21470 - DNA, 334 bp, Homo sapiens
  ENST00000518097
acagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaagtaagggtctggaagcacaggattggagccgggacttgtccccgctggtcagagatgatttttctttttgttcaatacgttcagcttagt

SEQ ID NO: 21471 - DNA, 678 bp, Homo sapiens
  ENST00000518505
ttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaac

SEQ ID NO: 21472 - DNA, 3706 bp, Homo sapiens
  ENST00000519178
ccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttatgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccga

SEQ ID NO: 21473 - DNA, 185 bp, Homo sapiens
  ENST00000518058
attctgacatggggtctcggcctgagtctatgggatgtagaaaagacacagtgccaaggccagcatctccaacagaagcaggttgtgtgcaggagcactctttctgtcagctcgcagagataacagagagtgcatccttgtacttcacctgcaccctctacccagaggcacaggtgtgtgatgac

SEQ ID NO: 21474 - DNA, 3132 bp, Homo sapiens
  ENST00000519543
attgcttttaaggagggcacatagttttaagagaaataggaaatggcttaatctaatacggcacgtaaaccaggtataagatgaagtggctacagtattcattctttcatccaaccagacatttttgagcacatgtggctgtggccttggacattcacaggctagtgagaattccatgtgccagccactgcatgacagtgtggcaagggatgcaatgtggacaggtgtcggttgcagtgagaatgcaggagaaggaatgctagcagcctgcaggggccaggaaaggtttctcggaggaggccagaaggatctgccagatgctcccaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccatgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttatgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtgaagcat

SEQ ID NO: 21475 - DNA, 676 bp, Homo sapiens
  ENST00000520197
ttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagattcacatgtacctggccaaacgaacaactccatgttttccaaaaggcttggagaacataccaggtacctctcctctttccctttgtgtttgtcattttggcgaattactggaagatggtggttccagctgaaaggctttttggcaatttttaacagctgaaaataaaccttgaaataaacattttctcctttaactgatgtctgggaaggaagaaacaaaaaaagaaagagaagaaaggaaataaggaaggagggagggagagagtgaaggaggga

SEQ ID NO: 21476 - DNA, 712 bp, Homo sapiens
  ENST00000520089
ttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaaggtaagttcattgtctttttatctcttggatgagagtaccccctcattcatcttctttctcctcttcccccttgcttttgtacagaagttgatagcttgcatatcactcgcattaattccagctcctatgaattaaacacatgtataagtggggtgagtaccagcaacatgcccactttgcagatgagaaaattgactcacgggaatgaaatgatttgtggaaattatgtggctgattgaagcagagtaagacctaagtcgcgttctcccagttttcattttaaggattatttcgccctatcgagtaatgactagacacacacaatccggaggcaatgtcaa

SEQ ID NO: 21477 - DNA, 620 bp, Homo sapiens
  ENST00000519294
cccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtttaaagtccgggaggtgagagggacccagctgaagaggatggagtgagggcttccgtataactggagtacctggtgtcatgggaagattcacatgtacctggccaaacgaacaactccatgttttccaaaaggcttggagaacataccaggtacctctcctctttccctttgtgtttgtcattttggcgaattactggaagatggtggttccagctgaaaggctttttggcaatttttaacagctgaaaataaaccttgaaataaacattttctcctttaactgatgtctgggaaggaagaaacaaaaaaagaaagagaagaaaggaaataaggaaggagggagggagagagtgaaggaggga

SEQ ID NO: 21478 - DNA, 743 bp, Homo sapiens
  ENST00000524151
tctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagggatcatgaaggtttgctgggggcctgaaagacttttcctgcctgaaaggtttcagaatgtcacggtttaccccagccagcctgtgcaggtgtggaaaccgcctcttctatttcccagctattccatattcaggagcaatcacttgatgagtgctgagcagctgaaagaaattcctcttggttttgattgcgggaagaagggtgaggatcctgaagacttttggatgccttggactcactgtttatttttgatgagtcctaagaaagtcatgtgatctttttatacaataaatgggatgggtctgtgattatttgaacgttggagagagtgtcaggcatttgctgccggtttgacattctgcccttggatctgatacaaaaatgcttggaggcactttccgcctgtttttcaaatgagggaggcaatggccagagcagaagctcacctgtcattacctgccagcaagcggcagacctctgcctgtggggtgcatgcagctctatagtgatgtg

SEQ ID NO: 21479 - DNA, 813 bp, Homo sapiens
  ENST00000522523
ctgtttcctcctcatctgtatatagggctaccaaagctaccttcctcgtaaggttatgtgaggaccaagtgaagtgataccaacagagacctagcacagccctaagcacatgttaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactg

SEQ ID NO: 21480 - DNA, 481 bp, Homo sapiens
  ENST00000522797
gggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtttaaagtccgggaggtgagagggacccagctgaagaggatggagtgagggcttccgtataactggagtacctggtgtcatgggaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactc

SEQ ID NO: 21481 - DNA, 581 bp, Homo sapiens
  ENST00000518108
acattcagaatgccagtggagagagcactcactgaggcctctccccttcctcacccctttctcttccctttcccaacaggaatctctctgctcagctatgaggcatctgtaccttctgtgcccatttccacccatggccggctgctgggcaggtcccaggccatccagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacgg

SEQ ID NO: 21482 - DNA, 829 bp, Homo sapiens
  ENST00000522996
taatgcagcttgctagttaaggagccccccaggaggtgctggtgggagatggttctatctttgcagagttctcttcccagaggactttgccacaatctccgatcctcttaaagaaccatcagccctttgcctctatatacaaattcatctgcacagccaagactgaaggttcccttgtgcagcaccctcacttcacaggttaggaaactgaggcctagagagacatcttcagtatcacactgcatgctgatatgctgttgaccaatccttatcttcccattgtgtgcagccccagaatgggtcctgggactcccaagcttggaggaaggatgcagaaccctgatgtggcactgaggactccaggtgagcaggggctgaagatgatctgaaccatctgccctgagcctgctttctcttccagggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttatgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggc

SEQ ID NO: 21483 - DNA, 465 bp, Homo sapiens
  ENST00000522809
cctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttatgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccggtaagctaagctgcaggagggtgcagattcctactgctatgttttggagcagactcagttggtgt

SEQ ID NO: 21484 - DNA, 616 bp, Homo sapiens
  ENST00000521107
tcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacat

SEQ ID NO: 21485 - DNA, 476 bp, Homo sapiens
  ENST00000522691
cgagtgcaagtgggaagtgattcaggtgatgaaaggaaagacaaatttccctcatggatatttctttcttctcatttgcccagaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaa

SEQ ID NO: 21486 - DNA, 4969 bp, Homo sapiens
  ENST00000366930
gcccctcccgtcagttcgccagctgccagccccgggaccttttcatctcttcccttttggccggaggagccgagttcagatccgccactccgcacccgagactgacacactgaactccacttcctcctcttaaatttatttctacttaatagccactcgtctctttttttccccatctcattgctccaagaatttttttcttcttactcgccaaagtcagggttccctctgcccgtcccgtattaatatttccacttttggaactactggccttttctttttaaaggaattcaagcaggatacgtttttctgttgggcattgactagattgtttgcaaaagtttcgcatcaaaaacaacaacaacaaaaaaccaaacaactctccttgatctatactttgagaattgttgatttcttttttttattctgacttttaaaaacaacttttttttccacttttttaaaaaatgcactactgtgtgctgagcgcttttctgatcctgcatctggtcacggtcgcgctcagcctgtctacctgcagcacactcgatatggaccagttcatgcgcaagaggatcgaggcgatccgcgggcagatcctgagcaagctgaagctcaccagtcccccagaagactatcctgagcccgaggaagtccccccggaggtgatttccatctacaacagcaccagggacttgctccaggagaaggcgagccggagggcggccgcctgcgagcgcgagaggagcgacgaagagtactacgccaaggaggtttacaaaatagacatgccgcccttcttcccctccgaaaatgccatcccgcccactttctacagaccctacttcagaattgttcgatttgacgtctcagcaatggagaagaatgcttccaatttggtgaaagcagagttcagagtctttcgtttgcagaacccaaaagccagagtgcctgaacaacggattgagctatatcagattctcaagtccaaagatttaacatctccaacccagcgctacatcgacagcaaagttgtgaaaacaagagcagaaggcgaatggctctccttcgatgtaactgatgctgttcatgaatggcttcaccataaagacaggaacctgggatttaaaataagcttacactgtccctgctgcacttttgtaccatctaataattacatcatcccaaataaaagtgaagaactagaagcaagatttgcaggtattgatggcacctccacatataccagtggtgatcagaaaactataaagtccactaggaaaaaaaacagtgggaagaccccacatctcctgctaatgttattgccctcctacagacttgagtcacaacagaccaaccggcggaagaagcgtgctttggatgcggcctattgctttagaaatgtgcaggataattgctgcctacgtccactttacattgatttcaagagggatctagggtggaaatggatacacgaacccaaagggtacaatgccaacttctgtgctggagcatgcccgtatttatggagttcagacactcagcacagcagggtcctgagcttatataataccataaatccagaagcatctgcttctccttgctgcgtgtcccaagatttagaacctctaaccattctctactacattggcaaaacacccaagattgaacagctttctaatatgattgtaaagtcttgcaaatgcagctaaaattcttggaaaagtggcaagaccaaaatgacaatgatgatgataatgatgatgacgacgacaacgatgatgcttgtaacaagaaaacataagagagccttggttcatcagtgttaaaaaatttttgaaaaggcggtactagttcagacactttggaagtttgtgttctgtttgttaaaactggcatctgacacaaaaaaagttgaaggccttattctacatttcacctactttgtaagtgagagagacaagaagcaaattttttttaaagaaaaaaataaacactggaagaatttattagtgttaattatgtgaacaacgacaacaacaacaacaacaacaaacaggaaaatcccattaagtggagttgctgtacgtaccgttcctatcccgcgcctcacttgatttttctgtattgctatgcaataggcacccttcccattcttactcttagagttaacagtgagttatttattgtgtgttactatataatgaacgtttcattgcccttggaaaataaaacaggtgtataaagtggagaccaaatactttgccagaaactcatggatggcttaaggaacttgaactcaaacgagccagaaaaaaagaggtcatattaatgggatgaaaacccaagtgagttattatatgaccgagaaagtctgcattaagataaagaccctgaaaacacatgttatgtatcagctgcctaaggaagcttcttgtaaggtccaaaaactaaaaagactgttaataaaagaaactttcagtcagaataagtctgtaagtttttttttttctttttaattgtaaatggttctttgtcagtttagtaaaccagtgaaatgttgaaatgttttgacatgtactggtcaaacttcagaccttaaaatattgctgtatagctatgctataggttttttcctttgttttggtatatgtaaccatacctatattattaaaatagatggatatagaagccagcataattgaaaacacatctgcagatctcttttgcaaactattaaatcaaaacattaactactttatgtgtaatgtgtaaatttttaccatattttttatattctgtaataatgtcaactatgatttagattgacttaaatttgggctctttttaatgatcactcacaaatgtatgtttcttttagctggccagtacttttgagtaaagcccctatagtttgacttgcactacaaatgcattttttttttaataacatttgccctacttgtgctttgtgtttctttcattattatgacataagctacctgggtccacttgtcttttcttttttttgtttcacagaaaagatgggttcgagttcagtggtcttcatcttccaagcatcattactaaccaagtcagacgttaacaaatttttatgttaggaaaaggaggaatgttatagatacatagaaaattgaagtaaaatgttttcattttagcaaggatttagggttctaactaaaactcagaatctttattgagttaagaaaagtttctctaccttggtttaatcaatatttttgtaaaatcctattgttattacaaagaggacacttcataggaaacatctttttctttagtcaggtttttaatattcagggggaaattgaaagatatatattttagtcgatttttcaaaaggggaaaaaagtccaggtcagcataagtcattttgtgtatttcactgaagttataaggtttttataaatgttctttgaaggggaaaaggcacaagccaatttttcctatgatcaaaaaattctttctttcctctgagtgagagttatctatatctgaggctaaagtttaccttgctttaataaataatttgccacatcattgcagaagaggtatcctcatgctggggttaatagaatatgtcagtttatcacttgtcgcttatttagctttaaaataaaaattaataggcaaagcaatggaatatttgcagtttcacctaaagagcagcataaggaggcgggaatccaaagtgaagttgtttgatatggtctacttcttttttggaatttcctgaccattaattaaagaattggatttgcaagtttgaaaactggaaaagcaagagatgggatgccataatagtaaacagcccttgtgttggatgtaacccaatcccagatttgagtgtgtgttgattatttttttgtcttccacttttctattatgtgtaaatcacttttatttctgcagacattttcctctcagataggatgacattttgttttgtattattttgtctttcctcatgaatgcactgataatattttaaatgctctattttaagatctcttgaatctgttttttttttttttaatttgggggttctgtaaggtctttatttcccataagtaaatattgccatgggaggggggtggaggtggcaaggaaggggtgaagtgctagtatgcaagtgggcagcaattatttttgtgttaatcagcagtacaatttgatcgttggcatggttaaaaaatggaatataagattagctgttttgtattttgatgaccaattacgctgtattttaacacgatgtatgtctgtttttgtggtgctctagtggtaaataaattatttcgatgatatgtggatgtctttttcctatcagtaccatcatcgagtctagaaaacacctgtgatgcaataagactatctcaagctggaaaagtcataccacctttccgattgccctctgtgctttctcccttaaggacagtcacttcagaagtcatgctttaaagcacaagagtcaggccatatccatcaaggatagaagaaatccctgtgccgtctttttattcccttatttattgctatttggtaattgtttgagatttagtttccatccagcttgactgccgaccagaaaaaatgcagagagatgtttgcaccatgctttggctttctggttctatgttctgccaacgccagggccaaaagaactggtctagacagtatcccctgtagccccataacttggatagttgctgagccagccagatataacaagagccacgtgctttctggggttggttgtttgggatcagctacttgcctgtcagtttcactggtaccactgcaccacaaacaaaaaaacccaccctatttcctccaatttttttggctgctacctacaagaccagactcctcaaacgagttgccaatctcttaataaataggattaataaaaaaagtaattgtgactcaa

SEQ ID NO: 21487 - DNA, 5053 bp, Homo sapiens
  ENST00000366929
gcccctcccgtcagttcgccagctgccagccccgggaccttttcatctcttcccttttggccggaggagccgagttcagatccgccactccgcacccgagactgacacactgaactccacttcctcctcttaaatttatttctacttaatagccactcgtctctttttttccccatctcattgctccaagaatttttttcttcttactcgccaaagtcagggttccctctgcccgtcccgtattaatatttccacttttggaactactggccttttctttttaaaggaattcaagcaggatacgtttttctgttgggcattgactagattgtttgcaaaagtttcgcatcaaaaacaacaacaacaaaaaaccaaacaactctccttgatctatactttgagaattgttgatttcttttttttattctgacttttaaaaacaacttttttttccacttttttaaaaaatgcactactgtgtgctgagcgcttttctgatcctgcatctggtcacggtcgcgctcagcctgtctacctgcagcacactcgatatggaccagttcatgcgcaagaggatcgaggcgatccgcgggcagatcctgagcaagctgaagctcaccagtcccccagaagactatcctgagcccgaggaagtccccccggaggtgatttccatctacaacagcaccagggacttgctccaggagaaggcgagccggagggcggccgcctgcgagcgcgagaggagcgacgaagagtactacgccaaggaggtttacaaaatagacatgccgcccttcttcccctccgaaactgtctgcccagttgttacaacaccctctggctcagtgggcagcttgtgctccagacagtcccaggtgctctgtgggtaccttgatgccatcccgcccactttctacagaccctacttcagaattgttcgatttgacgtctcagcaatggagaagaatgcttccaatttggtgaaagcagagttcagagtctttcgtttgcagaacccaaaagccagagtgcctgaacaacggattgagctatatcagattctcaagtccaaagatttaacatctccaacccagcgctacatcgacagcaaagttgtgaaaacaagagcagaaggcgaatggctctccttcgatgtaactgatgctgttcatgaatggcttcaccataaagacaggaacctgggatttaaaataagcttacactgtccctgctgcacttttgtaccatctaataattacatcatcccaaataaaagtgaagaactagaagcaagatttgcaggtattgatggcacctccacatataccagtggtgatcagaaaactataaagtccactaggaaaaaaaacagtgggaagaccccacatctcctgctaatgttattgccctcctacagacttgagtcacaacagaccaaccggcggaagaagcgtgctttggatgcggcctattgctttagaaatgtgcaggataattgctgcctacgtccactttacattgatttcaagagggatctagggtggaaatggatacacgaacccaaagggtacaatgccaacttctgtgctggagcatgcccgtatttatggagttcagacactcagcacagcagggtcctgagcttatataataccataaatccagaagcatctgcttctccttgctgcgtgtcccaagatttagaacctctaaccattctctactacattggcaaaacacccaagattgaacagctttctaatatgattgtaaagtcttgcaaatgcagctaaaattcttggaaaagtggcaagaccaaaatgacaatgatgatgataatgatgatgacgacgacaacgatgatgcttgtaacaagaaaacataagagagccttggttcatcagtgttaaaaaatttttgaaaaggcggtactagttcagacactttggaagtttgtgttctgtttgttaaaactggcatctgacacaaaaaaagttgaaggccttattctacatttcacctactttgtaagtgagagagacaagaagcaaattttttttaaagaaaaaaataaacactggaagaatttattagtgttaattatgtgaacaacgacaacaacaacaacaacaacaaacaggaaaatcccattaagtggagttgctgtacgtaccgttcctatcccgcgcctcacttgatttttctgtattgctatgcaataggcacccttcccattcttactcttagagttaacagtgagttatttattgtgtgttactatataatgaacgtttcattgcccttggaaaataaaacaggtgtataaagtggagaccaaatactttgccagaaactcatggatggcttaaggaacttgaactcaaacgagccagaaaaaaagaggtcatattaatgggatgaaaacccaagtgagttattatatgaccgagaaagtctgcattaagataaagaccctgaaaacacatgttatgtatcagctgcctaaggaagcttcttgtaaggtccaaaaactaaaaagactgttaataaaagaaactttcagtcagaataagtctgtaagtttttttttttctttttaattgtaaatggttctttgtcagtttagtaaaccagtgaaatgttgaaatgttttgacatgtactggtcaaacttcagaccttaaaatattgctgtatagctatgctataggttttttcctttgttttggtatatgtaaccatacctatattattaaaatagatggatatagaagccagcataattgaaaacacatctgcagatctcttttgcaaactattaaatcaaaacattaactactttatgtgtaatgtgtaaatttttaccatattttttatattctgtaataatgtcaactatgatttagattgacttaaatttgggctctttttaatgatcactcacaaatgtatgtttcttttagctggccagtacttttgagtaaagcccctatagtttgacttgcactacaaatgcattttttttttaataacatttgccctacttgtgctttgtgtttctttcattattatgacataagctacctgggtccacttgtcttttcttttttttgtttcacagaaaagatgggttcgagttcagtggtcttcatcttccaagcatcattactaaccaagtcagacgttaacaaatttttatgttaggaaaaggaggaatgttatagatacatagaaaattgaagtaaaatgttttcattttagcaaggatttagggttctaactaaaactcagaatctttattgagttaagaaaagtttctctaccttggtttaatcaatatttttgtaaaatcctattgttattacaaagaggacacttcataggaaacatctttttctttagtcaggtttttaatattcagggggaaattgaaagatatatattttagtcgatttttcaaaaggggaaaaaagtccaggtcagcataagtcattttgtgtatttcactgaagttataaggtttttataaatgttctttgaaggggaaaaggcacaagccaatttttcctatgatcaaaaaattctttctttcctctgagtgagagttatctatatctgaggctaaagtttaccttgctttaataaataatttgccacatcattgcagaagaggtatcctcatgctggggttaatagaatatgtcagtttatcacttgtcgcttatttagctttaaaataaaaattaataggcaaagcaatggaatatttgcagtttcacctaaagagcagcataaggaggcgggaatccaaagtgaagttgtttgatatggtctacttcttttttggaatttcctgaccattaattaaagaattggatttgcaagtttgaaaactggaaaagcaagagatgggatgccataatagtaaacagcccttgtgttggatgtaacccaatcccagatttgagtgtgtgttgattatttttttgtcttccacttttctattatgtgtaaatcacttttatttctgcagacattttcctctcagataggatgacattttgttttgtattattttgtctttcctcatgaatgcactgataatattttaaatgctctattttaagatctcttgaatctgttttttttttttttaatttgggggttctgtaaggtctttatttcccataagtaaatattgccatgggaggggggtggaggtggcaaggaaggggtgaagtgctagtatgcaagtgggcagcaattatttttgtgttaatcagcagtacaatttgatcgttggcatggttaaaaaatggaatataagattagctgttttgtattttgatgaccaattacgctgtattttaacacgatgtatgtctgtttttgtggtgctctagtggtaaataaattatttcgatgatatgtggatgtctttttcctatcagtaccatcatcgagtctagaaaacacctgtgatgcaataagactatctcaagctggaaaagtcataccacctttccgattgccctctgtgctttctcccttaaggacagtcacttcagaagtcatgctttaaagcacaagagtcaggccatatccatcaaggatagaagaaatccctgtgccgtctttttattcccttatttattgctatttggtaattgtttgagatttagtttccatccagcttgactgccgaccagaaaaaatgcagagagatgtttgcaccatgctttggctttctggttctatgttctgccaacgccagggccaaaagaactggtctagacagtatcccctgtagccccataacttggatagttgctgagccagccagatataacaagagccacgtgctttctggggttggttgtttgggatcagctacttgcctgtcagtttcactggtaccactgcaccacaaacaaaaaaacccaccctatttcctccaatttttttggctgctacctacaagaccagactcctcaaacgagttgccaatctcttaataaataggattaataaaaaaagtaattgtgactcaa

SEQ ID NO: 21488 - DNA, 405 bp, Homo sapiens
  ENST00000488793
ccctccgaaaatgccatcccgcccactttctacagaccctacttcagaattgttcgatttgacgtctcagcaatggagaagaatgcttccaatttggtgaaagcagagttcagagtctttcgtttgcagaacccaaaagccagagtgcctgaacaacggattgagctatatcagattctcaagtccaaagatttaacatctccaacccagcgctacatcgacagcaaagttgtgaaaacaagagcagaaggcgaatggctctccttcgatgtaactgatgctgttcatgaatggcttcaccataaaggttacaagccactctctcttttcctcccaagatgttcagtatccctaagttactttaaattgattgcagatttaagggtatagacacacatacaaatg

SEQ ID NO: 21489 - DNA, 1508 bp, Homo sapiens
  ENST00000479322
cgacagcaaagttgtgaaaacaagagcagaaggcgaatggctctccttcgatgtaactgatgctgttcatgaatggcttcaccataaaggttacaagccactctctcttttcctcccaagatgttcaacaggaacctgggatttaaaataagcttacactgtccctgctgcacttttgtaccatctaataattacatcatcccaaataaaagtgaagaactagaagcaagatttgcaggtattgatggcacctccacatataccagtggtgatcagaaaactataaagtccactaggaaaaaaaacagtgggaagaccccacatctcctgctaatgttattgccctcctacagacttgagtcacaacagaccaaccggcggaagaagcgtgctttggatgcggcctattgctttagaaatgtgcaggataattgctgcctacgtccactttacattgatttcaagagggatctagggtggaaatggatacacgaacccaaagggtacaatgccaacttctgtgctggagcatgcccgtatttatggagttcagacactcagcacagcagggtcctgagcttatataataccataaatccagaagcatctgcttctccttgctgcgtgtcccaagatttagaacctctaaccattctctactacattggcaaaacacccaagattgaacagctttctaatatgattgtaaagtcttgcaaatgcagctaaaattcttggaaaagtggcaagaccaaaatgacaatgatgatgataatgatgatgacgacgacaacgatgatgcttgtaacaagaaaacataagagagccttggttcatcagtgttaaaaaatttttgaaaaggcggtactagttcagacactttggaagtttgtgttctgtttgttaaaactggcatctgacacaaaaaaagttgaaggccttattctacatttcacctactttgtaagtgagagagacaagaagcaaattttttttaaagaaaaaaataaacactggaagaatttattagtgttaattatgtgaacaacgacaacaacaacaacaacaacaaacaggaaaatcccattaagtggagttgctgtacgtaccgttcctatcccgcgcctcacttgatttttctgtattgctatgcaataggcacccttcccattcttactcttagagttaacagtgagttatttattgtgtgttactatataatgaacgtttcattgcccttggaaaataaaacaggtgtataaagtggagaccaaatactttgccagaaactcatggatggcttaaggaacttgaactcaaacgagccagaaaaaaagaggtcatattaatgggatgaaaacccaagtgagttattatatgaccgagaaagtctgcattaagataaagaccctgaaaacacatgttatgtatcagctgcctaaggaagcttcttgtaaggtccaaaaactaaaaagactgttaataaaagaaactttcagtcagaataa

SEQ ID NO: 21490 - DNA, 210 bp, Homo sapiens
  ENST00000556507
catacctccgcagtgcagacacaacccacagcacgctcattgtttctgcatcctgtctggggccctgcacgctgcacttactaaatggctcaaggcaatgttttgtgagaacatttctcaccgaagtgatcagttccagctaggaagagcaatgtgctgggactgtacaacactctgaaccctgaagcatctgcctcgccttgctgcgtg

SEQ ID NO: 21491 - DNA, 608 bp, Homo sapiens
  ENST00000557493
agaataagggatgtgctaagcaaaggcaacagggaggcccaggccctcaagtggaaataagcttgatttgttctagcagcagcagcaaacagatcggtgtggctggagcatgagtccaacttaggtctagaaatcagcattcactgtccatgtcacacctttcagcccaatggagatatcctggaaaacattcacgaggtgatggaaatcaaattcaaaggcgtggacaatgaggatgaccatggccgtggagatctggggcgcctcaagaagcagaaggatcaccacaaccctcatctaatcctcatgatgattcccccacaccggctcgacaacccgggccaggggggtcagaggaagaagcgggctttggacaccaattactgcttccgcaacttggaggagaactgctgtgtgcgccccctctacattgacttccgacaggatctgggctggaagtgggtccatgaacctaagggctactatgccaacttctgctcaggcccttgcccatacctccgcagtgcagacacaacccacagcacggtatggagcaggctcatgccatctgaggcactggggctgaccgaccagaccacttgttaaaa

SEQ ID NO: 21492 - DNA, 1280 bp, Homo sapiens
  ENST00000556285
ggggaggccgcctggttttcctccctccttctgcacgtctgctggggtctcttcctctccaggccttgccgtccccctggcctctcttcccagctcacacatgaagatgcacttgcaaagggctctggtggtcctggccctgctgaactttgccacggtcagcctctctctgtccacttgcaccaccttggacttcggccacatcaagaagaagagggtggaagccattaggggacagatcttgagcaagctcaggctcaccagcccccctgagccaacggtgatgacccacgtcccctatcaggtcctggccctttacaacagcacccgggagctgctggaggagatgcatggggagagggaggaaggctgcacccaggaaaacaccgagtcggaatactatgccaaagaaatccataaattcgacatgatccaggggctggcggagcacaacgaactggctgtctgccctaaaggaattacctccaaggttttccgcttcaatgtgtcctcagtggagaaaaatagaaccaacctattccgagcagaattccgggtcttgcgggtgcccaaccccagctctaagcggaatgagcagaggatcgagctcttccagatccttcggccagatgagcacattgccaaacagcgctatatcggtggcaagaatctgcccacacggggcactgccgagtggctgtcctttgatgtcactgacactgtgcgtgagtggctgttgagaagagagtccaacttaggtctagaaatcagcattcactgtccatgtcacacctttcagcccaatggagatatcctggaaaacattcacgaggtgatggaaatcaaattcaaaggcgtggacaatgaggatgaccatggccgtggagatctggggcgcctcaagaagcagaaggatcaccacaaccctcatctaatcctcatgatgattcccccacaccggctcgacaacccgggccaggggggtcagaggaagaagcgggctttggacaccaattactgcttccggtgagactgggcccacatgggaaccaacatctactgcctgcctactgcccaatggctaggtcaggccccagagccaagccacactcaacagagggtccctgatgctattcacaaacatctccaggaagaagactgaaaatctctcacagagattttctctgtgaaatctctttctgttttcctgggagtcccactgtttttccataggctaactctggaaggagctggctgaagtaaatgaggaaaactctgtg

SEQ ID NO: 21493 - DNA, 549 bp, Homo sapiens
  ENST00000555193
atttctgcgagagcggctccggagcggcggtcggggagggagagggttgccagcgcttcctggaagtcctgaagctctcgcagtgcagtgagttcatgcaccttcttgccaagcctcagtctttgggatctggggaggccgcctggttttcctccctccttctgcacgtctgctggggtctcttcctctccaggccttgccgtccccctggcctctcttcccagctcacacatgaagatgcacttgcaaagggctctggtggtcctggccctgctgaactttgccacggtcagcctctctctgtccacttgcaccaccttggacttcggccacatcaagaagaagagggtggaagccattaggggacagatcttgagcaagctcaggctcaccagcccccctgagccaacggtgatgacccacgtcccctatcaggtcctggccctttacaacagcacccgggagctgctggaggagatgcatggggagagggaggaaggctgcacccaggaaaacaccgagtcggaatactatgccaaagaaatccat

SEQ ID NO: 21494 - DNA, 716 bp, Homo sapiens
  ENST00000556674
ctagaggttcgggccgagaagaggagcgaaagcacagagccgacttcccctcacccatctgggaaatgggctcgggccaactgctgacttcgcgctcgctggcgcagctccctgcggagacctcggcggggagggaggctgaacatctggatgacatttctgcgagagcggctccggagcggcggtcggggagggagagagaagcaggggacagaagcaatggccgaggcagaagacaagccgaggtgctggtgaccctgggcgtctgagtggatgattggggctgctgcgctcagaggcctgcctccctgccttccaatgcatataaccccacaccccagccaatgaagacgagaggcagcgtgaacaaagtcatttagaaagcccccgaggaagtgtaaacaaaagagaaagcatgaatggagtgcctgagagacaagtgtgtcctgtactgcccccacctttagctgggccagcaactgcccggccctgcttctccccacctactcactggtgatctttttttttttacttttttttcccttttcttttccattctcttttcttattttctttcaaggcaaggcaaggattttgattttgggacccagccatggtccttctgcttcttctttaaaatacccactttctccccatcgccaagcggcgtttggcaatatcagatatccactctatttatttttacctaaggaaaa

SEQ ID NO: 21495 - DNA, 2522 bp, Homo sapiens
  ENST00000238682
tgcttgccctccacctggcctgctgggagtcagagcccagcaaaacctgtttagacacatggacaagaatcccagcgctacaaggcacacagtccgcttcttcgtcctcagggttgccagcgcttcctggaagtcctgaagctctcgcagtgcagtgagttcatgcaccttcttgccaagcctcagtctttgggatctggggaggccgcctggttttcctccctccttctgcacgtctgctggggtctcttcctctccaggccttgccgtccccctggcctctcttcccagctcacacatgaagatgcacttgcaaagggctctggtggtcctggccctgctgaactttgccacggtcagcctctctctgtccacttgcaccaccttggacttcggccacatcaagaagaagagggtggaagccattaggggacagatcttgagcaagctcaggctcaccagcccccctgagccaacggtgatgacccacgtcccctatcaggtcctggccctttacaacagcacccgggagctgctggaggagatgcatggggagagggaggaaggctgcacccaggaaaacaccgagtcggaatactatgccaaagaaatccataaattcgacatgatccaggggctggcggagcacaacgaactggctgtctgccctaaaggaattacctccaaggttttccgcttcaatgtgtcctcagtggagaaaaatagaaccaacctattccgagcagaattccgggtcttgcgggtgcccaaccccagctctaagcggaatgagcagaggatcgagctcttccagatccttcggccagatgagcacattgccaaacagcgctatatcggtggcaagaatctgcccacacggggcactgccgagtggctgtcctttgatgtcactgacactgtgcgtgagtggctgttgagaagagagtccaacttaggtctagaaatcagcattcactgtccatgtcacacctttcagcccaatggagatatcctggaaaacattcacgaggtgatggaaatcaaattcaaaggcgtggacaatgaggatgaccatggccgtggagatctggggcgcctcaagaagcagaaggatcaccacaaccctcatctaatcctcatgatgattcccccacaccggctcgacaacccgggccaggggggtcagaggaagaagcgggctttggacaccaattactgcttccgcaacttggaggagaactgctgtgtgcgccccctctacattgacttccgacaggatctgggctggaagtgggtccatgaacctaagggctactatgccaacttctgctcaggcccttgcccatacctccgcagtgcagacacaacccacagcacggtgctgggactgtacaacactctgaaccctgaagcatctgcctcgccttgctgcgtgccccaggacctggagcccctgaccatcctgtactatgttgggaggacccccaaagtggagcagctctccaacatggtggtgaagtcttgtaaatgtagctgagaccccacgtgcgacagagagaggggagagagaaccaccactgcctgactgcccgctcctcgggaaacacacaagcaacaaacctcactgagaggcctggagcccacaaccttcggctccgggcaaatggctgagatggaggtttccttttggaacatttctttcttgctggctctgagaatcacggtggtaaagaaagtgtgggtttggttagaggaaggctgaactcttcagaacacacagactttctgtgacgcagacagaggggatggggatagaggaaagggatggtaagttgagatgttgtgtggcaatgggatttgggctaccctaaagggagaaggaagggcagagaatggctgggtcagggccagactggaagacacttcagatctgaggttggatttgctcattgctgtaccacatctgctctagggaatctggattatgttatacaaggcaagcattttttttttttttttaaagacaggttacgaagacaaagtcccagaattgtatctcatactgtctgggattaagggcaaatctattacttttgcaaactgtcctctacatcaattaacatcgtgggtcactacagggagaaaatccaggtcatgcagttcctggcccatcaactgtattgggccttttggatatgctgaacgcagaagaaagggtggaaatcaaccctctcctgtctgccctctgggtccctcctctcacctctccctcgatcatatttccccttggacacttggttagacgccttccaggtcaggatgcacatttctggattgtggttccatgcagccttggggcattatgggttcttcccccacttcccctccaagaccctgtgttcatttggtgttcctggaagcaggtgctacaacatgtgaggcattcggggaagctgcacatgtgccacacagtgacttggccccagacgcatagactgaggtataaagacaagtatgaatat

SEQ ID NO: 21496 - DNA, 2708 bp, Homo sapiens
  ENST00000554980
catgtgatcccacaactactaggcgaatgggctggagttgcccttcacgcaccagaatgtcaggcaccaaaccctggcacctccaggcttcatcatgctcactgtctccgtgctcaagtcatctggaccctcagccatagttctctatcatctcctctgtgctgttttctaagttcacaactgtcttcccaagctgttcatcttggtgagcaatccacattccaacttcccatcatggtgaacaaggattcccaaagaagaaatgtccaagtaatttttacctcgttgtgtccttgttccttaggaaaaatatggcccagtgtaaccgtgatcttcatcttatctcttctagaatctgccactttgtctaggcccacagtcatggccctggtagaaatgcttgcatcttccactgagacggattctgcttcctgtttgcaagtgaccttgcctctagcattggttcctgacttgaatctttttgccagcattacatcctgtggctttttgaatttgtggccttttgaatcacagtctctgtgctcggagactctttagttactccctgtccgtagtctcttccagtccctctgcctcttgccctgatccttctgcagtagattggctcaacgatcccctctcccaaaaaccatgtagatggcatgagtttttgctttccttactgtatctgtgtacttttgcctccaagtaggtaggtgacaattttctcttaataccatcctttcaaagggaatgattattccacttctgtttcatgatggccactagtgtatgcccccatttggtgattcataatacaacaggaatacctggaatgtggcaacgtgcgcttgaaggtccactctgagctctggaggcactttctgtctcctgtgaccctcaatagaactcagttcctatgagtccctataggagcagaggccctggctcacccttgcatgggtggtgggcacacttccccatcacacagaggtgcttttctcactaattctgtcttattttgcagagtccaacttaggtctagaaatcagcattcactgtccatgtcacacctttcagcccaatggagatatcctggaaaacattcacgaggtgatggaaatcaaattcaaaggcgtggacaatgaggatgaccatggccgtggagatctggggcgcctcaagaagcagaaggatcaccacaaccctcatctaatcctcatgatgattcccccacaccggctcgacaacccgggccaggggggtcagaggaagaagcgggctttggacaccaattactgcttccgcaacttggaggagaactgctgtgtgcgccccctctacattgacttccgacaggatctgggctggaagtgggtccatgaacctaagggctactatgccaacttctgctcaggcccttgcccatacctccgcagtgcagacacaacccacagcacggtgctgggactgtacaacactctgaaccctgaagcatctgcctcgccttgctgcgtgccccaggacctggagcccctgaccatcctgtactatgttgggaggacccccaaagtggagcagctctccaacatggtggtgaagtcttgtaaatgtagctgagaccccacgtgcgacagagagaggggagagagaaccaccactgcctgactgcccgctcctcgggaaacacacaagcaacaaacctcactgagaggcctggagcccacaaccttcggctccgggcaaatggctgagatggaggtttccttttggaacatttctttcttgctggctctgagaatcacggtggtaaagaaagtgtgggtttggttagaggaaggctgaactcttcagaacacacagactttctgtgacgcagacagaggggatggggatagaggaaagggatggtaagttgagatgttgtgtggcaatgggatttgggctaccctaaagggagaaggaagggcagagaatggctgggtcagggccagactggaagacacttcagatctgaggttggatttgctcattgctgtaccacatctgctctagggaatctggattatgttatacaaggcaagcattttttttttttttttaaagacaggttacgaagacaaagtcccagaattgtatctcatactgtctgggattaagggcaaatctattacttttgcaaactgtcctctacatcaattaacatcgtgggtcactacagggagaaaatccaggtcatgcagttcctggcccatcaactgtattgggccttttggatatgctgaacgcagaagaaagggtggaaatcaaccctctcctgtctgccctctgggtccctcctctcacctctccctcgatcatatttccccttggacacttggttagacgccttccaggtcaggatgcacatttctggattgtggttccatgcagccttggggcattatgggttcttcccccacttcccctccaagaccctgtgttcatttggtgttcctggaagcaggtgctacaacatgtgaggcattcggggaagctgcacatgtgccacacagtgacttggccccagacgcatagactgaggtataaagacaagtatgaatattactctcaaaatctttgtataaataaatatttttggggcatcctggatgatttcatcttctggaatattgtttctagaacagtaaaagccttattctaaggtg

SEQ ID NO: 21497 - DNA, 4621 bp, Homo sapiens
  ENST00000295754
ggagagggagaaggctctcgggcggagagaggtcctgcccagctgttggcgaggagtttcctgtttcccccgcagcgctgagttgaagttgagtgagtcactcgcgcgcacggagcgacgacacccccgcgcgtgcacccgctcgggacaggagccggactcctgtgcagcttccctcggccgccgggggcctccccgcgcctcgccggcctccaggccccctcctggctggcgagcgggcgccacatctggcccgcacatctgcgctgccggcccggcgcggggtccggagagggcgcggcgcggaggcgcagccaggggtccgggaaggcgccgtccgctgcgctgggggctcggtctatgacgagcagcggggtctgccatgggtcgggggctgctcaggggcctgtggccgctgcacatcgtcctgtggacgcgtatcgccagcacgatcccaccgcacgttcagaagtcggttaataacgacatgatagtcactgacaacaacggtgcagtcaagtttccacaactgtgtaaattttgtgatgtgagattttccacctgtgacaaccagaaatcctgcatgagcaactgcagcatcacctccatctgtgagaagccacaggaagtctgtgtggctgtatggagaaagaatgacgagaacataacactagagacagtttgccatgaccccaagctcccctaccatgactttattctggaagatgctgcttctccaaagtgcattatgaaggaaaaaaaaaagcctggtgagactttcttcatgtgttcctgtagctctgatgagtgcaatgacaacatcatcttctcagaagaatataacaccagcaatcctgacttgttgctagtcatatttcaagtgacaggcatcagcctcctgccaccactgggagttgccatatctgtcatcatcatcttctactgctaccgcgttaaccggcagcagaagctgagttcaacctgggaaaccggcaagacgcggaagctcatggagttcagcgagcactgtgccatcatcctggaagatgaccgctctgacatcagctccacgtgtgccaacaacatcaaccacaacacagagctgctgcccattgagctggacaccctggtggggaaaggtcgctttgctgaggtctataaggccaagctgaagcagaacacttcagagcagtttgagacagtggcagtcaagatctttccctatgaggagtatgcctcttggaagacagagaaggacatcttctcagacatcaatctgaagcatgagaacatactccagttcctgacggctgaggagcggaagacggagttggggaaacaatactggctgatcaccgccttccacgccaagggcaacctacaggagtacctgacgcggcatgtcatcagctgggaggacctgcgcaagctgggcagctccctcgcccgggggattgctcacctccacagtgatcacactccatgtgggaggcccaagatgcccatcgtgcacagggacctcaagagctccaatatcctcgtgaagaacgacctaacctgctgcctgtgtgactttgggctttccctgcgtctggaccctactctgtctgtggatgacctggctaacagtgggcaggtgggaactgcaagatacatggctccagaagtcctagaatccaggatgaatttggagaatgttgagtccttcaagcagaccgatgtctactccatggctctggtgctctgggaaatgacatctcgctgtaatgcagtgggagaagtaaaagattatgagcctccatttggttccaaggtgcgggagcacccctgtgtcgaaagcatgaaggacaacgtgttgagagatcgagggcgaccagaaattcccagcttctggctcaaccaccagggcatccagatggtgtgtgagacgttgactgagtgctgggaccacgacccagaggcccgtctcacagcccagtgtgtggcagaacgcttcagtgagctggagcatctggacaggctctcggggaggagctgctcggaggagaagattcctgaagacggctccctaaacactaccaaatagctcttctggggcaggctgggccatgtccaaagaggctgcccctctcaccaaagaacagaggcagcaggaagctgcccctgaactgatgcttcctggaaaaccaagggggtcactcccctccctgtaagctgtggggataagcagaaacaacagcagcagggagtgggtgacatagagcattctatgcctttgacattgtcataggataagctgtgttagcacttcctcaggaaatgagattgatttttacaatagccaataacatttgcactttattaatgcctgtatataaatatgaatagctatgttttatatatatatatatatatctatatatgtctatagctctatatatatagccataccttgaaaagagacaaggaaaaacatcaaatattcccaggaaattggttttattggagaactccagaaccaagcagagaaggaagggacccatgacagcattagcatttgacaatcacacatgcagtggttctctgactgtaaaacagtgaactttgcatgaggaaagaggctccatgtctcacagccagctatgaccacattgcacttgcttttgcaaaataatcattccctgcctagcacttctcttctggccatggaactaagtacagtggcactgtttgaggaccagtgttcccggggttcctgtgtgcccttatttctcctggacttttcatttaagctccaagccccaaatctggggggctagtttagaaactctccctcaacctagtttagaaactctaccccatctttaataccttgaatgttttgaaccccactttttaccttcatgggttgcagaaaaatcagaacagatgtccccatccatgcgattgccccaccatctactaatgaaaaattgttctttttttcatctttcccctgcacttatgttactattctctgctcccagccttcatccttttctaaaaaggagcaaattctcactctaggctttatcgtgtttactttttcattacacttgacttgattttctagttttctatacaaacaccaatgggttccatctttctgggctcctgattgctcaagcacagtttggcctgatgaagaggatttcaactacacaatactatcattgtcaggactatgacctcaggcactctaaacatatgttttgtttggtcagcacagcgtttcaaaaagtgaagccactttataaatatttggagattttgcaggaaaatctggatccccaggtaaggatagcagatggttttcagttatctccagtccacgttcacaaaatgtgaaggtgtggagacacttacaaagctgcctcacttctcactgtaaacattagctctttccactgcctacctggaccccagtctaggaattaaatctgcacctaaccaaggtcccttgtaagaaatgtccattcaagcagtcattctctgggtatataatatgattttgactaccttatctggtgttaagatttgaagttggccttttattggactaaaggggaactcctttaagggtctcagttagcccaagtttcttttgcttatatgttaatagttttaccctctgcattggagagaggagtgctttactccaagaagctttcctcatggttaccgttctctccatcatgccagccttctcaacctttgcagaaattactagagaggatttgaatgtgggacacaaaggtcccatttgcagttagaaaatttgtgtccacaaggacaagaacaaagtatgagctttaaaactccataggaaacttgttaatcaacaaagaagtgttaatgctgcaagtaatctcttttttaaaactttttgaagctacttattttcagccaaataggaatattagagagggactggtagtgagaatatcagctctgtttggatggtggaaggtctcattttattgagatttttaagatacatgcaaaggtttggaaatagaacctctaggcaccctcctcagtgtgggtgggctgagagttaaagacagtgtggctgcagtagcatagaggcgcctagaaattccacttgcaccgtagggcatgctgataccatcccaatagctgttgcccattgacctctagtggtgagtttctagaatactggtccattcatgagatattcaagattcaagagtattctcacttctgggttatcagcataaactggaatgtagtgtcagaggatactgtggcttgttttgtttatgtttttttttcttattcaagaaaaaagaccaaggaataacattctgtagttcctaaaaatactgacttttttcactactatacataaagggaaagttttattcttttatggaacacttcagctgtactcatgtattaaaataggaatgtgaatgctatatactctttttatatcaaaagtctcaagcacttatttttattctatgcattgtttgtcttttacataaataaaatgtttattagattgaataaagcaaaatactcaggtgagcatcctgcctcctgttcccattcctag

SEQ ID NO: 21498 - DNA, 4605 bp, Homo sapiens
  ENST00000359013
actcgcgcgcacggagcgacgacacccccgcgcgtgcacccgctcgggacaggagccggactcctgtgcagcttccctcggccgccgggggcctccccgcgcctcgccggcctccaggccccctcctggctggcgagcgggcgccacatctggcccgcacatctgcgctgccggcccggcgcggggtccggagagggcgcggcgcggaggcgcagccaggggtccgggaaggcgccgtccgctgcgctgggggctcggtctatgacgagcagcggggtctgccatgggtcgggggctgctcaggggcctgtggccgctgcacatcgtcctgtggacgcgtatcgccagcacgatcccaccgcacgttcagaagtcggatgtggaaatggaggcccagaaagatgaaatcatctgccccagctgtaataggactgcccatccactgagacatattaataacgacatgatagtcactgacaacaacggtgcagtcaagtttccacaactgtgtaaattttgtgatgtgagattttccacctgtgacaaccagaaatcctgcatgagcaactgcagcatcacctccatctgtgagaagccacaggaagtctgtgtggctgtatggagaaagaatgacgagaacataacactagagacagtttgccatgaccccaagctcccctaccatgactttattctggaagatgctgcttctccaaagtgcattatgaaggaaaaaaaaaagcctggtgagactttcttcatgtgttcctgtagctctgatgagtgcaatgacaacatcatcttctcagaagaatataacaccagcaatcctgacttgttgctagtcatatttcaagtgacaggcatcagcctcctgccaccactgggagttgccatatctgtcatcatcatcttctactgctaccgcgttaaccggcagcagaagctgagttcaacctgggaaaccggcaagacgcggaagctcatggagttcagcgagcactgtgccatcatcctggaagatgaccgctctgacatcagctccacgtgtgccaacaacatcaaccacaacacagagctgctgcccattgagctggacaccctggtggggaaaggtcgctttgctgaggtctataaggccaagctgaagcagaacacttcagagcagtttgagacagtggcagtcaagatctttccctatgaggagtatgcctcttggaagacagagaaggacatcttctcagacatcaatctgaagcatgagaacatactccagttcctgacggctgaggagcggaagacggagttggggaaacaatactggctgatcaccgccttccacgccaagggcaacctacaggagtacctgacgcggcatgtcatcagctgggaggacctgcgcaagctgggcagctccctcgcccgggggattgctcacctccacagtgatcacactccatgtgggaggcccaagatgcccatcgtgcacagggacctcaagagctccaatatcctcgtgaagaacgacctaacctgctgcctgtgtgactttgggctttccctgcgtctggaccctactctgtctgtggatgacctggctaacagtgggcaggtgggaactgcaagatacatggctccagaagtcctagaatccaggatgaatttggagaatgttgagtccttcaagcagaccgatgtctactccatggctctggtgctctgggaaatgacatctcgctgtaatgcagtgggagaagtaaaagattatgagcctccatttggttccaaggtgcgggagcacccctgtgtcgaaagcatgaaggacaacgtgttgagagatcgagggcgaccagaaattcccagcttctggctcaaccaccagggcatccagatggtgtgtgagacgttgactgagtgctgggaccacgacccagaggcccgtctcacagcccagtgtgtggcagaacgcttcagtgagctggagcatctggacaggctctcggggaggagctgctcggaggagaagattcctgaagacggctccctaaacactaccaaatagctcttctggggcaggctgggccatgtccaaagaggctgcccctctcaccaaagaacagaggcagcaggaagctgcccctgaactgatgcttcctggaaaaccaagggggtcactcccctccctgtaagctgtggggataagcagaaacaacagcagcagggagtgggtgacatagagcattctatgcctttgacattgtcataggataagctgtgttagcacttcctcaggaaatgagattgatttttacaatagccaataacatttgcactttattaatgcctgtatataaatatgaatagctatgttttatatatatatatatatatctatatatgtctatagctctatatatatagccataccttgaaaagagacaaggaaaaacatcaaatattcccaggaaattggttttattggagaactccagaaccaagcagagaaggaagggacccatgacagcattagcatttgacaatcacacatgcagtggttctctgactgtaaaacagtgaactttgcatgaggaaagaggctccatgtctcacagccagctatgaccacattgcacttgcttttgcaaaataatcattccctgcctagcacttctcttctggccatggaactaagtacagtggcactgtttgaggaccagtgttcccggggttcctgtgtgcccttatttctcctggacttttcatttaagctccaagccccaaatctggggggctagtttagaaactctccctcaacctagtttagaaactctaccccatctttaataccttgaatgttttgaaccccactttttaccttcatgggttgcagaaaaatcagaacagatgtccccatccatgcgattgccccaccatctactaatgaaaaattgttctttttttcatctttcccctgcacttatgttactattctctgctcccagccttcatccttttctaaaaaggagcaaattctcactctaggctttatcgtgtttactttttcattacacttgacttgattttctagttttctatacaaacaccaatgggttccatctttctgggctcctgattgctcaagcacagtttggcctgatgaagaggatttcaactacacaatactatcattgtcaggactatgacctcaggcactctaaacatatgttttgtttggtcagcacagcgtttcaaaaagtgaagccactttataaatatttggagattttgcaggaaaatctggatccccaggtaaggatagcagatggttttcagttatctccagtccacgttcacaaaatgtgaaggtgtggagacacttacaaagctgcctcacttctcactgtaaacattagctctttccactgcctacctggaccccagtctaggaattaaatctgcacctaaccaaggtcccttgtaagaaatgtccattcaagcagtcattctctgggtatataatatgattttgactaccttatctggtgttaagatttgaagttggccttttattggactaaaggggaactcctttaagggtctcagttagcccaagtttcttttgcttatatgttaatagttttaccctctgcattggagagaggagtgctttactccaagaagctttcctcatggttaccgttctctccatcatgccagccttctcaacctttgcagaaattactagagaggatttgaatgtgggacacaaaggtcccatttgcagttagaaaatttgtgtccacaaggacaagaacaaagtatgagctttaaaactccataggaaacttgttaatcaacaaagaagtgttaatgctgcaagtaatctcttttttaaaactttttgaagctacttattttcagccaaataggaatattagagagggactggtagtgagaatatcagctctgtttggatggtggaaggtctcattttattgagatttttaagatacatgcaaaggtttggaaatagaacctctaggcaccctcctcagtgtgggtgggctgagagttaaagacagtgtggctgcagtagcatagaggcgcctagaaattccacttgcaccgtagggcatgctgataccatcccaatagctgttgcccattgacctctagtggtgagtttctagaatactggtccattcatgagatattcaagattcaagagtattctcacttctgggttatcagcataaactggaatgtagtgtcagaggatactgtggcttgttttgtttatgtttttttttcttattcaagaaaaaagaccaaggaataacattctgtagttcctaaaaatactgacttttttcactactatacataaagggaaagttttattcttttatggaacacttcagctgtactcatgtattaaaataggaatgtgaatgctatatactctttttatatcaaaagtctcaagcacttatttttattctatgcattgtttgtcttttacataaataaaatgtttattagattgaataaagcaaaatactcaggtgagcatcctgcctcctgttcccattcctagtagctaaa

SEQ ID NO: 21499 - DNA, 1910 bp, Homo sapiens
  ENST00000381178
cggacctccacactgagccatgcccacccccgacgccaccacgccacaggccaagggcttccgcagggccgtgtctgagctggacgccaagcaggcagaggccatcatggtaagagggcagggcgccccggggcccagcctcacaggctctccgtggcctggaactgcagccccagctgcatcctacacccccaccccaaggtccccgcggttcattgggcgcaggcagagcctcatcgaggacgcccgcaaggagcgggaggcggcggtggcagcagcggccgctgcagtcccctcggagcccggggaccccctggaggctgtggcctttgaggagaaggaggggaaggccgtgctaaacctgctcttctccccgagggccaccaagccctcggcgctgtcccgagctgtgaaggtgtttgagacgtttgaagccaaaatccaccatctagagacccggcccgcccagaggccgcgagctgggggcccccacctggagtacttcgtgcgcctcgaggtgcgccgaggggacctggccgccctgctcagtggtgtgcgccaggtgtcagaggacgtgcgcagccccgcggggcccaaggtcccctggttcccaagaaaagtgtcagagctggacaagtgtcatcacctggtcaccaagttcgaccctgacctggacttggaccacccgggcttctcggaccaggtgtaccgccagcgcaggaagctgattgctgagatcgccttccagtacaggcacggcgacccgattccccgtgtggagtacaccgccgaggagattgccacctggaaggaggtctacaccacgctgaagggcctctacgccacgcacgcctgcggggagcacctggaggcctttgctttgctggagcgcttcagcggctaccgggaagacaatatcccccagctggaggacgtctcccgcttcctgaaggagcgcacgggcttccagctgcggcctgtggccggcctgctgtccgcccgggacttcctggccagcctggccttccgcgtgttccagtgcacccagtatatccgccacgcgtcctcgcccatgcactcccctgagccggactgctgccacgagctgctggggcacgtgcccatgctggccgaccgcaccttcgcgcagttctcgcaggacattggcctggcgtccctgggggcctcggatgaggaaattgagaagctgtccacgctgtactggttcacggtggagttcgggctgtgtaagcagaacggggaggtgaaggcctatggtgccgggctgctgtcctcctacggggagctcctgcactgcctgtctgaggagcctgagattcgggccttcgaccctgaggctgcggccgtgcagccctaccaagaccagacgtaccagtcagtctacttcgtgtctgagagcttcagtgacgccaaggacaagctcaggagctatgcctcacgcatccagcgccccttctccgtgaagttcgacccgtacacgctggccatcgacgtgctggacagcccccaggccgtgcggcgctccctggagggtgtccaggatgagctggacacccttgcccatgcgctgagtgccattggctaggtgcacggcgtccctgagggcccttcccaacctcccctggtcctgcactgtcccggagctcaggccctggtgaggggctgggtcccgggtgccccccatgccctccctgctgccaggctcccactgcccctgcacctgcttctcagcgcaacagctgtgtgtgcccgtggtgaggttgtgctgcctgtggtgaggtcctgtcctggctcccagggtcctgggggctgctgcactgccctccgcccttccctgacactgtctgctgccccaatcaccgtcacaataaaagaaactgtggtctcta

SEQ ID NO: 21500 - DNA, 1898 bp, Homo sapiens
  ENST00000381175
cggacctccacactgagccatgcccacccccgacgccaccacgccacaggccaagggcttccgcagggccgtgtctgagctggacgccaagcaggcagaggccatcatgggcgccccggggcccagcctcacaggctctccgtggcctggaactgcagccccagctgcatcctacacccccaccccaaggtccccgcggttcattgggcgcaggcagagcctcatcgaggacgcccgcaaggagcgggaggcggcggtggcagcagcggccgctgcagtcccctcggagcccggggaccccctggaggctgtggcctttgaggagaaggaggggaaggccgtgctaaacctgctcttctccccgagggccaccaagccctcggcgctgtcccgagctgtgaaggtgtttgagacgtttgaagccaaaatccaccatctagagacccggcccgcccagaggccgcgagctgggggcccccacctggagtacttcgtgcgcctcgaggtgcgccgaggggacctggccgccctgctcagtggtgtgcgccaggtgtcagaggacgtgcgcagccccgcggggcccaaggtcccctggttcccaagaaaagtgtcagagctggacaagtgtcatcacctggtcaccaagttcgaccctgacctggacttggaccacccgggcttctcggaccaggtgtaccgccagcgcaggaagctgattgctgagatcgccttccagtacaggcacggcgacccgattccccgtgtggagtacaccgccgaggagattgccacctggaaggaggtctacaccacgctgaagggcctctacgccacgcacgcctgcggggagcacctggaggcctttgctttgctggagcgcttcagcggctaccgggaagacaatatcccccagctggaggacgtctcccgcttcctgaaggagcgcacgggcttccagctgcggcctgtggccggcctgctgtccgcccgggacttcctggccagcctggccttccgcgtgttccagtgcacccagtatatccgccacgcgtcctcgcccatgcactcccctgagccggactgctgccacgagctgctggggcacgtgcccatgctggccgaccgcaccttcgcgcagttctcgcaggacattggcctggcgtccctgggggcctcggatgaggaaattgagaagctgtccacgctgtactggttcacggtggagttcgggctgtgtaagcagaacggggaggtgaaggcctatggtgccgggctgctgtcctcctacggggagctcctgcactgcctgtctgaggagcctgagattcgggccttcgaccctgaggctgcggccgtgcagccctaccaagaccagacgtaccagtcagtctacttcgtgtctgagagcttcagtgacgccaaggacaagctcaggagctatgcctcacgcatccagcgccccttctccgtgaagttcgacccgtacacgctggccatcgacgtgctggacagcccccaggccgtgcggcgctccctggagggtgtccaggatgagctggacacccttgcccatgcgctgagtgccattggctaggtgcacggcgtccctgagggcccttcccaacctcccctggtcctgcactgtcccggagctcaggccctggtgaggggctgggtcccgggtgccccccatgccctccctgctgccaggctcccactgcccctgcacctgcttctcagcgcaacagctgtgtgtgcccgtggtgaggttgtgctgcctgtggtgaggtcctgtcctggctcccagggtcctgggggctgctgcactgccctccgcccttccctgacactgtctgctgccccaatcaccgtcacaataaaagaaactgtggtctcta

SEQ ID NO: 21501 - DNA, 1889 bp, Homo sapiens
  ENST00000352909
ggacccagagggggctttgacgtcagctcagcttataagaggctgctgggccagggctgtggagacggagcccggacctccacactgagccatgcccacccccgacgccaccacgccacaggccaagggcttccgcagggccgtgtctgagctggacgccaagcaggcagaggccatcatgtccccgcggttcattgggcgcaggcagagcctcatcgaggacgcccgcaaggagcgggaggcggcggtggcagcagcggccgctgcagtcccctcggagcccggggaccccctggaggctgtggcctttgaggagaaggaggggaaggccgtgctaaacctgctcttctccccgagggccaccaagccctcggcgctgtcccgagctgtgaaggtgtttgagacgtttgaagccaaaatccaccatctagagacccggcccgcccagaggccgcgagctgggggcccccacctggagtacttcgtgcgcctcgaggtgcgccgaggggacctggccgccctgctcagtggtgtgcgccaggtgtcagaggacgtgcgcagccccgcggggcccaaggtcccctggttcccaagaaaagtgtcagagctggacaagtgtcatcacctggtcaccaagttcgaccctgacctggacttggaccacccgggcttctcggaccaggtgtaccgccagcgcaggaagctgattgctgagatcgccttccagtacaggcacggcgacccgattccccgtgtggagtacaccgccgaggagattgccacctggaaggaggtctacaccacgctgaagggcctctacgccacgcacgcctgcggggagcacctggaggcctttgctttgctggagcgcttcagcggctaccgggaagacaatatcccccagctggaggacgtctcccgcttcctgaaggagcgcacgggcttccagctgcggcctgtggccggcctgctgtccgcccgggacttcctggccagcctggccttccgcgtgttccagtgcacccagtatatccgccacgcgtcctcgcccatgcactcccctgagccggactgctgccacgagctgctggggcacgtgcccatgctggccgaccgcaccttcgcgcagttctcgcaggacattggcctggcgtccctgggggcctcggatgaggaaattgagaagctgtccacgctgtactggttcacggtggagttcgggctgtgtaagcagaacggggaggtgaaggcctatggtgccgggctgctgtcctcctacggggagctcctgcactgcctgtctgaggagcctgagattcgggccttcgaccctgaggctgcggccgtgcagccctaccaagaccagacgtaccagtcagtctacttcgtgtctgagagcttcagtgacgccaaggacaagctcaggagctatgcctcacgcatccagcgccccttctccgtgaagttcgacccgtacacgctggccatcgacgtgctggacagcccccaggccgtgcggcgctccctggagggtgtccaggatgagctggacacccttgcccatgcgctgagtgccattggctaggtgcacggcgtccctgagggcccttcccaacctcccctggtcctgcactgtcccggagctcaggccctggtgaggggctgggtcccgggtgccccccatgccctccctgctgccaggctcccactgcccctgcacctgcttctcagcgcaacagctgtgtgtgcccgtggtgaggttgtgctgcctgtggtgaggtcctgtcctggctcccagggtcctgggggctgctgcactgccctccgcccttccctgacactgtctgctgccccaatcaccgtcacaataaaagaaactgtggtctcta

SEQ ID NO: 21502 - DNA, 1115 bp, Homo sapiens
  ENST00000324155
cggacctccacactgagccatgcccacccccgacgccaccacgccacaggccaagggcttccgcagggccgtgtctgagctggacgccaagcaggcagaggccatcatgggccaccaagccctcggcgctgtcccgagctgtgaaggtgtttgagacgtttgaagccaaaatccaccatctagagacccggcccgcccagaggccgcgagctgggggcccccacctggagtacttcgtgcgcctcgaggtgcgccgaggggacctggccgccctgctcagtggtgtgcgccaggtgtcagaggacgtgcgcagccccgcggggcccaaggtcccctggttcccaagaaaagtgtcagagctggacaagtgtcatcacctggtcaccaagttcgaccctgacctggacttggaccacccgggcttctcggaccaggtgtaccgccagcgcaggaagctgattgctgagatcgccttccagtacaggcacggcgacccgattccccgtgtggagtacaccgccgaggagattgccacctggaaggaggtctacaccacgctgaagggcctctacgccacgcacgcctgcggggagcacctggaggcctttgctttgctggagcgcttcagcggctaccgggaagacaatatcccccagctggaggacgtctcccgcttcctgaaggagcgcacgggcttccagctgcggcctgtggccggcctgctgtccgcccgggacttcctggccagcctggccttccgcgtgttccagtgcacccagtatatccgccacgcgtcctcgcccatgcactcccctgagccggactgctgccacgagctgctggggcacgtgcccatgctggccgaccgcaccttcgcgcagttctcgcaggacattggcctggcgtccctgggggcctcggatgaggaaattgagaagctgtccacgctgtactggttcacggtggagttcgggctgtgtaagcagaacggggaggtgaaggcctatggtgccgggctgctgtcctcctacggggagctcctgcactgcctgtctgaggagcctgagattcgggccttcgaccctgaggctgcggccgtgcagccctaccaagac

SEQ ID NO: 21503 - DNA, 745 bp, Homo sapiens
  ENST00000479437
aagaggctacccatcctgtcgggccatccccagtgtgctgagggaccgcccctcatggccccctatcccctgggattccctaaagccaccagcaaaagcccctcccgggggcctgggtcttcaggggtccccaagaggcctgcgttggtaggggctcaggcaggcagaggcacccacagttcaggaggggggtttcgggcactggggtggggcattagagggccctgagcctggctgcccgcaggaaggaggtctacaccacgctgaagggcctctacgccacgcacgcctgcggggagcacctggaggcctttgctttgctggagcgcttcagcggctaccgggaagacaatatcccccagctggaggacgtctcccgcttcctgaaggagcgcacgggcttccagctgcggcctgtggccggcctgctgtccgcccgggacttcctggccagcctggccttccgcgtgttccagtgcacccagtatatccgccacgcgtcctcgcccatgcactcccctgagccggactgctgccacgagctgctggggcacgtgcccatgctggccgaccgcaccttcgcgcagttctcgcaggacattggcctggcgtccctgggggcctcggatgaggaaattgagaagctgtccacgctgtactggttcacggtggagttcgggctgtgtaagcagaacggggaggtgaaggcctatggtgccgggctgctgtcctcctacggggagct

SEQ ID NO: 21504 - DNA, 483 bp, Homo sapiens
  ENST00000416223
ggacttggaccacccgggcttctcggaccaggtgtaccgccagcgcaggaagctgattgctgagatcgccttccagtacaggcacggcgacccgattccccgtgtggagtacaccgccgaggagattgccacctgagcgcacgggcttccagctgcggcctgtggccggcctgctgtccgcccgggacttcctggccagcctggccttccgcgtgttccagtgcacccagtatatccgccacgcgtcctcgcccatgcactcccctgagccggactgctgccacgagctgctggggcacgtgcccatgctggccgaccgcaccttcgcgcagttctcgcaggacattggcctggcgtccctgggggcctcggatgaggaaattgagaagctgtccacgctgtactggttcacggtggagttcgggctgtgtaagcagaacggggaggtgaaggcctatggtgccgggctgctgtcctcctacg

SEQ ID NO: 21505 - DNA, 347 bp, Homo sapiens
  ENST00000412076
ggacttggaccacccgggcttctcggaccaggtgtaccgccagcgcaggaagctgattgctgagatcgccttccagtacaggcacggcgacccgattccccgtgtggagtacaccgccgaggagattgccacctgggactgctgccacgagctgctggggcacgtgcccatgctggccgaccgcaccttcgcgcagttctcgcaggacattggcctggcgtccctgggggcctcggatgaggaaattgagaagctgtccacgctgtactggttcacggtggagttcgggctgtgtaagcagaacggggaggtgaaggcctatggtgccgggctgctgtcctcctacg

SEQ ID NO: 21506 - DNA, 839 bp, Homo sapiens
  ENST00000461172
ttgcagagcgcacgggcttccagctgcggcctgtggccggcctgctgtccgcccgggacttcctggccagcctggccttccgcgtgttccagtgcacccagtatatccgccacgcgtcctcgcccatgcactcccctgagccggactgctgccacgagctgctggggcacgtgcccatgctggccgaccgcaccttcgcgcagttctcgcaggtacgccgcggcctcggagggagccggggtcacccaggggctggcttggcgccgggggcgggcggggatcgatgtgcgggtgggtgaagtgtgctgcctgctcccgggccccgccaaggaggctcggcgccccgagggtcgcgcggcatagggcggggctggagcggagcctcccacggcctgtgctgccacctgccggctacctgggaacggcgcccacgggcttaggaatgtggtcaaggagggctgcctggaggaggaggcccggtggaggtgcggatcctgggcggccagggaaggtctctgccgccagggaagtgtcccagagacccctggaggggctgctgacacccccggtgcccccacctcgagcatgacccagggctgcctctccccatccttcatcctccctgctccacaggacattggcctggcgtccctgggggcctcggatgaggaaattgagaagctgtccacggtgggttgacccctccctgcagggcctggggtgtgggtttgggggtctgaatccaggcctcaccctcttgccgtccaggctgaggcctctccttccacccacgaattgtgaccctcaccctggcctgcctgcatcctggcctggcctcc

SEQ ID NO: 21507 - DNA, 985 bp, Homo sapiens
  ENST00000381168
cggacctccacactgagccatgcccacccccgacgccaccacgccacaggccaagggcttccgcagggccgtgtctgagctggacgccaagcaggcagaggccatcatggtaagagggcagggccaccaagccctcggcgctgtcccgagctgtgaaggtgtttgagacgtttgaagccaaaatccaccatctagagacccggcccgcccagaggccgcgagctgggggcccccacctggagtacttcgtgcgcctcgaggtgcgccgaggggacctggccgccctgctcagtggtgtgcgccaggtgtcagaggacgtgcgcagccccgcggggcccaaggtcccctggttcccaagaaaagtgtcagagctggacaagtgtcatcacctggtcaccaagttcgaccctgacctggacttggaccacccgggcttctcggaccaggtgtaccgccagcgcaggaagctgattgctgagatcgccttccagtacaggcagggacctgctgaccactggccccctccccagcggcgacccgattccccgtgtggagtacaccgccgaggagattgccacctggaaggaggtctacaccacgctgaagggcctctacgccacgcacgcctgcggggagcacctggaggcctttgctttgctggagcgcttcagcggctaccgggaagacaatatcccccagctggaggacgtctcccgcttcctgaaggagcgcacgggcttccagctgcggcctgtggccggcctgctgtccgcccgggacttcctggccagcctggccttccgcgtgttccagtgcacccagtatatccgccacgcgtcctcgcccatgcactcccctgagccggactgctgccacgagctgctggggcacgtgcccatgctggccgaccgcaccttcgcgcagttctcgcaggacattggcctggcgtccctgggggcctcggatgaggaaattgagaagctgt

SEQ ID NO: 21508 - DNA, 963 bp, Homo sapiens
  ENST00000469226
cctctctctccatctctgtctctttctccttctctctctcttcctgcttttgctccctaagacgtttgaagccaaaatccaccatctagagacccggcccgcccagaggccgcgagctgggggcccccacctggagtacttcgtgcgcctcgaggtgcgccgaggggacctggccgccctgctcagtggtgtgcgccaggtgtcagaggacgtgcgcagccccgcggggcccaaggtcccctggttcccaagaaaagtgtcagagctggacaagtgtcatcacctggtcaccaagttcgaccctgacctggacttggaccacccgggcttctcggaccaggtgtaccgccagcgcaggaagctgattgctgagatcgccttccagtacaggcagtgaggggcccctgcgctcgggacccagactccgtcctgcaggctgacgctggacctggggggtgggagggaaggacaaaggggaggacccatcttgtcaccagcatcagtgcctcctgccaggcagctctgctccagggctttccatgtccccaaatcccagtggggaaactgaggcccaggggggctagagcaacctgccgaggccacatagccggctcacggcacagtcagctggggtgcaccctcctgtccatcctccaacccaaaggcctcgctgcactaggcgggtgtggacctgtgcccagtgaagctccctccctccctcctgcccttctcactccccgaggggacctgctgaccactggccccctccccagcggcgacccgattccccgtgtggagtacaccgccgaggagattgccacctggaaggaggtctacaccacgctgaagggcctctacgccacgcacgcctgcggggagcacctggaggcctttgctttgctggagcgcttcagcggctaccgggaagacaatatcccccagctggaggacgtctcccgcttc

SEQ ID NO: 21509 - DNA, 1535 bp, Homo sapiens
  ENST00000333684
cggacctccacactgagccatgcccacccccgacgccaccacgccacaggccaagggcttccgcagggccgtgtctgagctggacgccaagcaggcagaggccatcatgtccccgcggttcattgggcgcaggcagagcctcatcgaggacgcccgcaaggagcgggaggcggcggtggcagcagcggccgctgcagtcccctcggagcccggggaccccctggaggctgtggcctttgaggagaaggaggggaaggccgtgctaaacctgctcttctccccgagggccaccaagccctcggcgctgtcccgagctgtgaaggtgtttgagacgtttgaagccaaaatccaccatctagagacccggcccgcccagaggccgcgagctgggggcccccacctggagtacttcgtgcgcctcgaggtgcgccgaggggacctggccgccctgctcagtggtgtgcgccaggtgtcagaggacgtgcgcagccccgcggggcccaaggtcccctggttcccaagaaaagtgtcagagctggacaagtgtcatcacctggtcaccaagttcgaccctgacctggacttggaccacccgggcttctcggaccaggtgtaccgccagcgcaggaagctgattgctgagatcgccttccagtacaggcacggcgacccgattccccgtgtggagtacaccgccgaggagattgccacctgggactgctgccacgagctgctggggcacgtgcccatgctggccgaccgcaccttcgcgcagttctcgcaggacattggcctggcgtccctgggggcctcggatgaggaaattgagaagctgtccacgctgtactggttcacggtggagttcgggctgtgtaagcagaacggggaggtgaaggcctatggtgccgggctgctgtcctcctacggggagctcctgcactgcctgtctgaggagcctgagattcgggccttcgaccctgaggctgcggccgtgcagccctaccaagaccagacgtaccagtcagtctacttcgtgtctgagagcttcagtgacgccaaggacaagctcaggagctatgcctcacgcatccagcgccccttctccgtgaagttcgacccgtacacgctggccatcgacgtgctggacagcccccaggccgtgcggcgctccctggagggtgtccaggatgagctggacacccttgcccatgcgctgagtgccattggctaggtgcacggcgtccctgagggcccttcccaacctcccctggtcctgcactgtcccggagctcaggccctggtgaggggctgggtcccgggtgccccccatgccctccctgctgccaggctcccactgcccctgcacctgcttctcagcgcaacagctgtgtgtgcccgtggtgaggttgtgctgcctgtggtgaggtcctgtcctggctcccagggtcctgggggctgctgcactgccctccgcccttccctgacactgtctgctgccccaatcaccgtcacaataaaagaaactgtggtctcta

SEQ ID NO: 21510 - DNA, 5811 bp, Homo sapiens
  ENST00000366787
aggaggaggagacggcatccagtacagaggggctggacttggacccctgcagcagccctgcacaggagaagcggcatataaagccgcgctgcccgggagccgctcggccacgtccaccggagcatcctgcactgcagggccggtctctcgctccagcagagcctgcgcctttctgactcggtccggaacactgaaaccagtcatcactgcatctttttggcaaaccaggagctcagctgcaggaggcaggatggtctggaggctggtcctgctggctctgtgggtgtggcccagcacgcaagctggtcaccaggacaaagacacgaccttcgaccttttcagtatcagcaacatcaaccgcaagaccattggcgccaagcagttccgcgggcccgaccccggcgtgccggcttaccgcttcgtgcgctttgactacatcccaccggtgaacgcagatgacctcagcaagatcaccaagatcatgcggcagaaggagggcttcttcctcacggcccagctcaagcaggacggcaagtccaggggcacgctgttggctctggagggccccggtctctcccagaggcagttcgagatcgtctccaacggccccgcggacacgctggatctcacctactggattgacggcacccggcatgtggtctccctggaggacgtcggcctggctgactcgcagtggaagaacgtcaccgtgcaggtggctggcgagacctacagcttgcacgtgggctgcgacctcatagacagcttcgctctggacgagcccttctacgagcacctgcaggcggaaaagagccggatgtacgtggccaaaggctctgccagagagagtcacttcaggggtttgcttcagaacgtccacctagtgtttgaaaactctgtggaagatattctaagcaagaagggttgccagcaaggccagggagctgagatcaacgccatcagtgagaacacagagacgctgcgcctgggtccgcatgtcaccaccgagtacgtgggccccagctcggagaggaggcccgaggtgtgcgaacgctcgtgcgaggagctgggaaacatggtccaggagctctcggggctccacgtcctcgtgaaccagctcagcgagaacctcaagagagtgtcgaatgataaccagtttctctgggagctcattggtggccctcctaagacaaggaacatgtcagcttgctggcaggatggccggttctttgcggaaaatgaaacgtgggtggtggacagctgcaccacgtgtacctgcaagaaatttaaaaccatttgccaccaaatcacctgcccgcctgcaacctgcgccagtccatcctttgtggaaggcgaatgctgcccttcctgcctccactcggtggacggtgaggagggctggtctccgtgggcagagtggacccagtgctccgtgacgtgtggctctgggacccagcagagaggccggtcctgtgacgtcaccagcaacacctgcttggggccctccatccagacacgggcttgcagtctgagcaagtgtgacacccgcatccggcaggacggcggctggagccactggtcaccttggtcttcatgctctgtgacctgtggagttggcaatatcacacgcatccgtctctgcaactccccagtgccccagatggggggcaagaattgcaaagggagtggccgggagaccaaagcctgccagggcgccccatgcccaatcgatggccgctggagcccctggtccccgtggtcggcctgcactgtcacctgtgccggtgggatccgggagcgcacccgggtctgcaacagccctgagcctcagtacggagggaaggcctgcgtgggggatgtgcaggagcgtcagatgtgcaacaagaggagctgccccgtggatggctgtttatccaacccctgcttcccgggagcccagtgcagcagcttccccgatgggtcctggtcatgcggctcctgccctgtgggcttcttgggcaatggcacccactgtgaggacctggacgagtgtgccctggtccccgacatctgcttctccaccagcaaggtgcctcgctgtgtcaacactcagcctggcttccactgcctgccctgcccgccccgatacagagggaaccagcccgtcggggtcggcctggaagcagccaagacggaaaagcaagtgtgtgagcccgaaaacccatgcaaggacaagacacacaactgccacaagcacgcggagtgcatctacctgggccacttcagcgaccccatgtacaagtgcgagtgccagacaggctacgcgggcgacgggctcatctgcggggaggactcggacctggacggctggcccaacctcaatctggtctgcgccaccaacgccacctaccactgcatcaaggataactgcccccatctgccaaattctgggcaggaagactttgacaaggacgggattggcgatgcctgtgatgatgacgatgacaatgacggtgtgaccgatgagaaggacaactgccagctcctcttcaatccccgccaggctgactatgacaaggatgaggttggggaccgctgtgacaactgcccttacgtgcacaaccctgcccagatcgacacagacaacaatggagagggtgacgcctgctccgtggacattgatggggacgatgtcttcaatgaacgagacaattgtccctacgtctacaacactgaccagagggacacggatggtgacggtgtgggggatcactgtgacaactgccccctggtgcacaaccctgaccagaccgacgtggacaatgaccttgttggggaccagtgtgacaacaacgaggacatagatgacgacggccaccagaacaaccaggacaactgcccctacatctccaacgccaaccaggctgaccatgacagagacggccagggcgacgcctgtgaccctgatgatgacaacgatggcgtccccgatgacagggacaactgccggcttgtgttcaacccagaccaggaggacttggacggtgatggacggggtgatatttgtaaagatgattttgacaatgacaacatcccagatattgatgatgtgtgtcctgaaaacaatgccatcagtgagacagacttcaggaacttccagatggtccccttggatcccaaagggaccacccaaattgatcccaactgggtcattcgccatcaaggcaaggagctggttcagacagccaactcggaccccggcatcgctgtaggttttgacgagtttgggtctgtggacttcagtggcacattctacgtaaacactgaccgggacgacgactatgccggcttcgtctttggttaccagtcaagcagccgcttctatgtggtgatgtggaagcaggtgacgcagacctactgggaggaccagcccacgcgggcctatggctactccggcgtgtccctcaaggtggtgaactccaccacggggacgggcgagcacctgaggaacgcgctgtggcacacggggaacacgccggggcaggtgcgaaccttatggcacgaccccaggaacattggctggaaggactacacggcctataggtggcacctgactcacaggcccaagactggctacatcagagtcttagtgcatgaaggaaaacaggtcatggcagactcaggacctatctatgaccaaacctacgctggcgggcggctgggtctatttgtcttctctcaagaaatggtctatttctcagacctcaagtacgaatgcagagatatttaaacaagatttgctgcatttccggcaatgccctgtgcatgccatggtccctagacacctcagttcattgtggtccttgtggcttctctctctagcagcacctcctgtcccttgaccttaactctgatggttcttcacctcctgccagcaaccccaaacccaagtgccttcagaggataaatatcaatggaactcagagatgaacatctaacccactagaggaaaccagtttggtgatatatgagactttatgtggagtgaaaattgggcatgccattacattgctttttcttgtttgtttaaaaagaatgacgtttacatataaaatgtaattacttattgtatttatgtgtatatggagttgaagggaatactgtgcataagccattatgataaattaagcatgaaaaatattgctgaactacttttggtgcttaaagttgtcactattcttgaattagagttgctctacaatgacacacaaatcccattaaataaattataaacaagggtcaattcaaatttgaagtaatgttttagtaaggagagattagaagacaacaggcatagcaaatgacataagctaccgattaactaatcggaacatgtaaaacagttacaaaaataaacgaactctcctcttgtcctacaatgaaagccctcatgtgcagtagagatgcagtttcatcaaagaacaaacatccttgcaaatgggtgtgacgcggttccagatgtggatttggcaaaacctcatttaagtaaaaggttagcagagcaaagtgcggtgctttagctgctgcttgtgccgctgtggcgtcggggaggctcctgcctgagcttccttccccagctttgctgcctgagaggaaccagagcagacgcacaggccggaaaaggcgcatctaacgcgtatctaggctttggtaactgcggacaagttgcttttacctgatttgatgatacatttcattaaggttccagttataaatattttgttaatatttattaagtgactatagaatgcaactccatttaccagtaacttattttaaatatgcctagtaacacatatgtagtataatttctagaaacaaacatctaataagtatataatcctgtgaaaatatgaggcttgataatattaggttgtcacgatgaagcatgctagaagctgtaacagaatacatagagaataatgaggagtttatgatggaaccttaaatatataatgttgccagcgattttagttcaatatttgttactgttatctatctgctgtatatggaattcttttaattcaaacgctgaaaagaatcagcatttagtcttgccaggcacacccaataatcagtcatgtgtaatatgcacaagtttgtttttgtttttgttttttttgttggttggtttgtttttttgctttaagttgcatgatctttctgcaggaaatagtcactcatcccactccacataaggggtttagtaagagaagtctgtctgtctgatgatggatagggggcaaatctttttcccctttctgttaatagtcatcacatttctatgccaaacaggaacaatccataactttagtcttaatgtacacattgcattttgataaaattaattttgttgtttcctttgaggttgatcgttgtgttgttgttttgctgcactttttacttttttgcgtgtggagctgtattcccgagaccaacgaagcgttgggatacttcattaaatgtagcgactgtcaacagcgtgcaggttttctgtttctgtgttgtggggtcaaccgtacaatggtgtgggagtgacgatgatgtgagtatttagaatgtaccatattttttgtaaattatttatgtttttctaaacaaatttatcgtataggttgatgaaacgtcatgtgttttgccaaagactgtaaatatttatttatgtgttcacatggtcaaaatttcaccactgaaaccctgcacttagctagaacctcatttttaaagattaacaacaggaaataaattgtaaaaaaggttttctatacatga

SEQ ID NO: 21511 - DNA, 875 bp, Homo sapiens
  ENST00000488355
gacaatgacaacatcccagatattgatgatgtgtgtcctgaaaacaatgccatcagtgagacagacttcaggaacttccagatggtccccttggatcccaaagggaccacccaaattgatcccaactgggtcattcgccatcaaggcaaggagctggttcagacagccaactcggaccccggcatcgctgtaggttttgacgagtttgggtctgtggacttcagtggcacattctacgtaaacactgaccgggacgacgactatgccggcttcgtctttggttaccagtcaagcagccgcttctatgtggtgatgtggaagcaggtgacgcagacctactgggaggaccagcccacgcgggcctatggctactccggcgtgtccctcaaggtggtgaactccaccacggggacgggcgagcacctgaggaacgcgctgtggcacacggggaacacgccggggcaggtgcgaaccttatggcacgaccccaggaacattggctggaaggactacacggcctataggtggcacctgactcacaggcccaagactggctacatcagagtcttagtgcatgaaggaaaacaggtcatggcagactcaggacctatctatgaccaaacctacgctggcgggcggctgggtctatttgtcttctctcaagaaatggtctatttctcagacctcaagtacgaatgcagagatgaacatctaacccactagaggaaaccagtttggtgatatatgagactttatgtggagtgaaaattgggcatgccattacattgctttttcttgtttgtttaaaaagaatgacgtttacatataaaatgtaattacttattgtatttatgtgtatatggagttgaagggaa

SEQ ID NO: 21512 - DNA, 641 bp, Homo sapiens
  ENST00000461848
acaccgcttacaggcaaatacccctctaggcggcacagcctgatctctctccgcttcttgtgttagtccggcaggacggcggctggagccactggtcaccttggtcttcatgctctgtgacctgtggagttggcaatatcacacgcatccgtctctgcaactccccagtgccccagatggggggcaagaattgcaaagggagtggccgggagaccaaagcctgccagggcgccccatgcccaatcgatggccgctggagcccctggtccccgtggtcggcctgcactgtcacctgtgccggtgggatccgggagcgcacccgggtctgcaacagccctgagcctcagtacggagggaaggcctgcgtgggggatgtgcaggagcgtcagatgtgcaacaagaggagctgccccgtgggtgagtgaggggtagaagcgggggcactgaaacccgggcttccattctgatgaaaagcacaaacgctttgggaaactagatgaaaaacacagaaaagaaaaatcaattttagttgcacacgcaaagataactacttttaacatctgtgtttcagtcctcctgtatttctaatgtaaaaacaaaaaagatgccaggtggcgtggcctgtggaatgtgggtagttg

SEQ ID NO: 21513 - DNA, 481 bp, Homo sapiens
  ENST00000472733
gtctccaacggccccgcggacacgctggatctcacctactggattgacggcacccggcatgtggtctccctggaggacgtcggcctggctgactcgcagtggaagaacgtcaccgtgcaggtggctggcgagacctacagcttgcacgtgggctgcgacctcatagacagcttcgctctggacgagcccttctacgagcacctgcaggcggaaaagagccggatgtacgtggccaaaggctctgccagagagagtcacttcaggggtttgcttcagaacgtccacctagtgtttgaaaactctgtggaagatattctaagcaagaagggttgccagcaaggccagggaggtaggtgtgttgtgaaaaatgcattttatatactggcttggatggatttctattgtgacatggtgtatgtgtgtgtgtgtatgtgtgtgcattcatgcttgtaaaaatttaagtaaaaatatttgggtaact

SEQ ID NO: 21514 - DNA, 437 bp, Homo sapiens
  ENST00000435791
acattctgctccggtaacccatgcctgtggctcgctgggctaagtcagcccctggtgaagtttcatttgccgaattcatctctcatgacaacccgatgaggtgggcattttacatgacgctacgtttcattctacggatgaggaaactgagacagagaagttaagagctcagctgcaggaggcaggatggtctggaggctggtcctgctggctctgtgggtgtggcccagcacgcaagctggtcaccaggacaaagacacgaccttcgaccttttcagtatcagcaacatcaaccgcaagaccattggcgccaagcagttccgcgggcccgaccccggcgtgccggcttaccgcttcgtgcgctttgactacatcccaccggtgaacgcagatgacctcagcaagatcaccaagatcatgcggcagaaggagggctt

SEQ ID NO: 21515 - DNA, 5280 bp, Homo sapiens
  ENST00000617924
gagcatcctgcactgcagggccggtctctcgctccagcagagcctgcgcctttctgactcggtccggaacactgaaaccagtcatcactgcatctttttggcaaaccaggagctcagctgcaggaggcaggatggtctggaggctggtcctgctggctctgtgggtgtggcccagcacgcaagctggtcaccaggacaaagacacgaccttcgaccttttcagtatcagcaacatcaaccgcaagaccattggcgccaagcagttccgcgggcccgaccccggcgtgccggcttaccgcttcgtgcgctttgactacatcccaccggtgaacgcagatgacctcagcaagatcaccaagatcatgcggcagaaggagggcttcttcctcacggcccagctcaagcaggacggcaagtccaggggcacgctgttggctctggagggccccggtctctcccagaggcagttcgagatcgtctccaacggccccgcggacacgctggatctcacctactggattgacggcacccggcatgtggtctccctggaggacgtcggcctggctgactcgcagtggaagaacgtcaccgtgcaggtggctggcgagacctacagcttgcacgtgggctgcgacctcatagacagcttcgctctggacgagcccttctacgagcacctgcaggcggaaaagagccggatgtacgtggccaaaggctctgccagagagagtcacttcaggggtttgcttcagaacgtccacctagtgtttgaaaactctgtggaagatattctaagcaagaagggttgccagcaaggccagggagctgagatcaacgccatcagtgagaacacagagacgctgcgcctgggtccgcatgtcaccaccgagtacgtgggccccagctcggagaggaggcccgaggtgtgcgaacgctcgtgcgaggagctgggaaacatggtccaggagctctcggggctccacgtcctcgtgaaccagctcagcgagaacctcaagagagtgtcgaatgataaccagtttctctgggagctcattggtggccctcctaagacaaggaacatgtcagcttgctggcaggatggccggttctttgcggaaaatgaaacgtgggtggtggacagctgcaccacgtgtacctgcaagaaatttaaaaccatttgccaccaaatcacctgcccgcctgcaacctgcgccagtccatcctttgtggaaggcgaatgctgcccttcctgcctccactcggtggacggtgaggagggctggtctccgtgggcagagtggacccagtgctccgtgacgtgtggctctgggacccagcagagaggccggtcctgtgacgtcaccagcaacacctgcttggggccctccatccagacacgggcttgcagtctgagcaagtgtgacacccgcatccggcaggacggcggctggagccactggtcaccttggtcttcatgctctgtgacctgtggagttggcaatatcacacgcatccgtctctgcaactccccagtgccccagatggggggcaagaattgcaaagggagtggccgggagaccaaagcctgccagggcgccccatgcccaatcgatggccgctggagcccctggtccccgtggtcggcctgcactgtcacctgtgccggtgggatccgggagcgcacccgggtctgcaacagccctgagcctcagtacggagggaaggcctgcgtgggggatgtgcaggagcgtcagatgtgcaacaagaggagctgccccgtggatggctgtttatccaacccctgcttcccgggagcccagtgcagcagcttccccgatgggtcctggtcatgcggctcctgccctgtgggcttcttgggcaatggcacccactgtgaggacctggacgagtgtgccctggtccccgacatctgcttctccaccagcaaggtgcctcgctgtgtcaacactcagcctggcttccactgcctgccctgcccgccccgatacagagggaaccagcccgtcggggtcggcctggaagcagccaagacggaaaagcaagtgtgtgagcccgaaaacccatgcaaggacaagacacacaactgccacaagcacgcggagtgcatctacctgggccacttcagcgaccccatgtacaagtgcgagtgccagacaggctacgcgggcgacgggctcatctgcggggaggactcggacctggacggctggcccaacctcaatctggtctgcgccaccaacgccacctaccactgcatcaaggataactgcccccatctgccaaattctgggcaggaagactttgacaaggacgggattggcgatgcctgtgatgatgacgatgacaatgacggtgtgaccgatgagaaggacaactgccagctcctcttcaatccccgccaggctgactatgacaaggatgaggttggggaccgctgtgacaactgcccttacgtgcacaaccctgcccagatcgacacagacaacaatggagagggtgacgcctgctccgtggacattgatggggacgatgtcttcaatgaacgagacaattgtccctacgtctacaacactgaccagagggacacggatggtgacggtgtgggggatcactgtgacaactgccccctggtgcacaaccctgaccagaccgacgtggacaatgaccttgttggggaccagtgtgacaacaacgaggacatagatgacgacggccaccagaacaaccaggacaactgcccctacatctccaacgccaaccaggctgaccatgacagagacggccagggcgacgcctgtgaccctgatgatgacaacgatggcgtccccgatgacagggacaactgccggcttgtgttcaacccagaccaggaggacttggacggtgatggacggggtgatatttgtaaagatgattttgacaatgacaacatcccagatattgatgatgtgtgtcctgaaaacaatgccatcagtgagacagacttcaggaacttccagatggtccccttggatcccaaagggaccacccaaattgatcccaactgggtcattcgccatcaaggcaaggagctggttcagacagccaactcggaccccggcatcgctgtaggttttgacgagtttgggtctgtggacttcagtggcacattctacgtaaacactgaccgggacgacgactatgccggcttcgtctttggttaccagtcaagcagccgcttctatgtggtgatgtggaagcaggtgacgcagacctactgggaggaccagcccacgcgggcctatggctactccggcgtgtccctcaaggtggtgaactccaccacggggacgggcgagcacctgaggaacgcgctgtggcacacggggaacacgccggggcaggtgcgaaccttatggcacgaccccaggaacattggctggaaggactacacggcctataggtggcacctgactcacaggcccaagactggctacatcagagtcttagtgcatgaaggaaaacaggtcatggcagactcaggacctatctatgaccaaacctacgctggcgggcggctgggtctatttgtcttctctcaagaaatggtctatttctcagacctcaagtacgaatgcagagatatttaaacaagatttgctgcatttccggcaatgccctgtgcatgccatggtccctagacacctcagttcattgtggtccttgtggcttctctctctagcagcacctcctgtcccttgaccttaactctgatggttcttcacctcctgccagcaaccccaaacccaagtgccttcagaggataaatatcaatggaactcagagatgaacatctaacccactagaggaaaccagtttggtgatatatgagactttatgtggagtgaaaattgggcatgccattacattgctttttcttgtttgtttaaaaagaatgacgtttacatataaaatgtaattacttattgtatttatgtgtatatggagttgaagggaatactgtgcataagccattatgataaattaagcatgaaaaatattgctgaactacttttggtgcttaaagttgtcactattcttgaattagagttgctctacaatgacacacaaatcccattaaataaattataaacaagggtcaattcaaatttgaagtaatgttttagtaaggagagattagaagacaacaggcatagcaaatgacataagctaccgattaactaatcggaacatgtaaaacagttacaaaaataaacgaactctcctcttgtcctacaatgaaagccctcatgtgcagtagagatgcagtttcatcaaagaacaaacatccttgcaaatgggtgtgacgcggttccagatgtggatttggcaaaacctcatttaagtaaaaggttagcagagcaaagtgcggtgctttagctgctgcttgtgccgctgtggcgtcggggaggctcctgcctgagcttccttccccagctttgctgcctgagaggaaccagagcagacgcacaggccggaaaaggcgcatctaacgcgtatctaggctttggtaactgcggacaagttgcttttacctgatttgatgatacatttcattaaggttccagttataaatattttgttaatatttattaagtgactatagaatgcaactccatttaccagtaacttattttaaatatgcctagtaacacatatgtagtataatttctagaaacaaacatctaataagtatataatcctgtgaaaatatgaggcttgataatattaggttgtcacgatgaagcatgctagaagctgtaacagaatacatagagaataatgaggagtttatgatggaaccttaaatatataatgttgccagcgattttagttcaatatttgttactgttatctatctgctgtatatggaattcttttaattcaaacgctgaaaagaatcagcatttagtcttgccaggcacacccaataatcagtcatgtgtaatatgcacaagtttgtttttgtttttgttttttttgttggttggtttgtttttttgctttaagttgcatgatctttctgcaggaaatagtcactcatcccactccacataaggggtttagtaagagaagtctgtctgtctgatgatggatagggggcaaatctttttcccctttctgttaatagtcatcacatttctatgccaaacaggaacaatccataactttagtcttaatgtacacattgcattttgataaaattaattttgttgtttc

SEQ ID NO: 21516 - DNA, 573 bp, Homo sapiens
  ENST00000513310
gtggctaagggagggaagggtaatttgggggctcttgagagatgagagaaacaacgactggagggattaagaagaactcttaggagcagcttggcctaaaggctgtgtgggacgtgcctgctttgccttcgccttccaccatgatctctttgaccttctcccatcttccagtcagaggctaaacccaggcgctctgctgccagtcctgacagaccccgccctgaatgatctctatgtgatttccaccttcaagctgcagactaaaagttcagccaccatcttcggtctttactcttcaactgacaacagtaaatattttgaatttactgtgatgggacgcttaaacaaagaaaagttaaaacaatgaagatgagcaggaagaaaaaaataccatccaaacacccagcaaataaccatactaatgtagacatattttcttctaatcttctagccatcctccgttacctgaagaacgatgggaaggtgcatttggtggttttcaacaacctgcagctggcagacggaaggcggcacaggatcctcctgaggctgagcaatttgcagcgaggggcc

SEQ ID NO: 21517 - DNA, 564 bp, Homo sapiens
  ENST00000510218
aatttgggggctcttgagagatgagagaaacaacgactggagggattaagaagaactcttaggagcagcttggcctaaaggctgtgtgggacgtgcctgctttgccttcgccttccaccatgatcgtaagttttctgagaccccctcagccatgtttcctgtagagcctgtggagtttctttgaccttctcccatcttccagtcagaggctaaacccaggcgctctgctgccagtcctgacagaccccgccctgaatgatctctatgtgatttccaccttcaagctgcagactaaaagttcagccaccatcttcggtctttactcttcaactgacaacagtaaatattttgaatttactgtgatgggacgcttaaacaaagccatcctccgttacctgaagaacgatgggaaggtgcatttggtggttttcaacaacctgcagctggcagacggaaggcggcacaggatcctcctgaggctgagcaatttgcagcgaggggccggctccctagagctctacctggactgcatccaggtggattccgttcacaatctccccaggg

SEQ ID NO: 21518 - DNA, 3222 bp, Homo sapiens
  ENST00000350881
agcagccagctccccagcaccgcacggcggggacgcgagcgcgcccccgacggcagcccggacgccgagcacgggtcacctgcggcgccggcccgggcgccgaccgaggttcaacgcacggcccggggacccccaggcggggccaacgccgccgtcgcccccggcctcgcggggagcaggaagagccaacatgctggccccgcgcggagccgccgtcctcctgctgcacctggtcctgcagcggtggctagcggcaggcgcccaggccaccccccaggtctttgaccttctcccatcttccagtcagaggctaaacccaggcgctctgctgccagtcctgacagaccccgccctgaatgatctctatgtgatttccaccttcaagctgcagactaaaagttcagccaccatcttcggtctttactcttcaactgacaacagtaaatattttgaatttactgtgatgggacgcttaaacaaagccatcctccgttacctgaagaacgatgggaaggtgcatttggtggttttcaacaacctgcagctggcagacggaaggcggcacaggatcctcctgaggctgagcaatttgcagcgaggggccggctccctagagctctacctggactgcatccaggtggattccgttcacaatctccccagggcctttgctggcccctcccagaaacctgagaccattgaattgaggactttccagaggaagccacaggacttcttggaagagctgaagctggtggtgagaggctcactgttccaggtggccagcctgcaagactgcttcctgcagcagagtgagccactggctgccacaggcacaggggactttaaccggcagttcttgggtcaaatgacacaattaaaccaactcctgggagaggtgaaggaccttctgagacagcaggttaaggaaacatcatttttgcgaaacaccatagctgaatgccaggcttgcggtcctctcaagtttcagtctccgaccccaagcacggtggtgcccccggctccccctgcaccgccaacacgcccacctcgtcggtgtgactccaacccatgtttccgaggtgtccaatgtaccgacagtagagatggcttccagtgtgggccctgccccgagggctacacaggaaacgggatcacctgtattgatgttgatgagtgcaaataccatccctgctacccgggcgtgcactgcataaatttgtctcctggcttcagatgtgacgcctgcccagtgggcttcacagggcccatggtgcagggtgttgggatcagttttgccaagtcaaacaagcaggtctgcactgacattgatgagtgtcgaaatggagcgtgcgttcccaactcgatctgcgttaatactttgggatcttaccgctgtgggccttgtaagccggggtatactggtgatcagataaggggatgcaaagcggaaagaaactgcagaaacccagagctgaacccttgcagtgtgaatgcccagtgcattgaagagaggcagggggatgtgacatgtgtgtgtggagtcggttgggctggagatggctatatctgtggaaaggatgtggacatcgacagttaccccgacgaagaactgccatgctctgccaggaactgtaaaaaggacaactgcaaatatgtgccaaattctggccaagaagatgcagacagagatggcattggcgacgcttgtgacgaggatgctgacggagatgggatcctgaatgagcaggataactgtgtcctgattcataatgtggaccaaaggaacagcgataaagatatctttggggatgcctgtgataactgcctgagtgtcttaaataacgaccagaaagacaccgatggggatggaagaggagatgcctgtgatgatgacatggatggagatggaataaaaaacattctggacaactgcccaaaatttcccaatcgtgaccaacgggacaaggatggtgatggtgtgggggatgcctgtgacagttgtcctgatgtcagcaaccctaaccagtctgatgtggataatgatctggttggggactcctgtgacaccaatcaggacagtgatggagatgggcaccaggacagcacagacaactgccccaccgtcattaacagtgcccagctggacaccgataaggatggaattggtgacgagtgtgatgatgatgatgacaatgatggtatcccagacctggtgccccctggaccagacaactgccggctggtccccaacccagcccaggaggatagcaacagcgacggagtgggagacatctgtgagtctgactttgaccaggaccaggtcatcgatcggatcgacgtctgcccagagaacgcagaggtcaccctgaccgacttcagggcttaccagaccgtggtcctggatcctgaaggggatgcccagatcgatcccaactgggtggtcctgaaccagggcatggagattgtacagaccatgaacagtgatcctggcctggcagtggggtacacagcttttaatggagttgacttcgaagggaccttccatgtgaatacccagacagatgatgactatgcaggctttatctttggctaccaagatagctccagcttctacgtggtcatgtggaagcagacggagcagacatattggcaagccaccccattccgagcagttgcagaacctggcattcagctcaaggctgtgaagtctaagacaggtccaggggagcatctccggaactccctgtggcacacgggggacaccagtgaccaggtcaggctgctgtggaaggactccaggaatgtgggctggaaggacaaggtgtcctaccgctggttcctacagcacaggccccaggtgggctacatcagggtacgattttatgaaggctctgagttggtggctgactctggcgtcaccatagacaccacaatgcgtggaggccgacttggcgttttctgcttctctcaagaaaacatcatctggtccaacctcaagtatcgctgcaatgacaccatccctgaggacttccaagagtttcaaacccagaatttcgaccgcttcgataattaaaccaaggaagcaatctgtaactgcttttcggaacactaaaaccatatatattttaacttcaattttctttagcttttaccaacccaaatatatcaaaacgttttatgtgaatgtggcaataaaggagaagagatcatttttaaaaa

SEQ ID NO: 21519 - DNA, 3094 bp, Homo sapiens
  ENST00000511733
ggagcgatgtatgcccagagtctgctcttgacatccctgagaaagacgcagaattactctacttgccctgccacctgcattttctgctctgactttgcttgaacgacaaaaagaaagtttatttcaaggattggcttgatgtcttaatttctgagtctttgaccttctcccatcttccagtcagaggctaaacccaggcgctctgctgccagtcctgacagaccccgccctgaatgatctctatgtgatttccaccttcaagctgcagactaaaagttcagccaccatcttcggtctttactcttcaactgacaacagtaaatattttgaatttactgtgatgggacgcttaaacaaagccatcctccgttacctgaagaacgatgggaaggtgcatttggtggttttcaacaacctgcagctggcagacggaaggcggcacaggatcctcctgaggctgagcaatttgcagcgaggggccggctccctagagctctacctggactgcatccaggtggattccgttcacaatctccccagggcctttgctggcccctcccagaaacctgagaccattgaattgaggactttccagaggaagccacaggacttcttggaagagctgaagctggtggtgagaggctcactgttccaggtggccagcctgcaagactgcttcctgcagcagagtgagccactggctgccacaggcacaggggactttaaccggcagttcttgggtcaaatgacacaattaaaccaactcctgggagaggtgaaggaccttctgagacagcaggttaaggaaacatcatttttgcgaaacaccatagctgaatgccaggcttgcggtcctctcaagtttcagtctccgaccccaagcacggtggtgcccccggctccccctgcaccgccaacacgcccacctcgtcggtgtgactccaacccatgtttccgaggtgtccaatgtaccgacagtagagatggcttccagtgtgggccctgccccgagggctacacaggaaacgggatcacctgtattgatgttgatgagtgcaaataccatccctgctacccgggcgtgcactgcataaatttgtctcctggcttcagatgtgacgcctgcccagtgggcttcacagggcccatggtgcagggtgttgggatcagttttgccaagtcaaacaagcaggtctgcactgacattgatgagtgtcgaaatggagcgtgcgttcccaactcgatctgcgttaatactttgggatcttaccgctgtgggccttgtaagccggggtatactggtgatcagataaggggatgcaaagcggaaagaaactgcagaaacccagagctgaacccttgcagtgtgaatgcccagtgcattgaagagaggcagggggatgtgacatgtgtgtgtggagtcggttgggctggagatggctatatctgtggaaaggatgtggacatcgacagttaccccgacgaagaactgccatgctctgccaggaactgtaaaaaggacaactgcaaatatgtgccaaattctggccaagaagatgcagacagagatggcattggcgacgcttgtgacgaggatgctgacggagatgggatcctgaatgagcaggataactgtgtcctgattcataatgtggaccaaaggaacagcgataaagatatctttggggatgcctgtgataactgcctgagtgtcttaaataacgaccagaaagacaccgatggggatggaagaggagatgcctgtgatgatgacatggatggagatggaataaaaaacattctggacaactgcccaaaatttcccaatcgtgaccaacgggacaaggatggtgatggtgtgggggatgcctgtgacagttgtcctgatgtcagcaaccctaaccagtctgatgtggataatgatctggttggggactcctgtgacaccaatcaggacagtgatggagatgggcaccaggacagcacagacaactgccccaccgtcattaacagtgcccagctggacaccgataaggatggaattggtgacgagtgtgatgatgatgatgacaatgatggtatcccagacctggtgccccctggaccagacaactgccggctggtccccaacccagcccaggaggatagcaacagcgacggagtgggagacatctgtgagtctgactttgaccaggaccaggtcatcgatcggatcgacgtctgcccagagaacgcagaggtcaccctgaccgacttcagggcttaccagaccgtggtcctggatcctgaaggggatgcccagatcgatcccaactgggtggtcctgaaccagggcatggagattgtacagaccatgaacagtgatcctggcctggcagtggggtacacagcttttaatggagttgacttcgaagggaccttccatgtgaatacccagacagatgatgactatgcaggctttatctttggctaccaagatagctccagcttctacgtggtcatgtggaagcagacggagcagacatattggcaagccaccccattccgagcagttgcagaacctggcattcagctcaaggctgtgaagtctaagacaggtccaggggagcatctccggaactccctgtggcacacgggggacaccagtgaccaggtcaggctgctgtggaaggactccaggaatgtgggctggaaggacaaggtgtcctaccgctggttcctacagcacaggccccaggtgggctacatcagggtacgattttatgaaggctctgagttggtggctgactctggcgtcaccatagacaccacaatgcgtggaggccgacttggcgttttctgcttctctcaagaaaacatcatctggtccaacctcaagtatcgctgcaatgacaccatccctgaggacttccaagagtttcaaacccagaatttcgaccgcttcgataattaaaccaaggaagcaatctgtaactgcttttcggaacactaaaaccatatatattttaacttcaattttctttagcttttaccaacccaaatatatcaaaacgttttatgtgaatgtggcaataaaggagaagagatcattttt

SEQ ID NO: 21520 - DNA, 612 bp, Homo sapiens
  ENST00000515510
cagtctgatgtggataatgatctggttggggactcctgtgacaccaatcaggacagtggaattgttctgtggaagtgagttttgtgaaccctcctagctcaacacgatggagtcccacattaagactcaaggctggatcaactgatcagattctggaagaacatcaccaaaaacagacgtgtgtcactcagccctagcggcacctgcaacccaagttggttgaatctgcggatacggaaccgcggatacagaggcctgactgtactagctaagtgaacttaaacatatttcccagtctcttcacatctcaacttcttcatctgcaaagaggagataaataaatgcatcgcacaggttatggtgaaaaatcaagataatgtagagtaaccatgagaggtctcagactccaggacacctcttggaggcagggcagactcatcttcaggtggcccctcagcccagaaagtcaggtggacagagaaggagagttctgagaagtcctttagaccagcactgagcccggcctacacactctcctcgagaaggcgtggccctgttcactttgcccttctccccatggcgttcagtgatggagatgggcaccaggacagc

SEQ ID NO: 21521 - DNA, 853 bp, Homo sapiens
  ENST00000504720
ctcatatggtgcctgaggttttgagcttccttaaggttacttggccccttcaagactgttctgaactccctcaactctctctgcagggcatggagattgtacagaccatgaacagtgatcctggcctggcagtggggtacacagcttttaatggagttgacttcgaagggaccttccatgtgaatacccagacagatgatgactatgcaggctttatctttggctaccaagatagctccagcttctacgtggtcatgtggaagcagacggagcagacatattggcaagccaccccattccgagcagttgcagaacctggcattcagctcaaggctgtgaagtctaagacaggtccaggggagcatctccggaactccctgtggcacacgggggacaccagtgaccaggtcaggctgctgtggaaggactccaggaatgtgggctggaaggacaaggtgtcctaccgctggttcctacagcacaggccccaggtgggctacatcagggtacgattttatgaaggctctgagttggtggctgactctggcgtcaccatagacaccacaatgcgtggaggccgacttggcgttttctgcttctctcaagaaaacatcatctggtccaacctcaagtatcgctgcaatgacaccatccctgaggacttccaagagtttcaaacccagaatttcgaccgcttcgataattaaaccaaggaagcaatctgtaactgcttttcggaacactaaaaccatatatattttaacttcaattttctttagcttttaccaacccaaatatatcaaaacgttttatgtgaatgtggcaataaaggagaagagatcatttttaaaaa

SEQ ID NO: 21522 - DNA, 558 bp, Homo sapiens
  ENST00000511888
aagtttttaagcatggtatctagacaaggcaactcacatgacaataagacacaaaactttctcactcaagatagcaggtttggtttggtttgatttttaactcaagtttgatagtgtgaccaacatcatgttaggccttgtgagagacagaagttgggaagaaacaccccccacccccctccacacacacacggacacacacggtccctgccctcaaggacttccagtctagtaagtaagtggcaacagctacagtacaatccaggtcagcgaaaaatggagcctaaaacagagcaaagaaagacgcagggtacgattttatgaaggctctgagttggtggctgactctggcgtcaccatagacaccacaatgcgtggaggccgacttggcgttttctgcttctctcaagaaaacatcatctggtccaacctcaagtatcgctgcaatgacaccatccctgaggacttccaagagtttcaaacccagaatttcgaccgcttcgataattaaaccaaggaagcaatctgtaactgcttttcggaacactaaaaccatat

SEQ ID NO: 21523 - DNA, 532 bp, Homo sapiens
  ENST00000472720
agtgctgaggagccagagtcgccgccgggttgccagacgctggaatgggtggtcttccgacacacaccaccatctttcttgcgctcgggaagctcggggctcagcggctcccagaggttacggcggcggctctggcgagacgggaataggcaagtcaagaggctgaaaaatctgaagcatgtttccaaagagcaacctaacagtcacttgctgggtatggaggagcatgaggaagctctttctattgctttctctcttgctgtcccatgcagctcatttggaaggcaaaaaggataatcagttcatctggaaaccaggacttgccaagtagaagaaagcacttattggagagggggagtagagtcaagcaaataaacctgagatttttaggatcatttttataagtcttgaattcgttgatgatgttaacaaaaaagtccgtggggaaggtgtacaggagactgtggtcccggaggagtccagagtcgggcagtgtggtgttttcatgttgacgggtggacaagtcacctgt

SEQ ID NO: 21524 - DNA, 6111 bp, Homo sapiens
  ENST00000409968
agtgctgaggagccagagtcgccgccgggttgccagacgctggaatgggtggtcttccgacacacaccaccatctttcttgcgctcgggaagctcggggctcagcggctcccagaggttacggcggcggctctggcgagacgggaataggcaagtcaagaggctgaaaaatctgaagcatgtttccaaagagcaacctaacagtcacttgctgggtatggaggagcatgaggaagctctttctattgctttctctcttgctgtcccatgcagctcatttggaaggcaaaaaggataatcagttcatctggaaaccaggtccgtggggaaggtgtacaggagactgtggtcccggaggagtccagagtcgggcagtgtggtgttttcatgttgacgggtggacaagtcacctgtctaactgtggtgagagcaacaggcctccaaaggaaagaagttgtttccgagtttgtgactggcacagtgacctctttcagtgggaggtttctgactggcaccactgtgtgcttgttccttacgctcgcggtgaagtcaagcctcggactgcagagtgtgtgacggctcagcatggactgcagcaccggatggtgcgctgcattcagaagctgaaccgaactgtggttgcaaatgaaatatgcgaacactttgcccttcagcctcctacagaacaggcttgcctcattccttgtccccgggattgtgtagtatctgagttcttaccatggtccaactgtagcaagggatgtgggaagaaattgcagcatagaactcgcgcggtcatagctccccctctctttggtggtttgcaatgtccaaatctgactgagtcaagagcctgtgatgctcccatttcctgtcctcttggggaagaggaatatacatttagccttaaggttggaccatggagtaaatgcagactgcctcatcttaaagaaattaatccaagcggaagaactgttctggattttaactctgattcaaatgagcgagtcacctttaaacatcaaagttacaaagcacatcatcattcgaagtcttgggcaatagagataggttatcaaacccggcaggtttcgtgtacaagaagtgatggacaaaatgctatgttaagcctttgccttcaagattccttcccattgactgttcagtcctgcatcatgcccaaagactgtgaaacctcccagtggtcctcctggagcccctgctccaagacatgccgttcagggagtctcttgccaggatttaggagcaggagccggaacgtgaagcacatggctattggaggtggaaaggagtgtcctgaacttcttgagaaagaggcctgcattgttgaaggagaacttctgcagcaatgtcccaggtattcctggagaacttctgaatggaaagaatgccaagtctctctcctcctcgagcagcaggatccccactggcatgtgacgggacccgtgtgtggcggtgggatccagacccgggaggtgtactgtgcccagagcgtaccagcagctgccgcactgagggccaaggaagtctctagacctgtggaaaaggcattatgtgtgggacccgccccgttgccctctcagctctgcaatatcccttgctctacggactgcatagtatcttcctggtcagcctggggcctgtgcatccatgaaaactgtcatgatcctcaggggaaaaaaggatttagaacgaggcagcgccatgtcctcatggaatctacagggcctgcagggcattgccctcatttggtggagtctgttccttgtgaggatccaatgtgctaccgatggctggcatcagaagggatctgtttccctgatcatggaaaatgtggcctgggacatcgtattctgaaggccgtctgccagaatgaccgcggagaagatgtatcagggagtctttgcccagttccccctcctcctgagaggaagtcttgtgaaattccctgccgaatggactgtgtgctgagcgagtggacggagtggtcatcctgttcccagtcctgttcaaataaaaactcagatgggaaacagaccaggtcaagaactatcctggcactggctggggaaggtggaaagccatgtccccctagtcaggctctccaagagcatcgtttgtgtaatgaccattcctgtatgcagcttcactgggagacatcgccttggggcccttgttctgaggacacattggtaactgcccttaatgcaaccattggctggaatggagaagccacgtgtggtgtaggcattcagactcggagagtcttctgtgtcaagagtcacgtgggacaagtaatgaccaaaagatgtccagattctactcgacctgaaactgtgcgcccctgttttctcccatgcaaaaaagactgtattgtgactgctttcagtgagtggacaccctgcccaaggatgtgccaagcaggaaatgccacagtaaaacagtctcgatacagaatcatcatccaagaagcagccaatggaggccaggaatgcccagataccttatatgaggagagagagtgtgaagatgtttccttgtgtcctgtatatcggtggaagccacagaaatggagcccttgcatcttagtgccagagtctgtctggcagggaataacgggcagcagtgaagcctgtggaaaggggttacaaacaagagctgtctcatgcatctctgatgacaaccggtcagcagaaatgatggaatgcctcaagcagacaaacggcatgcctctccttgtgcaagaatgcacagtcccatgtcgagaagactgcaccttcactgcttggtccaagtttacgccctgctccacgaactgtgaagccacaaaaagtaggcggcgacagctcacagggaaaagcagaaagaaggagaaatgccaggattctgacctttaccctctagtggagacagaactatgtccttgtgatgaatttatatcccaaccttatggaaactggtcagattgcattcttccagaaggcagaagggagcctcaccgaggactgcgggtacaagcagacagcaaagaatgtggagaaggcctgcgctttcgagcagtagcctgttctgataaaaatggaagacctgttgacccctccttctgcagcagctctggttacattcaagaaaaatgtgtcattccctgcccatttgattgcaagttaagcgattggtctagttgggggtcttgcagttcatcttgtggaattggagtgagaattcgatccaaatggctaaaagaaaaaccttacaatggaggacgaccatgtcccaaactggatctcaagaatcaggtacatgaggcagtcccatgttacagtgagtgcaatcagtattcctgggttgtagaacactggtcttcatgcaaaatcaacaatgagctgaggtccctgcgctgtggaggaggaacacaatctaggaaaatcagatgtgtgaatactgcggatggtgaaggtggagcagtggatagcaacctgtgcaaccaggatgaaattcccccagaaacccagtcctgttctcttatgtgtcccaatgagtgtgtcatgtctgagtggggactttggagcaaatgcccacagtcatgcgatccccacacaatgcagagaagaactcgccacctgctaagaccatcactgaactcaaggacttgtgctgaagactcacaggtgcagccttgcctcctgaatgaaaattgcttccagttccagtacaatctaacagagtggagcacatgccagctgagtgaaaacgcaccctgtggtcaaggcgtcaggacccgcctgctaagctgtgtgtgcagtgatggcaagccagtcagcatggaccaatgtgagcagcataatttggagaagccccagagaatgagcattccctgcttggtggaatgcgtggtcaactgtcagctctcagggtggacggcttggacagagtgttcacagacctgtggccatggaggtcgaatgagccggactcgatttatcattatgccaacccaaggagaaggacggccatgccccacagagcttacccaggagaaaacctgcccagtgaccccctgctacagctgggtccttggcaactggtctgcatgtaaattggagggtggagactgtggggaaggagttcagatccgcagcctttcctgcatggtccacagtggttcaatatctcatgcagctggacgtgtcgaggatgcactgtgtggagaaatgccctttcaggacagcatcctgaagcagctgtgttctgtgccttgcccaggagactgccatttaacagaatggtcagagtggagcacatgtgaattaacctgcattgatggaagaagctttgagactgtgggccgccagtctagatcaaggacttttataattcagtcttttgagaaccaagacagctgcccccaacaggttctagaaacacgcccttgtacaggaggcaaatgttatcactacacatggaaagcaagtctttggaacaataacgaacgaactgtatggtgccagcgttcagatggcgttaatgtcacaggaggctgctcccctcaggcccgtcctgctgccattcggcagtgcattccagcctgcagaaaacctttctcctactgtacacagggtggagtctgtggttgtgagaagggctatacagagataatgaaatcaaatggtttcctggattactgcatgaaagtaccaggctcagaggataaaaaagctgatgtgaaaaacctttctgggaaaaacagacctgtgaattcaaaaatacatgatatttttaaaggatggtctcttcaaccacttgatccagatggccgagtaaaaatttgggtttatggcgtttcaggtggcgcttttctcatcatgattttcctaatatttacttcctaccttgtttgcaagaagccaaaaccacatcaaagcacacctccccaacagaagcctctgaccttagcctacgatggagacttagacatgtaatctgaaaaagaaatccaaatgtagacatcaactgccttaaccgctttctcttttgtagctctcagacttctcagttttttgaggaatctcaagatgtgatatattgggcagaatacaaatattgcaaaagtaatattgcctcaacttcatttggacatggagtcaaggattattaggtctgccattttgttttcaagttgtttgtgggtgtgttttatttttttggttttcccaagggacctgaaaacccttctcttcctgtttggaactgggaggaagaaaacatgatggaattcccacagacttgagtaaacttgatcttcagcagcataatgacaatccagaggaaaatacagtcaaggcatttactctaaatgacgagtctgacactgcattgttacgcactatattagtgcaaagtctttattcttcccatacttcaacactgagttttctagagtttactttggtttaaagactttcaaattggattgcctatttttcatgaacacagagagaatggattaccatttcagaaattctctgagtttttaacctttaaatattgtattttgttttgtagccaggggatgatggcgcttcatgggttgcagctactgaaaatagcagcgtgtgtgtaattgctggactagatgaaagctaggtcatttctgaagggaatgtgtactgaatgttagagtgtacaaatgaaatatgtggttaaattggagaatgaggtagattatttgattactaaaactgtattttaacaaaaacttatccatgtagatatagcattaaccacacacagttgtaattcagtttaatgatgacaaactctgcttttgtaatttcaattttcttatctgaatatttataaattcttctttcaaatttaattatctgacctcatttaatatacatcaaacaccgatcctgtttgtacaaagtcttgcttttataaggtttcaataatatctaaaacaacacattaaaaagctgagaccattttatgaagataattgtttgtaatcataggtgttgaaagtaaaaaggtgccatcttgtggtattgacttgtatttataacaaataaactgctcaagagactgc

SEQ ID NO: 21525 - DNA, 563 bp, Homo sapiens
  ENST00000485379
ggccacttgggtagaggcttagctcttgctttgctctgtgcttgctgaatgaacttggagaaaccacccaaagtcttgggagcttagtttttcagtaaaattgatgaattaaactaaatcagctctgaagctcactctagctccgaaagtcctgttgactgttggaacatagaaatatcctgtgtttttactcttctctggaagatatgacttgctaagtggtctgaagctgtctctagacctgtggaaaaggcattatgtgtgggacccgccccgttgccctctcagctctgcaatatcccttgctctacggactgcatagtatcttcctggtcagcctggggcctgtgcatccatgaaaactgtcatgatcctcaggggaaaaaaggatttagaacgaggcagcgccatgtcctcatggaatctacagggcctgcagggcattgccctcatttggtggagtctgttccttgtgaggatccaatgtgctaccgatggctggcatcagaagggatctgtttccctgatcatggaaaatgtggcctgggacatcgtattctgaa

SEQ ID NO: 21526 - DNA, 531 bp, Homo sapiens
  ENST00000480352
gtttgtactttgaagactaaaagaagtagaagacagaatttcagatcctttaagcattgtgaaaacctagatagcctgtgtctctgtggaactctaaatgaaaatgacagaaaaactaaaagtgagataggacagagttcagtctattaaaatgaagacttacatgtataaggcaacattctgttcttcaggtccctttccaagccaaactaactgaaaagctgacacctcccttatcattttaggtcgaatgagccggactcgatttatcattatgccaacccaaggagaaggacggccatgccccacagagcttacccaggagaaaacctgcccagtgaccccctgctacagctgggtccttggcaactggtctgcatgtaaattggagggtggagactgtggggaaggagttcagatccgcagcctttcctgcatggtccacagtggttcaatatctcatgcagctggacgtgtcgaggatgcactgtgtggagaaatgccctttcaggacagcatcctgaagcagct

SEQ ID NO: 21527 - DNA, 5846 bp, Homo sapiens
  ENST00000413152
atgcataacacagcagatgaggtggttttgtatcacaaattagcaggtccgtggggaaggtgtacaggagactgtggtcccggaggagtccagagtcgggcagtgtggtgttttcatgttgacgggtggacaagtcacctgtctaactgtggtgagagcaacaggcctccaaaggaaagaagttgtttccgagtttgtgactggcacagtgacctctttcagtgggaggtttctgactggcaccactgtgtgcttgttccttacgctcgcggtgaagtcaagcctcggactgcagagtgtgtgacggctcagcatggactgcagcaccggatggtgcgctgcattcagaagctgaaccgaactgtggttgcaaatgaaatatgcgaacactttgcccttcagcctcctacagaacaggcttgcctcattccttgtccccgggattgtgtagtatctgagttcttaccatggtccaactgtagcaagggatgtgggaagaaattgcagcatagaactcgcgcggtcatagctccccctctctttggtggtttgcaatgtccaaatctgactgagtcaagagcctgtgatgctcccatttcctgtcctcttggggaagaggaatatacatttagccttaaggttggaccatggagtaaatgcagactgcctcatcttaaagaaattaatccaagcggaagaactgttctggattttaactctgattcaaatgagcgagtcacctttaaacatcaaagttacaaagcacatcatcattcgaagtcttgggcaatagagataggttatcaaacccggcaggtttcgtgtacaagaagtgatggacaaaatgctatgttaagcctttgccttcaagattccttcccattgactgttcagtcctgcatcatgcccaaagactgtgaaacctcccagtggtcctcctggagcccctgctccaagacatgccgttcagggagtctcttgccaggatttaggagcaggagccggaacgtgaagcacatggctattggaggtggaaaggagtgtcctgaacttcttgagaaagaggcctgcattgttgaaggagaacttctgcagcaatgtcccaggtattcctggagaacttctgaatggaaagaatgccaagtctctctcctcctcgagcagcaggatccccactggcatgtgacgggacccgtgtgtggcggtgggatccagacccgggaggtgtactgtgcccagagcgtaccagcagctgccgcactgagggccaaggaagtctctagacctgtggaaaaggcattatgtgtgggacccgccccgttgccctctcagctctgcaatatcccttgctctacggactgcatagtatcttcctggtcagcctggggcctgtgcatccatgaaaactgtcatgatcctcaggggaaaaaaggatttagaacgaggcagcgccatgtcctcatggaatctacagggcctgcagggcattgccctcatttggtggagtctgttccttgtgaggatccaatgtgctaccgatggctggcatcagaagggatctgtttccctgatcatggaaaatgtggcctgggacatcgtattctgaaggccgtctgccagaatgaccgcggagaagatgtatcagggagtctttgcccagttccccctcctcctgagaggaagtcttgtgaaattccctgccgaatggactgtgtgctgagcgagtggacggagtggtcatcctgttcccagtcctgttcaaataaaaactcagatgggaaacagaccaggtcaagaactatcctggcactggctggggaaggtggaaagccatgtccccctagtcaggctctccaagagcatcgtttgtgtaatgaccattcctgtatgcagcttcactgggagacatcgccttggggcccttgttctgaggacacattggtaactgcccttaatgcaaccattggctggaatggagaagccacgtgtggtgtaggcattcagactcggagagtcttctgtgtcaagagtcacgtgggacaagtaatgaccaaaagatgtccagattctactcgacctgaaactgtgcgcccctgttttctcccatgcaaaaaagactgtattgtgactgctttcagtgagtggacaccctgcccaaggatgtgccaagcaggaaatgccacagtaaaacagtctcgatacagaatcatcatccaagaagcagccaatggaggccaggaatgcccagataccttatatgaggagagagagtgtgaagatgtttccttgtgtcctgtatatcggtggaagccacagaaatggagcccttgcatcttagtgccagagtctgtctggcagggaataacgggcagcagtgaagcctgtggaaaggggttacaaacaagagctgtctcatgcatctctgatgacaaccggtcagcagaaatgatggaatgcctcaagcagacaaacggcatgcctctccttgtgcaagaatgcacagtcccatgtcgagaagactgcaccttcactgcttggtccaagtttacgccctgctccacgaactgtgaagccacaaaaagtaggcggcgacagctcacagggaaaagcagaaagaaggagaaatgccaggattctgacctttaccctctagtggagacagaactatgtccttgtgatgaatttatatcccaaccttatggaaactggtcagattgcattcttccagaaggcagaagggagcctcaccgaggactgcgggtacaagcagacagcaaagaatgtggagaaggcctgcgctttcgagcagtagcctgttctgataaaaatggaagacctgttgacccctccttctgcagcagctctggttacattcaagaaaaatgtgtcattccctgcccatttgattgcaagttaagcgattggtctagttgggggtcttgcagttcatcttgtggaattggagtgagaattcgatccaaatggctaaaagaaaaaccttacaatggaggacgaccatgtcccaaactggatctcaagaatcaggctcaggtacatgaggcagtcccatgttacagtgagtgcaatcagtattcctgggttgtagaacactggtcttcatgcaaaatcaacaatgagctgaggtccctgcgctgtggaggaggaacacaatctaggaaaatcagatgtgtgaatactgcggatggtgaaggtggagcagtggatagcaacctgtgcaaccaggatgaaattcccccagaaacccagtcctgttctcttatgtgtcccaatgagtgtgtcatgtctgagtggggactttggagcaaatgcccacagtcatgcgatccccacacaatgcagagaagaactcgccacctgctaagaccatcactgaactcaaggacttgtgctgaagactcacaggtgcagccttgcctcctgaatgaaaattgcttccagttccagtacaatctaacagagtggagcacatgccagctgagtgaaaacgcaccctgtggtcaaggcgtcaggacccgcctgctaagctgtgtgtgcagtgatggcaagccagtcagcatggaccaatgtgagcagcataatttggagaagccccagagaatgagcattccctgcttggtggaatgcgtggtcaactgtcagctctcagggtggacggcttggacagagtgttcacagacctgtggccatggaggtcgaatgagccggactcgatttatcattatgccaacccaaggagaaggacggccatgccccacagagcttacccaggagaaaacctgcccagtgaccccctgctacagctgggtccttggcaactggtctgcatgtaaattggagggtggagactgtggggaaggagttcagatccgcagcctttcctgcatggtccacagtggttcaatatctcatgcagctggacgtgtcgaggatgcactgtgtggagaaatgccctttcaggacagcatcctgaagcagctgtgttctgtgccttgcccaggagactgccatttaacagaatggtcagagtggagcacatgtgaattaacctgcattgatggaagaagctttgagactgtgggccgccagtctagatcaaggacttttataattcagtcttttgagaaccaagacagctgcccccaacaggttctagaaacacgcccttgtacaggaggcaaatgttatcactacacatggaaagcaagtctttggaacaataacgaacgaactgtatggtgccagcgttcagatggcgttaatgtcacaggaggctgctcccctcaggcccgtcctgctgccattcggcagtgcattccagcctgcagaaaacctttctcctactgtacacagggtggagtctgtggttgtgagaagggctatacagagataatgaaatcaaatggtttcctggattactgcatgaaagtaccaggctcagaggataaaaaagctgatgtgaaaaacctttctgggaaaaacagacctgtgaattcaaaaatacatgatatttttaaaggatggtctcttcaaccacttgatccagatggccgagtaaaaatttgggtttatggcgtttcaggtggcgcttttctcatcatgattttcctaatatttacttcctaccttgtttgcaagaagccaaaaccacatcaaagcacacctccccaacagaagcctctgaccttagcctacgatggagacttagacatgtaatctgaaaaagaaatccaaatgtagacatcaactgccttaaccgctttctcttttgtagctctcagacttctcagttttttgaggaatctcaagatgtgatatattgggcagaatacaaatattgcaaaagtaatattgcctcaacttcatttggacatggagtcaaggattattaggtctgccattttgttttcaagttgtttgtgggtgtgttttatttttttggttttcccaagggacctgaaaacccttctcttcctgtttggaactgggaggaagaaaacatgatggaattcccacagacttgagtaaacttgatcttcagcagcataatgacaatccagaggaaaatacagtcaaggcatttactctaaatgacgagtctgacactgcattgttacgcactatattagtgcaaagtctttattcttcccatacttcaacactgagttttctagagtttactttggtttaaagactttcaaattggattgcctatttttcatgaacacagagagaatggattaccatttcagaaattctctgagtttttaacctttaaatattgtattttgttttgtagccaggggatgatggcgcttcatgggttgcagctactgaaaatagcagcgtgtgtgtaattgctggactagatgaaagctaggtcatttctgaagggaatgtgtactgaatgttagagtgtacaaatgaaatatgtggttaaattggagaatgaggtagattatttgattactaaaactgtattttaacaaaaacttatccatgtagatatagcattaaccacacacagttgtaattcagtttaatgatgacaaactctgcttttgtaatttcaattttcttatctgaatatttataaattcttctttcaaatttaattatctgacctcatttaatatacatcaaacaccgatcctgtttgtacaaagtcttgcttttataaggtttcaataatatctaaaacaacacattaaaaagctgagaccattttatgaagataattgtttgtaatcataggtgttgaaagtaaaaaggtgccatcttgtggtattgacttgtatttataacaaataaactgctcaagagactgc

SEQ ID NO: 21528 - DNA, 5939 bp, Homo sapiens
  ENST00000272643
atgtttccaaagagcaacctaacagtcacttgctgggtatggaggagcatgaggaagctctttctattgctttctctcttgctgtcccatgcagctcatttggaaggcaaaaaggataatcagttcatctggaaaccaggtccgtggggaaggtgtacaggagactgtggtcccggaggagtccagagtcgggcagtgtggtgttttcatgttgacgggtggacaagtcacctgtctaactgtggtgagagcaacaggcctccaaaggaaagaagttgtttccgagtttgtgactggcacagtgacctctttcagtgggaggtttctgactggcaccactgtgtgcttgttccttacgctcgcggtgaagtcaagcctcggactgcagagtgtgtgacggctcagcatggactgcagcaccggatggtgcgctgcattcagaagctgaaccgaactgtggttgcaaatgaaatatgcgaacactttgcccttcagcctcctacagaacaggcttgcctcattccttgtccccgggattgtgtagtatctgagttcttaccatggtccaactgtagcaagggatgtgggaagaaattgcagcatagaactcgcgcggtcatagctccccctctctttggtggtttgcaatgtccaaatctgactgagtcaagagcctgtgatgctcccatttcctgtcctcttggggaagaggaatatacatttagccttaaggttggaccatggagtaaatgcagactgcctcatcttaaagaaattaatccaagcggaagaactgttctggattttaactctgattcaaatgagcgagtcacctttaaacatcaaagttacaaagcacatcatcattcgaagtcttgggcaatagagataggttatcaaacccggcaggtttcgtgtacaagaagtgatggacaaaatgctatgttaagcctttgccttcaagattccttcccattgactgttcagtcctgcatcatgcccaaagactgtgaaacctcccagtggtcctcctggagcccctgctccaagacatgccgttcagggagtctcttgccaggatttaggagcaggagccggaacgtgaagcacatggctattggaggtggaaaggagtgtcctgaacttcttgagaaagaggcctgcattgttgaaggagaacttctgcagcaatgtcccaggtattcctggagaacttctgaatggaaagaatgccaagtctctctcctcctcgagcagcaggatccccactggcatgtgacgggacccgtgtgtggcggtgggatccagacccgggaggtgtactgtgcccagagcgtaccagcagctgccgcactgagggccaaggaagtctctagacctgtggaaaaggcattatgtgtgggacccgccccgttgccctctcagctctgcaatatcccttgctctacggactgcatagtatcttcctggtcagcctggggcctgtgcatccatgaaaactgtcatgatcctcaggggaaaaaaggatttagaacgaggcagcgccatgtcctcatggaatctacagggcctgcagggcattgccctcatttggtggagtctgttccttgtgaggatccaatgtgctaccgatggctggcatcagaagggatctgtttccctgatcatggaaaatgtggcctgggacatcgtattctgaaggccgtctgccagaatgaccgcggagaagatgtatcagggagtctttgcccagttccccctcctcctgagaggaagtcttgtgaaattccctgccgaatggactgtgtgctgagcgagtggacggagtggtcatcctgttcccagtcctgttcaaataaaaactcagatgggaaacagaccaggtcaagaactatcctggcactggctggggaaggtggaaagccatgtccccctagtcaggctctccaagagcatcgtttgtgtaatgaccattcctgtatgcagcttcactgggagacatcgccttggggcccttgttctgaggacacattggtaactgcccttaatgcaaccattggctggaatggagaagccacgtgtggtgtaggcattcagactcggagagtcttctgtgtcaagagtcacgtgggacaagtaatgaccaaaagatgtccagattctactcgacctgaaactgtgcgcccctgttttctcccatgcaaaaaagactgtattgtgactgctttcagtgagtggacaccctgcccaaggatgtgccaagcaggaaatgccacagtaaaacagtctcgatacagaatcatcatccaagaagcagccaatggaggccaggaatgcccagataccttatatgaggagagagagtgtgaagatgtttccttgtgtcctgtatatcggtggaagccacagaaatggagcccttgcatcttagtgccagagtctgtctggcagggaataacgggcagcagtgaagcctgtggaaaggggttacaaacaagagctgtctcatgcatctctgatgacaaccggtcagcagaaatgatggaatgcctcaagcagacaaacggcatgcctctccttgtgcaagaatgcacagtcccatgtcgagaagactgcaccttcactgcttggtccaagtttacgccctgctccacgaactgtgaagccacaaaaagtaggcggcgacagctcacagggaaaagcagaaagaaggagaaatgccaggattctgacctttaccctctagtggagacagaactatgtccttgtgatgaatttatatcccaaccttatggaaactggtcagattgcattcttccagaaggcagaagggagcctcaccgaggactgcgggtacaagcagacagcaaagaatgtggagaaggcctgcgctttcgagcagtagcctgttctgataaaaatggaagacctgttgacccctccttctgcagcagctctggttacattcaagaaaaatgtgtcattccctgcccatttgattgcaagttaagcgattggtctagttgggggtcttgcagttcatcttgtggaattggagtgagaattcgatccaaatggctaaaagaaaaaccttacaatggaggacgaccatgtcccaaactggatctcaagaatcagggacaggtacatgaggcagtcccatgttacagtgagtgcaatcagtattcctgggttgtagaacactggtcttcatgcaaaatcaacaatgagctgaggtccctgcgctgtggaggaggaacacaatctaggaaaatcagatgtgtgaatactgcggatggtgaaggtggagcagtggatagcaacctgtgcaaccaggatgaaattcccccagaaacccagtcctgttctcttatgtgtcccaatgagtgtgtcatgtctgagtggggactttggagcaaatgcccacagtcatgcgatccccacacaatgcagagaagaactcgccacctgctaagaccatcactgaactcaaggacttgtgctgaagactcacaggtgcagccttgcctcctgaatgaaaattgcttccagttccagtacaatctaacagagtggagcacatgccagctgagtgaaaacgcaccctgtggtcaaggcgtcaggacccgcctgctaagctgtgtgtgcagtgatggcaagccagtcagcatggaccaatgtgagcagcataatttggagaagccccagagaatgagcattccctgcttggtggaatgcgtggtcaactgtcagctctcagggtggacggcttggacagagtgttcacagacctgtggccatggaggtcgaatgagccggactcgatttatcattatgccaacccaaggagaaggacggccatgccccacagagcttacccaggagaaaacctgcccagtgaccccctgctacagctgggtccttggcaactggtctgcatgtaaattggagggtggagactgtggggaaggagttcagatccgcagcctttcctgcatggtccacagtggttcaatatctcatgcagctggacgtgtcgaggatgcactgtgtggagaaatgccctttcaggacagcatcctgaagcagctgtgttctgtgccttgcccaggagactgccatttaacagaatggtcagagtggagcacatgtgaattaacctgcattgatggaagaagctttgagactgtgggccgccagtctagatcaaggacttttataattcagtcttttgagaaccaagacagctgcccccaacaggttctagaaacacgcccttgtacaggaggcaaatgttatcactacacatggaaagcaagtctttggaacaataacgaacgaactgtatggtgccagcgttcagatggcgttaatgtcacaggaggctgctcccctcaggcccgtcctgctgccattcggcagtgcattccagcctgcagaaaacctttctcctactgtacacagggtggagtctgtggttgtgagaagggctatacagagataatgaaatcaaatggtttcctggattactgcatgaaagtaccaggctcagaggataaaaaagctgatgtgaaaaacctttctgggaaaaacagacctgtgaattcaaaaatacatgatatttttaaaggatggtctcttcaaccacttgatccagatggccgagtaaaaatttgggtttatggcgtttcaggtggcgcttttctcatcatgattttcctaatatttacttcctaccttgtttgcaagaagccaaaaccacatcaaagcacacctccccaacagaagcctctgaccttagcctacgatggagacttagacatgtaatctgaaaaagaaatccaaatgtagacatcaactgccttaaccgctttctcttttgtagctctcagacttctcagttttttgaggaatctcaagatgtgatatattgggcagaatacaaatattgcaaaagtaatattgcctcaacttcatttggacatggagtcaaggattattaggtctgccattttgttttcaagttgtttgtgggtgtgttttatttttttggttttcccaagggacctgaaaacccttctcttcctgtttggaactgggaggaagaaaacatgatggaattcccacagacttgagtaaacttgatcttcagcagcataatgacaatccagaggaaaatacagtcaaggcatttactctaaatgacgagtctgacactgcattgttacgcactatattagtgcaaagtctttattcttcccatacttcaacactgagttttctagagtttactttggtttaaagactttcaaattggattgcctatttttcatgaacacagagagaatggattaccatttcagaaattctctgagtttttaacctttaaatattgtattttgttttgtagccaggggatgatggcgcttcatgggttgcagctactgaaaatagcagcgtgtgtgtaattgctggactagatgaaagctaggtcatttctgaagggaatgtgtactgaatgttagagtgtacaaatgaaatatgtggttaaattggagaatgaggtagattatttgattactaaaactgtattttaacaaaaacttatccatgtagatatagcattaaccacacacagttgtaattcagtttaatgatgacaaactctgcttttgtaatttcaattttcttatctgaatatttataaattcttctttcaaatttaattatctgacctcatttaatatacatcaaacaccgatcctgtttgtacaaagtcttgcttttataaggtttcaataatatctaaaacaacacattaaaaagctgagaccattttatgaagataattgtttgtaatcataggtgttgaaagtaaaaaggtgccatcttgtggtattgacttgtatttataacaaataaactgctcaagagactgc

SEQ ID NO: 21529 - DNA, 893 bp, Homo sapiens
  ENST00000392595
cctaattagcaaggataacaagaatcgtccgcactaaagtcccctgcagcgtgaccatgtcgagaccccggaagaggctggctgggacttctggttcagacaagggactatcaggaaaacgcaccaaaactgagaactcaggtgaggcattagctaaagtggaggactccaaccctcagaagacttcagccactaaaaactgtttgaagaatctaagcagccactggctgatgaagtcagagccagagagccgcctagagaaaggtgtagatgtgaagttcagcattgaggatctcaaagcacagcccaaacagacaacatgctgggatggtgttcgtaactaccaggctcggaacttccttagagccatgaagctgggagaagaagccttcttctaccatagcaactgcaaagagccaggcatcgcaggactcatgaagatcgtgaaagaggcttacccagaccacacacagtttgagaaaaacaatccccattatgacccatctagcaaagaggacaaccctaagtggtccatggtggatgtacagtttgttcggatgatgaaacgtttcattcccctggctgagctcaaatcctatcatcaagctcacaaagctactggtggccccttaaaaaatatggttctcttcactcgccagagattatcaatccagcccctgacccaggaagagtttgattttgttttgagcctggaggaaaaggaaccaagttaactgagatactgctgctggaatgggcgagacattgctgcaaagaagtcaagcttttttcagacaaaaggtgtgagggggcttgcttggtatgcttacctgggcttgtgtacctcagtggtttttgtgtacttttttcaataaaatatcaaagttgaagaa

SEQ ID NO: 21530 - DNA, 1299 bp, Homo sapiens
  ENST00000341541
tgcggcgcagcggaggcggaccgcagtcgagtctgcagagtgttgggtctgtagccagcaaattacttcatcatctagattatccattcagttgatcctaattagcaaggataacaaggtaacacaaggcttacttatattcacccaacaaaagtgtctctgtggagccacttcccagtgaactacatactgagataggggttcctggatgagaaggaccaaggacagaaccgagaagagtttaggggcaggttatgcgagatggaaatggcgcagataacggagggaaggatttgagggctcaaacgtaggcgtctgtgtttcgcaaaagttggagacgttctaggctgcctctcgttgcctccatctcgctctgcgcgggttttggaggacattagcattctttcttgtatctccgttgattccagaatcgtccgcactaaagtcccctgcagcgtgaccatgtcgagaccccggaagaggctggctgggacttctggttcagacaagggactatcaggaaaacgcaccaaaactgagaactcaggtgaggcattagctaaagtggaggactccaaccctcagaagacttcagccactaaaaactgtttgaagaatctaagcagccactggctgatgaagtcagagccagagagccgcctagagaaaggtgtagatgtgaagttcagcattgaggatctcaaagcacagcccaaacagacaacatgctgggatggtgttcgtaactaccaggctcggaacttccttagagccatgaagctgggagaagaagccttcttctaccatagcaactgcaaagagccaggcatcgcaggactcatgaagatcgtgaaagaggcttacccagaccacacacagtttgagaaaaacaatccccattatgacccatctagcaaagaggacaaccctaagtggtccatggtggatgtacagtttgttcggatgatgaaacgtttcattcccctggctgagctcaaatcctatcatcaagctcacaaagctactggtggccccttaaaaaatatggttctcttcactcgccagagattatcaatccagcccctgacccaggaagagtttgattttgttttgagcctggaggaaaaggaaccaagttaactgagatactgctgctggaatgggcgagacattgctgcaaagaagtcaagcttttttcagacaaaaggtgtgagggggcttgcttggtatgcttacctgggcttgtgtacctcagtggtttttgtgtacttttttcaataaaatatcaaagttgaagaa

SEQ ID NO: 21531 - DNA, 943 bp, Homo sapiens
  ENST00000392594
cgccgcgggggtcgcgctgcacagcctgcggcgcagcggaggcggaccgcagtcgagtctgcagagtgttggaatcgtccgcactaaagtcccctgcagcgtgaccatgtcgagaccccggaagaggctggctgggacttctggttcagacaagggactatcaggaaaacgcaccaaaactgagaactcaggtgaggcattagctaaagtggaggactccaaccctcagaagacttcagccactaaaaactgtttgaagaatctaagcagccactggctgatgaagtcagagccagagagccgcctagagaaaggtgtagatgtgaagttcagcattgaggatctcaaagcacagcccaaacagacaacatgctgggatggtgttcgtaactaccaggctcggaacttccttagagccatgaagctgggagaagaagccttcttctaccatagcaactgcaaagagccaggcatcgcaggactcatgaagatcgtgaaagaggcttacccagaccacacacagtttgagaaaaacaatccccattatgacccatctagcaaagaggacaaccctaagtggtccatggtggatgtacagtttgttcggatgatgaaacgtttcattcccctggctgagctcaaatcctatcatcaagctcacaaagctactggtggccccttaaaaaatatggttctcttcactcgccagagattatcaatccagcccctgacccaggaagagtttgattttgttttgagcctggaggaaaaggaaccaagttaactgagatactgctgctggaatgggcgagacattgctgcaaagaagtcaagcttttttcagacaaaaggtgtgagggggcttgcttggtatgcttacctgggcttgtgtacctcagtggtttttgtgtacttttttcaataaaatatcaaagttgaagaa

SEQ ID NO: 21532 - DNA, 835 bp, Homo sapiens
  ENST00000352327
acagcctgcggcgcagcggaggcggaccgcagtcgagtctgcagagtgttgggtctgtagccagcaaattacttcatcatctagattatccattcagttgatcctaattagcaaggataacaagaatcgtccgcactaaagtcccctgcagcgtgaccatgtcgagaccccggaagaggctggctgggacttctggttcagacaagggactatcaggaaaacgcaccaaaactgagaactcaggtgaggcattagctaaagtggaggactccaaccctcagaagacttcagccactaaaaactgtttgaagaatctaagcagccactggctgatgaagtcagagccagagagccgcctagagaaaggtgtagatgtgaagttcagcattgaggatctcaaagcacagcccaaacagacaacatgctgggatggtgttcgtaactaccaggctcggaacttccttagagccatgaagctgggagaagaagccttcttctaccatagcaactgcaaagagccaggcatcgcaggactcatgaagatcgtgaaagaggcttacccagaccacacacagtttgagaaaaacaatccccattatgacccatctagcaaagaggacaaccctaagtggtccatgaagagtttgattttgttttgagcctggaggaaaaggaaccaagttaactgagatactgctgctggaatgggcgagacattgctgcaaagaagtcaagcttttttcagacaaaaggtgtgagggggcttgcttggtatgcttacctgggcttgtgtacctcagtggtttttgtgtacttttttcaataaaatatcaaa

SEQ ID NO: 21533 - DNA, 926 bp, Homo sapiens
  ENST00000531135
tgcacagcctgcggcgcagcggaggcggaccgcagtcgagtctgcagagtgttgggtctgtagccagcaaattacttcatcatctagattatccattcagttgatcctaattagcaaggataacaagaatcgtccgcactaaagtcccctgcagcgtgaccatgtcgagaccccggaagaggctggctgggacttctggttcagacaagggactatcaggaaaacgcaccaaaactgagaactcaggtgaggcattagctaaagtggaggactccaaccctcagaagacttcagccactaaaaactgtttgaagaatctaagcagccactggctgatgaagtcagagccagagagccgcctagagaaaggtgtagatgtgaagttcagcattgaggatctcaaagcacagcccaaacagacaacatgctgggatggtgttcgtaactaccaggctcggaacttccttagagccatgaagctgggagaagaagccttcttctaccatagcaactgcaaagagccaggcatcgcaggactcatgaagatcgtgaaagaggcttacccagaccacacacagtttgagaaaaacaatccccattatgacccatctagcaaagaggacaaccctaagtggtccatggtaaagactatgctttctatttcatgacaggggaaggatgaaccaggggaagaagacggttggggtgactgtaggtcaaggtacacggcccagcacttactcagatgaggtgatactgagataggagcttcctgtgggcggttaaaaatacagtgggcacagtcagcctagacacgtctttctgtcatgtacactgttgtcacataggtggatgtacagtttgttcggatgatgaaacgtttcattcccctggctgagctcaaatcctatcatcaagctcacaaa

SEQ ID NO: 21534 - DNA, 1074 bp, Homo sapiens
  ENST00000533975
agcctgcggcgcagcggaggcggaccgcagtcgagtctgcagagtgttgggtctgtagccagcaaattacttcatcatctagattatccattcagttgatcctaattagcaaggataacaaggtaacacaaggcttacttatattcacccaacaaaagtgtctctgtggagccacttcccagtgaactacatactgagataggggttcctggatgagaaggaccaaggacagaaccgagaagagtttaggggcaggttatgcgagatggaaatggcgcagataacggagggaaggatttgagggctcaaacgtaggcgtctgtgtttcgcaaaagttggagacgttctaggctgcctctcgttgcctccatctcgctctgcgcgggttttggaggacattagcattctttcttgtatctccgttgattccagaatcgtccgcactaaagtcccctgcagcgtgaccatgtcgagaccccggaagaggctggctgggacttctggttcagacaagggactatcaggaaaacgcaccaaaactgagaactcaggtgaggcattagctaaagtggaggactccaaccctcagaagacttcagccactaaaaactgtttgaagaatctaagcagccactggctgatgaagtcagagccagagagccgcctagagaaaggtgtagatgtgaagttcagcattgaggatctcaaagcacagcccaaacagacaacatgctgggatggtgttcgtaactaccaggctcggaacttccttagagccatgaagctgggagaagaagccttcttctaccatagcaactgcaaagagccaggcatcgcaggactcatgaagatcgtgaaagaggcttacccagaccacacacagtttgagaaaaacaatccccattatgacccatctagcaaagaggacaaccctaagtggtccatggtaaagactatgctttctatttcatgacaggggaaggatgaaccaggggaagaagacggttggggtgactgtaggtcaaggtacacggcccagcacttactcagatgaggtgatactgagataggagc

SEQ ID NO: 21535 - DNA, 745 bp, Homo sapiens
  ENST00000533781
caggagccacagtgagcaagaaggaaagacgtatgagatgagaataataatgcttttattatgcacttattgtaatgccaggcattgtctaggccctttgtattacctcatttaagcttcaaaatagttgcaagtaggtgctcagtttcctctttcctatgcaaaggcatagaagagagagtgaggaaaggaaaacatgtattgactactgtccggacctttaatcctgaacaaccctgtaaggtgttcttaccctattgaatagataatccagaagataccctgtaaggtaggtattcttgtctaatttttatagataaggaaagcttcttaacagtaagattaagttcctacagctggtaatggatccatgatttgaatccaggtctgactccaaagctaagctttttccattatgaaacattgcctttaacaagcatgatcttttctttttgcttctcctattgcagacaagggactatcaggaaaacgcaccaaaactgagaactcaggtgaggcattagctaaagtggaggactccaaccctcagaagacttcagccactaaaaactgtttgaagaatctaagcagccactggctgatgaagtcagagccagagagccgcctagagaaaggtgtagatgtgaagcattgaggatctcaaagcacagcccaaacagacaacatgctgggatggtgttcgtaactaccaggctcggaacttccttagagccatgaagctggg

SEQ ID NO: 21536 - DNA, 377 bp, Homo sapiens
  ENST00000525677
tgggtctgtagccagcaaattacttcatcatctagattatccattcagttgatcctaattagcaaggataacaagaatcgtccgcactaaagtcccctgcagcgtgaccatgtcgagaccccggaagaggctggctgggacttctggttcaggcacattctgattgtcttgggatgaaatcgaatcatcaccatttttctacaatgtcctgaatgaactgtttctttcaacttttattggcaccttcaaggagcagaaaggagatgggccaggagccacagtgagcaagaaggaaagacacaagggactatcaggaaaacgcaccaaaactgagaactcaggtgaggcattagctaaagtggaggactccaaccctc

SEQ ID NO: 21537 - DNA, 4603 bp, Homo sapiens
  ENST00000266085
gcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccatacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttaggaaaacaaaaatgaaaaactactccatttgaggattgtaattcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacatttttttttcattttaattaaaatttgaaattctgaacaccgtcagcaccctctcttccctatcatgggtcatctgacccctgtccgtctccttgtccctgcttcatgtttgggggcctttctttaactgccttcctggcttagctcagatggcagatgagagtgtagtcaagggcctgggcacaggagggagagctgcagagtgtcctgcctgccttggctggagggacacctctcctgggtgtggagacagcttggttccctttccctagctccctggtgggtgaatgccacctcctgagatcctcacctcttggaattaaaattgttggtcactggggaaagcctgagtttgcaaccagttgtagggtttctgttgtgtttttttttttttttttgaaataaaactataatataaattctcctattaaataaaattattttaagttttagtgtcaaaagtgagatgctgagagtaggtgataatgtatattttacagagtgggggttggcaggatggtgacattgaacatgattgctctctgtctcttttttcagcttatgggtatttatcttctattagtatttgtatcttcagttcattccactttaggaaacagagctgccaattgaaacagaagaagaaaaaaaaaaaaagcagcagacaacacactgtagagtcttgcacacacacaagtgcccaggcaaggtgcttggcagaaccgcagagtgggaagagagtaccggcatcgggtttccttgggatcaatttcattaccgtgtacctttcccattgtggtcatgccatttggcagggggagaatgggaggcttggccttctttgtgaggcagtgtgagcagaagctgatgccagcatgtcactggttttgaagggatgagcccagacttgatgttttgggattgtccttattttaacctcaaggtctcgcatggtggggcccctgaccaacctacacaagttccctcccacaagtggacatcagtgtcttctctgtgaggcatctggccattcgcactccctggtgtggtcagcctctctcacacaaggaggaacttgggtgaaggctgagtgtgaggcacctgaagtttccctgcggagtcgataaattagcagaaccacatccccatctgttaggccttggtgaggaggccctgggcaaagaagggtctttcgcaaagcgatgtcagagggcggttttgagctttctataagctatagctttgtttatttcacccgttcacttactgtataatttaaaatcatttatgtagctgagacacttctgtatttcaatcatatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcctccctattggaatcccaatggctcctggagtaggaaaaaagtttaaactacattcatgttcttgttctgtgtcactcggccctgggtagtctaccatttacttcaccccaagtcctgctgcccatccagttgggaagccatgattttcctaagaatccagggccatgggagatacaattccaagttctcgcttcctcctttgggcatctcttctgcctcccaatcaaggaagctccatgctcaggctctcagctctcgggccagtgctctgctctgtccagggtaggtaatactgggagactcctgtcttttaccctcccctcgttccagacctgcctcatggtggcaacatggttcttgaacaattaaagaaacaaatgactttttggaatagccctgtctagggcaaactgtggcccccaggagacactacccttccatgccccagacctctgtcttgcatgtgacaattgacaatctggactaccccaagatggcacccaagtgtttggcttctggctacctaaggttaacatgtcactagagtatttttatgagagacaaacattataaaaatctgatggcaaaagcaaaacaaaatggaaagtaggggaggtggatgtgacaacaacttccaaattggctctttggaggcgagaggaaggggagaacttggagaatagtttttgctttgggggtagaggcttcttagattctcccagcatccgcctttccctttagccagtctgctgtcctgaaacccagaagtgatggagagaaaccaacaagagatctcgaaccctgtctagaaggaatgtatttgttgctaaatttcgtagcactgtttacagttttcctccatgttatttatgaattttatattccgtgaatgtatattgtcttgtaatgttgcataatgttcactttttatagtgtgtcctttattctaaacagtaaagtggttttatttctatcacaca

SEQ ID NO: 21538 - DNA, 2150 bp, Homo sapiens
  ENST00000486483
aaaagcataaagaatgtataacaacctaattgttacaagggagtggaattaataatctacaagaaggcacaaaaggacagaaaagaaacagaacaaatgagaaaaatagaaagccaacagtaatatggatttttagactctgaggagcagttggagctaatccacattatggaaatggaaaccaccgaacctgagccagactgtgtagtgcagcctccctctcctcctgatgacttttcatgccaaatgagactctctgagaagatcactccattgaagacttgttttaagaaaaaggatcagaaaagattgggaactggaaccctgaggtctttgaggccaatattaaacactcttctagaatctggctcacttgatggggtttttagatctaggaaccagagtacagatgagaacagcttacatgaacctatgatgaagaaagccatggaaatcaattcatcatgcccaccagcagaaaataatatgtctgttctgattcctgataggacaaatgttggggaccagataccggaagcccatccttccactgaagctccagaacgagtggttccaatccaagatcacagctttccatcagaaaccctcagtgggacggtggcagattccacaccagctcacttccagactgatcttttgcacccagtttcaagtgatgttcctactagtcctgactgcttagacaaagtcatagattatgttccaggcattttccaagaaaacagttttacaatccaatacattctggacaccagtgataagctgagtactgagctctttcaggacaaaagtgaagaggcttcccttgacctcgtgtttgagctggtgaaccagttgcagtaccacactcaccaagagaacggaattgaaatttgcatggactttctgcaaggcacttgtatttatggcagggattgtttgaagcaccacactgtcttgccatatcattggcagatcaaaaggacaactactcaaaagtggcagagtgtattcaatgattctcaggagcacttggaaagattttactgtaacccagaaaatgatagaatgagaatgaagtatggaggacaagaattttgggcagatttgaatgccatgaacgtgtatgaaacaactgaatttgaccaactacgaaggctgtccacaccaccctctagcaatgtcaactctatttaccacacagtctggaaattcttctgtagggaccactttggatggagagagtatcccgagtctgtcattcgattgattgaagaagccaactctcggggtctgaaagaggttcgatttatgatgtggaataaccactacatcctccacaattcattcttcaggagagagataaaaaggagacccctcttccgctcctgttttatactgcttccatatttacagacacttggtggggttcccacacaagctcctccacctcttgaagcaacttcatcatcacaaattatctgcccagatggggtcacttcagcaaacttttaccctgaaacttgggtttatatgcatccatctcaggacttcatccaagtccctgtttctgcagaggataaaagttatcggatcatttacaatctttttcataagactgtgcctgagtttaaatacagaattttgcagatattgagagtccaaaaccagtttctttgggagaaatataaaaggaaaaaggaatatatgaacaggaaaatgtttggccgtgacaggataataaatgagagacatttatttcatggaacatcccaggatgtggtagatggaatctgcaaacacaactttgaccctcgagtctgtggaaagcatgctacaatgtttggacaaggcagttattttgcaaagaaggcaagctactctcataacttttctaagaagtcctccaaaggagtccacttcatgtttctggccaaagtgctgacgggcagatacacaatgggcagtcatggcatgagaaggcccccgccagtcaatcctggcagtgtcaccagtgacctttatgactcttgtgtggataatttctttgagcctcagatttttgtcatttttaatgatgaccagagttacccttattttgttatccaatatgaagaagtcagtaacactgtttccatttgaaaaatctt

SEQ ID NO: 21539 - DNA, 4109 bp, Homo sapiens
  ENST00000295924
agacgcggaccctcagggacactgcggacgcgagaaaggacacgccccctcgcgggagcataagtccaccgcacagaactcgcgcgcctcccctcgaacgaacgcgcacgcgcgcgcagggggcgggtcttcttcccgacacccactgagcgcccggcctcctcaccccaccccaccgaactccggccgcccaggctccgcctccgcgacgggccgtcgggaggaggcgaccggaagccacttaaagcagagatcgaggtgacaggcgagctggctggactcggagcgcggtcgaggctttctgcgttcgcggcggcggaatggcccgtgcgcggctcgccgcgtcgcggctctgtggtccctagacgtcggctcccgccctcggcgctgatctccggcgcgggcactgctttccactcggctcctgtcgtccgttctctcaggctcccgttcaggatttttagactctgaggagcagttggagctaatccacattatggaaatggaaaccaccgaacctgagccagactgtgtagtgcagcctccctctcctcctgatgacttttcatgccaaatgagactctctgagaagatcactccattgaagacttgttttaagaaaaaggatcagaaaagattgggaactggaaccctgaggtctttgaggccaatattaaacactcttctagaatctggctcacttgatggggtttttagatctaggaaccagagtacagatgagaacagcttacatgaacctatgatgaagaaagccatggaaatcaattcatcatgcccaccagcagaaaataatatgtctgttctgattcctgataggacaaatgttggggaccagataccggaagcccatccttccactgaagctccagaacgagtggttccaatccaagatcacagctttccatcagaaaccctcagtgggacggtggcagattccacaccagctcacttccagactgatcttttgcacccagtttcaagtgatgttcctactagtcctgactgcttagacaaagtcatagattatgttccaggcattttccaagaaaacagttttacaatccaatacattctggacaccagtgataagctgagtactgagctctttcaggacaaaagtgaagaggcttcccttgacctcgtgtttgagctggtgaaccagttgcagtaccacactcaccaagagaacggaattgaaatttgcatggactttctgcaaggcacttgtatttatggcagggattgtttgaagcaccacactgtcttgccatatcattggcagatcaaaaggacaactactcaaaagtggcagagtgtattcaatgattctcaggagcacttggaaagattttactgtaacccagaaaatgatagaatgagaatgaagtatggaggacaagaattttgggcagatttgaatgccatgaacgtgtatgaaacaactgaatttgaccaactacgaaggctgtccacaccaccctctagcaatgtcaactctatttaccacacagtctggaaattcttctgtagggaccactttggatggagagagtatcccgagtctgtcattcgattgattgaagaagccaactctcggggtctgaaagaggttcgatttatgatgtggaataaccactacatcctccacaattcattcttcaggagagagataaaaaggagacccctcttccgctcctgttttatactgcttccatatttacagacacttggtggggttcccacacaagctcctccacctcttgaagcaacttcatcatcacaaattatctgcccagatggggtcacttcagcaaacttttaccctgaaacttgggtttatatgcatccatctcaggacttcatccaagtccctgtttctgcagaggataaaagttatcggatcatttacaatctttttcataagactgtgcctgagtttaaatacagaattttgcagatattgagagtccaaaaccagtttctttgggagaaatataaaaggaaaaaggaatatatgaacaggaaaatgtttggccgtgacaggataataaatgagagacatttatttcatggaacatcccaggatgtggtagatggaatctgcaaacacaactttgaccctcgagtctgtggaaagcatgctacaatgtttggacaaggcagttattttgcaaagaaggcaagctactctcataacttttctaagaagtcctccaaaggagtccacttcatgtttctggccaaagtgctgacgggcagatacacaatgggcagtcatggcatgagaaggcccccgccagtcaatcctggcagtgtcaccagtgacctttatgactcttgtgtggataatttctttgagcctcagatttttgtcatttttaatgatgaccagagttacccttattttgttatccaatatgaagaagtcagtaacactgtttccatttgaaaaatcttggtactgctaaattatttgatatgaactcaatccagcatttgtagcaggttttgaatgggtgggactgggtggggaacagcattggacattaatagggcacttttcagacccattttttaaagtgctagaaaatgctttttttaaaaaaaaaatacaagttttaaaatgaccacttactctttaattatttactaattgctagtgtactcagtgtggaaaagactacagattacacactcttttcattcacacttgtacatatagacagcaatgttattaggagcattaaattaaaaaactgaacagcctaatttaaatgtggcttgggcctggtagaagtttgaccaaatggaatggaggctgtgagcaatgtgaggattctatttatttatttacgtttgataaaacttactggaactagtactaccatgcgtattccctgtccaaagcatcactgctttggtatagtataagttcatgaaattctggtgggtagaaagaaatttttatttctatcagcagtactaaaatgtatcagccaaccagagaacatcagtgactttaacttctgcagagtttgccccagaattcagagttctatttagaggaagttaaaacaacaacaaaaaacaaccatttgaaaaatttttgtcaccagcaaaacttttcactaattagtgatatgaaatgtgatttttgtgttgttaaacttcagctttggaaaactcagtctctttcattatcatccattccaatttgaaggagttgggcagctaatttggttaaaggcagtcttgagggttagaagtattacttccttttcgggttccagacctagcttgtgactgaaagttttagaaaaaggaagtacatctatagccaaattgataaggttattactgtgttttgcacaaagtatattagcaaaagtatttgctggaattattggtagatggcagtcccactcctacacctgctttgtcagatacagctgggttccctggctgactctgtaccttacttacactacttacttaatagaaacacaaacttggaaattgtgccagtggtccagctggagcacaacgtttggtgaatatgctgtttcctcagttcagagaggtagcaactaggtaaactccttataaaaagcaaatacctggatttacaaaagtgaaagtagttgttcacaaaagaattcgccatggaattctttcagttaccaagctctcctggtaatgtttgtggttatatcatttacacaaaacttttcaggaacttctgtgttgtttaagcaagatgtatctgtactgatgtctcagtgaatcagtctgtttattaagcacttatcagggcttccacacacttatttattttgccctagttaatcctgttgtttgctgccattggcatgaaatggccaactgtggctgttacagttctttcattcaattataacttgtaaaccagtgactcctaatctttttcaagttaagacaccttaccattgcttatttggttttatgagacttgttcctttttttctccctaaggaaaaagaaagctttatgacatatttatttttttaataaaactaagcaaaaataaaacttatggtaattctttaaaa

SEQ ID NO: 21540 - DNA, 4181 bp, Homo sapiens
  ENST00000461166
agtgcgagcgccggcctcgcggctccggccccggccccggccccgcgccggcagtgtgcggggctctcgcggatcggggtgattgattttgagactgccctttgtaccgaattcactcgggtcccgtcagcatgaagatggaattggtttacacttcttaggcacttagagcctgtggcaggtgtatacatcagaccgaggcgccgaaggatttagttggggtcgcaggcgcctgccccttccccgttcgtcagggtgggggcgcgtctatgcggcctcccccgcgggccgaccccgggtgctctgaggcgcctaggagcccttcccagaccccgggggggagggcacggcagctacgggagccttccggctaccccgcgtttcgggctgcagcccagaagtttggaagatgttttcacattaactttgagagcgcacaagtcttcgtcttcctccccgccgccgcgggaagcgctcgccgcctttcccccgcgcttcgcggctcagttctgcgagcccccaagacccgttggacgctcctcgggaggatttttagactctgaggagcagttggagctaatccacattatggaaatggaaaccaccgaacctgagccagactgtgtagtgcagcctccctctcctcctgatgacttttcatgccaaatgagactctctgagaagatcactccattgaagacttgttttaagaaaaaggatcagaaaagattgggaactggaaccctgaggtctttgaggccaatattaaacactcttctagaatctggctcacttgatggggtttttagatctaggaaccagagtacagatgagaacagcttacatgaacctatgatgaagaaagccatggaaatcaattcatcatgcccaccagcagaaaataatatgtctgttctgattcctgataggacaaatgttggggaccagataccggaagcccatccttccactgaagctccagaacgagtggttccaatccaagatcacagctttccatcagaaaccctcagtgggacggtggcagattccacaccagctcacttccagactgatcttttgcacccagtttcaagtgatgttcctactagtcctgactgcttagacaaagtcatagattatgttccaggcattttccaagaaaacagttttacaatccaatacattctggacaccagtgataagctgagtactgagctctttcaggacaaaagtgaagaggcttcccttgacctcgtgtttgagctggtgaaccagttgcagtaccacactcaccaagagaacggaattgaaatttgcatggactttctgcaaggcacttgtatttatggcagggattgtttgaagcaccacactgtcttgccatatcattggcagatcaaaaggacaactactcaaaagtggcagagtgtattcaatgattctcaggagcacttggaaagattttactgtaacccagaaaatgatagaatgagaatgaagtatggaggacaagaattttgggcagatttgaatgccatgaacgtgtatgaaacaactgaatttgaccaactacgaaggctgtccacaccaccctctagcaatgtcaactctatttaccacacagtctggaaattcttctgtagggaccactttggatggagagagtatcccgagtctgtcattcgattgattgaagaagccaactctcggggtctgaaagaggttcgatttatgatgtggaataaccactacatcctccacaattcattcttcaggagagagataaaaaggagacccctcttccgctcctgttttatactgcttccatatttacagacacttggtggggttcccacacaagctcctccacctcttgaagcaacttcatcatcacaaattatctgcccagatggggtcacttcagcaaacttttaccctgaaacttgggtttatatgcatccatctcaggacttcatccaagtccctgtttctgcagaggataaaagttatcggatcatttacaatctttttcataagactgtgcctgagtttaaatacagaattttgcagatattgagagtccaaaaccagtttctttgggagaaatataaaaggaaaaaggaatatatgaacaggaaaatgtttggccgtgacaggataataaatgagagacatttatttcatggaacatcccaggatgtggtagatggaatctgcaaacacaactttgaccctcgagtctgtggaaagcatgctacaatgtttggacaaggcagttattttgcaaagaaggcaagctactctcataacttttctaagaagtcctccaaaggagtccacttcatgtttctggccaaagtgctgacgggcagatacacaatgggcagtcatggcatgagaaggcccccgccagtcaatcctggcagtgtcaccagtgacctttatgactcttgtgtggataatttctttgagcctcagatttttgtcatttttaatgatgaccagagttacccttattttgttatccaatatgaagaagtcagtaacactgtttccatttgaaaaatcttggtactgctaaattatttgatatgaactcaatccagcatttgtagcaggttttgaatgggtgggactgggtggggaacagcattggacattaatagggcacttttcagacccattttttaaagtgctagaaaatgctttttttaaaaaaaaaatacaagttttaaaatgaccacttactctttaattatttactaattgctagtgtactcagtgtggaaaagactacagattacacactcttttcattcacacttgtacatatagacagcaatgttattaggagcattaaattaaaaaactgaacagcctaatttaaatgtggcttgggcctggtagaagtttgaccaaatggaatggaggctgtgagcaatgtgaggattctatttatttatttacgtttgataaaacttactggaactagtactaccatgcgtattccctgtccaaagcatcactgctttggtatagtataagttcatgaaattctggtgggtagaaagaaatttttatttctatcagcagtactaaaatgtatcagccaaccagagaacatcagtgactttaacttctgcagagtttgccccagaattcagagttctatttagaggaagttaaaacaacaacaaaaaacaaccatttgaaaaatttttgtcaccagcaaaacttttcactaattagtgatatgaaatgtgatttttgtgttgttaaacttcagctttggaaaactcagtctctttcattatcatccattccaatttgaaggagttgggcagctaatttggttaaaggcagtcttgagggttagaagtattacttccttttcgggttccagacctagcttgtgactgaaagttttagaaaaaggaagtacatctatagccaaattgataaggttattactgtgttttgcacaaagtatattagcaaaagtatttgctggaattattggtagatggcagtcccactcctacacctgctttgtcagatacagctgggttccctggctgactctgtaccttacttacactacttacttaatagaaacacaaacttggaaattgtgccagtggtccagctggagcacaacgtttggtgaatatgctgtttcctcagttcagagaggtagcaactaggtaaactccttataaaaagcaaatacctggatttacaaaagtgaaagtagttgttcacaaaagaattcgccatggaattctttcagttaccaagctctcctggtaatgtttgtggttatatcatttacacaaaacttttcaggaacttctgtgttgtttaagcaagatgtatctgtactgatgtctcagtgaatcagtctgtttattaagcacttatcagggcttccacacacttatttattttgccctagttaatcctgttgtttgctgccattggcatgaaatggccaactgtggctgttacagttctttcattcaattataacttgtaaaccagtgactcctaatctttttcaagttaagacaccttaccattgcttatttggttttatgagacttgttcctttttttctccctaaggaaaaagaaagctttatgacatatttatttttttaataaaactaagcaaaaataaaa

SEQ ID NO: 21541 - DNA, 1770 bp, Homo sapiens
  ENST00000473702
agagccgggcggcgcctcagctgcactgcgcggagttggcgcggcccgggaccaggagctgagcaaaccgccgcggccaacaggaggcgtcactcggacccgggctcggcgccggggtgtcgcgcggcggcgggcgggcaggctttggagcggcagttttttcggaaagtgcttttggccgggagtgccgcagaaccccagcgtcacgaggatttttagactctgaggagcagttggagctaatccacattatggaaatggaaaccaccgaacctgagccagactgtgtagtgcagcctccctctcctcctgatgacttttcatgccaaatgagactctctgagaagatcactccattgaagacttgttttaagaaaaaggatcagaaaagattgggaactggaaccctgaggtctttgaggccaatattaaacactcttctagaatctggctcacttgatggggtttttagatctaggaaccagagtacagatgagaacagcttacatgaacctatgatgaagaaagccatggaaatcaattcatcatgcccaccagcagaaaataatatgtctgttctgattcctgataggacaaatgttggggaccagataccggaagcccatccttccactgaagctccagaacgagtggttccaatccaagatcacagctttccatcagaaaccctcagtgggacggtggcagattccacaccagctcacttccagactgatcttttgcacccagtttcaagtgatgttcctactagtcctgactgcttagacaaagtcatagattatgttccaggcattttccaagaaaacagttttacaatccaatacattctggacaccagtgataagctgagtactgagctctttcaggacaaaagtgaagaggcttcccttgacctcgtgtttgagctggtgaaccagttgcagtaccacactcaccaagagaacggaattgaaatttgcatggactttctgcaaggcacttgtatttatggcagggattgtttgaagcaccacactgtcttgccatatcattggcagatcaaaaggacaactactcaaaagtggcagagtgtattcaatgattctcaggagcacttggaaagattttactgtaacccagaaaatgatagaatgagaatgaagtatggaggacaagaattttgggcagatttgaatgccatgaacgtgtatgaaacaactgaatttgaccaactacgaaggctgtccacaccaccctctagcaatgtcaactctatttaccacacagtctggaaattcttctgtagggaccactttggatggagagagtatcccgagtctgtcattcgattgattgaagaagccaactctcggggtctgaaagaggttcgatttatgatgtggaataaccactacatcctccacaattcattcttcaggagagagataaaaaggagacccctcttccgctcctgttttatactgcttccatatttacagacacttggtggggttcccacacaagctcctccacctcttgaagcaacttcatcatcacaaattatctgcccagatggggtcacttcagcaaacttttaccctgaaacttgggtttatatgcatccatctcaggacttcatccaagtccctgtttctgcagaggataaaagttatcggatcatttacaatctttttcataagactgtgcctgagtttaaatacagaattttgcagatattgagagtccaaaaccagtttctttgggagaaat

SEQ ID NO: 21542 - DNA, 2035 bp, Homo sapiens
  ENST00000481853
caccattcctttctcacctggcacaatctcagatttttagactctgaggagcagttggagctaatccacattatggaaatggaaaccaccgaacctgagccagactgtgtagtgcagcctccctctcctcctgatgacttttcatgccaaatgagactctctgagaagatcactccattgaagacttgttttaagaaaaaggatcagaaaagattgggaactggaaccctgaggtctttgaggccaatattaaacactcttctagaatctggctcacttgatggggtttttagatctaggaaccagagtacagatgagaacagcttacatgaacctatgatgaagaaagccatggaaatcaattcatcatgcccaccagcagaaaataatatgtctgttctgattcctgataggacaaatgttggggaccagataccggaagcccatccttccactgaagctccagaacgagtggttccaatccaagatcacagctttccatcagaaaccctcagtgggacggtggcagattccacaccagctcacttccagactgatcttttgcacccagtttcaagtgatgttcctactagtcctgactgcttagacaaagtcatagattatgttccaggcattttccaagaaaacagttttacaatccaatacattctggacaccagtgataagctgagtactgagctctttcaggacaaaagtgaagaggcttcccttgacctcgtgtttgagctggtgaaccagttgcagtaccacactcaccaagagaacggaattgaaatttgcatggactttctgcaaggcacttgtatttatggcagggattgtttgaagcaccacactgtcttgccatatcattggcagatcaaaaggacaactactcaaaagtggcagagtgtattcaatgattctcaggagcacttggaaagattttactgtaacccagaaaatgatagaatgagaatgaagtatggaggacaagaattttgggcagatttgaatgccatgaacgtgtatgaaacaactgaatttgaccaactacgaaggctgtccacaccaccctctagcaatgtcaactctatttaccacacagtctggaaattcttctgtagggaccactttggatggagagagtatcccgagtctgtcattcgattgattgaagaagccaactctcggggtctgaaagaggttcgatttatgatgtggaataaccactacatcctccacaattcattcttcaggagagagataaaaaggagacccctcttccgctcctgttttatactgcttccatatttacagacacttggtggggttcccacacaagctcctccacctcttgaagcaacttcatcatcacaaattatctgcccagatggggtcacttcagcaaacttttaccctgaaacttgggtttatatgcatccatctcaggacttcatccaagtccctgtttctgcagaggataaaagttatcggatcatttacaatctttttcataagactgtgcctgagtttaaatacagaattttgcagatattgagagtccaaaaccagtttctttgggagaaatataaaaggaaaaaggaatatatgaacaggaaaatgtttggccgtgacaggataataaatgagagacatttatttcatggaacatcccaggatgtggtagatggaatctgcaaacacaactttgaccctcgagtctgtggaaagcatgctacaatgtttggacaaggcagttattttgcaaagaaggcaagctactctcataacttttctaagaagtcctccaaaggagtccacttcatgtttctggccaaagtgctgacgggcagatacacaatgggcagtcatggcatgagaaggcccccgccagtcaatcctggcagtgtcaccagtgacctttatgactcttgtgtggataatttctttgagcctcagatttttgtcatttttaatgatgaccagagttacccttattttgttatccaatatgaagaagtcagtaacactg

SEQ ID NO: 21543 - DNA, 2700 bp, Homo sapiens
  ENST00000495891
cacaaacaagctggagcagcccagaggacaagaattttgggcagatttgaatgccatgaacgtgtatgaaacaactgaatttgaccaactacgaaggctgtccacaccaccctctagcaatgtcaactctatttaccacacagtctggaaattcttctgtagggaccactttggatggagagagtatcccgagtctgtcattcgattgattgaagaagccaactctcggggtctgaaagaggttcgatttatgatgtggaataaccactacatcctccacaattcattcttcaggagagagataaaaaggagacccctcttccgctcctgttttatactgcttccatatttacagacacttggtggggttcccacacaagctcctccacctcttgaagcaacttcatcatcacaaattatctgcccagatggggtcacttcagcaaacttttaccctgaaacttgggtttatatgcatccatctcaggacttcatccaagtccctgtttctgcagaggataaaagttatcggatcatttacaatctttttcataagactgtgcctgagtttaaatacagaattttgcagatattgagagtccaaaaccagtttctttgggagaaatataaaaggaaaaaggaatatatgaacaggaaaatgtttggccgtgacaggataataaatgagagacatttatttcatggaacatcccaggatgtggtagatggaatctgcaaacacaactttgaccctcgagtctgtggaaagcatgctacaatgtttggacaaggcagttattttgcaaagaaggcaagctactctcataacttttctaagaagtcctccaaaggagtccacttcatgtttctggccaaagtgctgacgggcagatacacaatgggcagtcatggcatgagaaggcccccgccagtcaatcctggcagtgtcaccagtgacctttatgactcttgtgtggataatttctttgagcctcagatttttgtcatttttaatgatgaccagagttacccttattttgttatccaatatgaagaagtcagtaacactgtttccatttgaaaaatcttggtactgctaaattatttgatatgaactcaatccagcatttgtagcaggttttgaatgggtgggactgggtggggaacagcattggacattaatagggcacttttcagacccattttttaaagtgctagaaaatgctttttttaaaaaaaaaatacaagttttaaaatgaccacttactctttaattatttactaattgctagtgtactcagtgtggaaaagactacagattacacactcttttcattcacacttgtacatatagacagcaatgttattaggagcattaaattaaaaaactgaacagcctaatttaaatgtggcttgggcctggtagaagtttgaccaaatggaatggaggctgtgagcaatgtgaggattctatttatttatttacgtttgataaaacttactggaactagtactaccatgcgtattccctgtccaaagcatcactgctttggtatagtataagttcatgaaattctggtgggtagaaagaaatttttatttctatcagcagtactaaaatgtatcagccaaccagagaacatcagtgactttaacttctgcagagtttgccccagaattcagagttctatttagaggaagttaaaacaacaacaaaaaacaaccatttgaaaaatttttgtcaccagcaaaacttttcactaattagtgatatgaaatgtgatttttgtgttgttaaacttcagctttggaaaactcagtctctttcattatcatccattccaatttgaaggagttgggcagctaatttggttaaaggcagtcttgagggttagaagtattacttccttttcgggttccagacctagcttgtgactgaaagttttagaaaaaggaagtacatctatagccaaattgataaggttattactgtgttttgcacaaagtatattagcaaaagtatttgctggaattattggtagatggcagtcccactcctacacctgctttgtcagatacagctgggttccctggctgactctgtaccttacttacactacttacttaatagaaacacaaacttggaaattgtgccagtggtccagctggagcacaacgtttggtgaatatgctgtttcctcagttcagagaggtagcaactaggtaaactccttataaaaagcaaatacctggatttacaaaagtgaaagtagttgttcacaaaagaattcgccatggaattctttcagttaccaagctctcctggtaatgtttgtggttatatcatttacacaaaacttttcaggaacttctgtgttgtttaagcaagatgtatctgtactgatgtctcagtgaatcagtctgtttattaagcacttatcagggcttccacacacttatttattttgccctagttaatcctgttgtttgctgccattggcatgaaatggccaactgtggctgttacagttctttcattcaattataacttgtaaaccagtgactcctaatctttttcaagttaagacaccttaccattgcttatttggttttatgagacttgttcctttttttctccctaaggaaaaagaaagctttatgacatatttatttttttaataaaactaagcaaaaataaaa

SEQ ID NO: 21544 - DNA, 3681 bp, Homo sapiens
  ENST00000542783
caccattcctttctcacctggcacaatctcagatttttagactctgaggagcagttggagctaatccacattatggaaatggaaaccaccgaacctgagccagactgtgtagtgcagcctccctctcctcctgatgacttttcatgccaaatgagactctctgagaagatcactccattgaagacttgttttaagaaaaaggatcagaaaagattgggaactggaaccctgaggtctttgaggccaatattaaacactcttctagaatctggctcacttgatggggtttttagatctaggaaccagagtacagatgagaacagcttacatgaacctatgatgaagaaagccatggaaatcaattcatcatgcccaccagcagaaaataatatgtctgttctgattcctgataggacaaatgttggggaccagataccggaagcccatccttccactgaagctccagaacgagtggttccaatccaagatcacagctttccatcagaaaccctcagtgggacggtggcagattccacaccagctcacttccagactgatcttttgcacccagtttcaagtgatgttcctactagtcctgactgcttagacaaagtcatagattatgttccaggcattttccaagaaaacagttttacaatccaatacattctggacaccagtgataagctgagtactgagctctttcaggacaaaagtgaagaggcttcccttgacctcgtgtttgagctggtgaaccagttgcagtaccacactcaccaagagaacggaattgaaatttgcatggactttctgcaaggcacttgtatttatggcagggattgtttgaagcaccacactgtcttgccatatcattggcagatcaaaaggacaactactcaaaagtggcagagtgtattcaatgattctcaggagcacttggaaagattttactgtaacccagaaaatgatagaatgagaatgaagtatggaggacaagaattttgggcagatttgaatgccatgaacgtgtatgaaacaactgaatttgaccaactacgaaggctgtccacaccaccctctagcaatgtcaactctatttaccacacagtctggaaattcttctgtagggaccactttggatggagagagtatcccgagtctgtcattcgattgattgaagaagccaactctcggggtctgaaagaggttcgatttatgatgtggaataaccactacatcctccacaattcattcttcaggagagagataaaaaggagacccctcttccgctcctgttttatactgcttccatatttacagacacttggtggggttcccacacaagctcctccacctcttgaagcaacttcatcatcacaaattatctgcccagatggggtcacttcagcaaacttttaccctgaaacttgggtttatatgcatccatctcaggacttcatccaagtccctgtttctgcagaggataaaagttatcggatcatttacaatctttttcataagactgtgcctgagtttaaatacagaattttgcagatattgagagtccaaaaccagtttctttgggagaaatataaaaggaaaaaggaatatatgaacaggaaaatgtttggccgtgacaggataataaatgagagacatttatttcatggaacatcccaggatgtggtagatggaatctgcaaacacaactttgaccctcgagtctgtggaaagcatgctacaatgtttggacaaggcagttattttgcaaagaaggcaagctactctcataacttttctaagaagtcctccaaaggagtccacttcatgtttctggccaaagtgctgacgggcagatacacaatgggcagtcatggcatgagaaggcccccgccagtcaatcctggcagtgtcaccagtgacctttatgactcttgtgtggataatttctttgagcctcagatttttgtcatttttaatgatgaccagagttacccttattttgttatccaatatgaagaagtcagtaacactgtttccatttgaaaaatcttggtactgctaaattatttgatatgaactcaatccagcatttgtagcaggttttgaatgggtgggactgggtggggaacagcattggacattaatagggcacttttcagacccattttttaaagtgctagaaaatgctttttttaaaaaaaaaatacaagttttaaaatgaccacttactctttaattatttactaattgctagtgtactcagtgtggaaaagactacagattacacactcttttcattcacacttgtacatatagacagcaatgttattaggagcattaaattaaaaaactgaacagcctaatttaaatgtggcttgggcctggtagaagtttgaccaaatggaatggaggctgtgagcaatgtgaggattctatttatttatttacgtttgataaaacttactggaactagtactaccatgcgtattccctgtccaaagcatcactgctttggtatagtataagttcatgaaattctggtgggtagaaagaaatttttatttctatcagcagtactaaaatgtatcagccaaccagagaacatcagtgactttaacttctgcagagtttgccccagaattcagagttctatttagaggaagttaaaacaacaacaaaaaacaaccatttgaaaaatttttgtcaccagcaaaacttttcactaattagtgatatgaaatgtgatttttgtgttgttaaacttcagctttggaaaactcagtctctttcattatcatccattccaatttgaaggagttgggcagctaatttggttaaaggcagtcttgagggttagaagtattacttccttttcgggttccagacctagcttgtgactgaaagttttagaaaaaggaagtacatctatagccaaattgataaggttattactgtgttttgcacaaagtatattagcaaaagtatttgctggaattattggtagatggcagtcccactcctacacctgctttgtcagatacagctgggttccctggctgactctgtaccttacttacactacttacttaatagaaacacaaacttggaaattgtgccagtggtccagctggagcacaacgtttggtgaatatgctgtttcctcagttcagagaggtagcaactaggtaaactccttataaaaagcaaatacctggatttacaaaagtgaaagtagttgttcacaaaagaattcgccatggaattctttcagttaccaagctctcctggtaatgtttgtggttatatcatttacacaaaacttttcaggaacttctgtgttgtttaagcaagatgtatctgtactgatgtctcagtgaatcagtctgtttattaagcacttatcagggcttccacacacttatttattttgccctagttaatcctgttgtttgctgccattggcatgaaatggccaactgtggctgttacagttctttcattcaattataacttgtaaaccagtgactcctaatctttttcaagttaagacaccttaccattgcttatttggttttatgagacttgttcctttttttctccctaaggaaaaagaaagctttatgacatatttatttttttaataaaactaagcaaaaataaaacttatggtaattcttt

SEQ ID NO: 21545 - DNA, 1017 bp, Homo sapiens
  ENST00000292090
ggctggcggccggcgggagaggcggccggcctggactggcccgagagggatcccggttcccagaacagacctaggaggcggcctcgagggcggacggcagggagggccagcatgccccgactgctgcaccccgccctgccgctgctcctgggcgccacgctgaccttccgggcgctccggcgcgcgctctgtcgcctgcccctacccgtgcacgtgcgcgccgaccccctgcgcacctggcgctggcacaacctgctcgtctccttcgctcactccattgtgtcggggatctgggcactgctgtgtgtatggcagactcctgacatgttagtggagattgagacggcgtggtcactttctggctatttgctcgtttgcttctctgcggggtatttcatccacgatacggtggacatcgtggctagcggacagacgcgagcctcttgggaataccttgtccatcacgtcatggccatgggtgccttcttctccggcatcttttggagcagctttgtcggtgggggtgtcttaacactactggtggaagtcagcaacatcttcctcaccattcgcatgatgatgaaaatcagtaatgcccaggatcatctcctctaccgggttaacaagtatgtgaacctggtcatgtactttctcttccgcctggcccctcaggcctacctcacccatttcttcttgcgttatgtgaaccagaggaccctgggcaccttcctgctgggtatcctgctcatgctggacgtgatgatcataatctacttttcccgcctcctccgctctgacttctgccctgagcatgtccccaagaagcaacacaaagacaagttcttgactgagtgaggggcacagagcctgggacaacaaaaacggacaaggccagaaacagcttcatatggacactgggacttagccccaagcctgggtgtcctctgaggccagcctctccaccttctgagcctgcgcccacactattgaaaacactaatgaaagtactcctctgaa

SEQ ID NO: 21546 - DNA, 408 bp, Homo sapiens
  ENST00000581236
tcggtgggggtgtcttaacactactggtggaagtcagcaacatcttcctcaccattcgcatgatgatgaaaatcagtaatgcccaggatcatctcctctaccgggttaacaaaggaccctgggcaccttcctgctgggtatcctgctcatgctggacgtgatgatcataatctacttttcccgcctcctccgctctgacttctgccctgagcatgtccccaagaagcaacacaaagacaagttcttgactgagtgaggggcacagagcctgggacaacaaaaacggacaaggccagaaacagcttcatatggacactgggacttagccccaagcctgggtgtcctctgaggccagcctctccaccttctgagcctgcgcccacactattgaaaacactaatgaaagta

SEQ ID NO: 21547 - DNA, 784 bp, Homo sapiens
  ENST00000394933
ggcaaatcggaggtcttgcttgcccagcctccggggagccgggccgagggccgggactgtctgagggaggactgtgacagccgcccggccccaggagtttaagagccggcgggaagaggtggcgatgggttactcagcagttcccaagtgcccacctcgcgggcgcgggagggacagtgtatggcagactcctgacatgttagtggagattgagacggcgtggtcactttctggctatttgctcgtttgcttctctgcggggtatttcatccacgatacggtggacatcgtggctagcggacagacgcgagcctcttgggaataccttgtccatcacgtcatggccatgggtgccttcttctccggcatcttttggagcagctttgtcggtgggggtgtcttaacactactggtggaagtcagcaacatcttcctcaccattcgcatgatgatgaaaatcagtaatgcccaggatcatctcctctaccgggttaacaagtatgtgaacctggtcatgtactttctcttccgcctggcccctcaggcctacctcacccatttcttcttgcgttatgtgaaccagaggaccctgggcaccttcctgctgggtatcctgctcatgctggacgtgatgatcataatctacttttcccgcctcctccgctctgacttctgccctgagcatgtccccaagaagcaacacaaagacaagttcttgactgagtgaggggcacagagcctgggacaacaaaaacggacaaggccagaaacagcttcatatgga

SEQ ID NO: 21548 - DNA, 578 bp, Homo sapiens
  ENST00000580518
aaaaactcagtattcggccaggcgcggtggctcacgcctgtaattccagcactttggggaggccgaggcgggcggatcacctgaggtcaggagtttgagaccaacctggccaacatgtgtatggcagactcctgacatgttagtggagattgagacggcgtggtcactttctggctatttgctcgtttgcttctctgcggggtatttcatccacgatacggtggacatcgtggctagcggacagacgcgagcctcttgggaataccttgtccatcacgtcatggccatgggtgccttcttctccggcatcttttggagcagctttgtcggtgggggtgtcttaacactactggtggaagtcagcaacatcttcctcaccattcgcatgatgatgaaaatcagtaatgcccaggatcatctcctctaccgggttaacaagtatgtgaacctggtcatgtactttctcttccgcctggcccctcaggcctacctcacccatttcttcttgcgttatgtgaaccagaggaccctgggcaccttcctgctgggtatcctgctcatgctggacgtgatgatca

SEQ ID NO: 21549 - DNA, 3695 bp, Homo sapiens
  ENST00000376552
ggagagctcgccagagcgctcgcatggcgggccggtgattgtagtcaatctggccgtattctcaggcagggtcgcccggggcggactacatctcccgggatgctgcgcggccgccccgcggaagattgtgaatatgtatcagaatgttaatgattagctgctgctaaatttggtcaaagaagtcacctacacagagcgtgttgttagagctgtgctgagcgggtgtttgggttgttggctgctttcttccccctttctcacacacttgtatattattttgaggtggtgttcgcagagtttgaaaggagagagaattaaaaaaaaaagccgcaagcgtttcactcttttatttttataatccccttcaatttggggttaaaaaaaagacaagaaaacaggaaggaagagaaataaggaaatgagatgtggtaaaagaagctaaaaggtgccttttaaaagatcgttgctgtgaagtgaaaaaaatctccagagaaaccaaaaagcaccgccgagacctcttccgaaccaaaggagtttgtgtttgcttttagggaagaagaaagatcattcattcggaggaataacaaccaattaaaagacaaataaaaaaagtttggagtgggacgcagagcgagcgagaggagctgccggcgggcggtggggcgcggagcccgcactttcccggccgggtgagcggcggccgcggcgccgggctcggcgggtgcgcctcggcggagcgaacgtcggagcgttgccttgggagacgcgcgccggacaatgcccgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccagcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaatcttcagctgtctacttggaagaacatggaataagcatacttaacagtgaaaagaatctttaattatgtattatatctgtaatatatttattttgtttaaagaaggctttctaacaatgactgactaaataaagctgtctgctcctgcattgataa

SEQ ID NO: 21550 - DNA, 1536 bp, Homo sapiens
  ENST00000461758
tttggtcaaagaagtcacctacacagagcgtgttgttagagctgtgctgagcgggtgtttgggttgttggctgctttcttccccctttctcacacacttgtatattattttgaggtggtgttcgcagagtttgaaaggagagagaattaaaaaaaaaagccgcaagcgtttcactcttttatttttataatccccttcaatttggggttaaaaaaaagacaagaaaacaggaaggaagagaaataaggaaatgagatgtggtaaaagaagctaaaaggtgccttttaaaagatcgttgctgtgaagtgaaaaaaatctccagagaaaccaaaaagcaccgccgagacctcttccgaaccaaaggagtttgtgtttgcttttagggaagaagaaagatcattcattcggaggaataacaaccaattaaaagacaaataaaaaaagtttggagtgggacgcagagcgagcgagaggagctgccggcgggcggtggggcgcggagcccgcactttcccggccgggtgagcggcggccgcggcgccgggctcggcgggtgcgcctcggcggagcgaacgtcggagcgttgccttgggagacgcgcgccggacaatgcccgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccagcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggtaagttatttctttataaccattttaaatgacagtaatactgggacactatgaaaagaaaattgtatgttttgcagttttattctgcaagccgttgtggctacctttgctttatgtattttgggcattgcaaacttgtcttgtgaaagagcttttcttggaaaatattaaacagtaaaattaaattgtgtggcgccttcgttggcttgatgtgaaagaatggatagagggtgagctgggaggatgaaaatgaaatctgtggagctacaaaagaaattgatgtaaaatccttgtactggtcccctgaggctacttagttgggtcttaccaagaactataaccgttacttccaaaatttgtacagagtaaatgagcctgataggaggatgtgataaggttcaacattgggtcttgaaatctagcaattagttcag

SEQ ID NO: 21551 - DNA, 2832 bp, Homo sapiens
  ENST00000470872
cgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccagcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcagagactgtttttcacaaattgaaggctgtagcaaccctgaatggagctgttcttccaatagcctgtgctcacttcgtgtctctgtgtcacattttggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaa

SEQ ID NO: 21552 - DNA, 873 bp, Homo sapiens
  ENST00000435650
ggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccagcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattggggagaaaaagaataaaagtgacacacctggatcattaaagcagcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagaggtgaacagagactccatcaagagctcttcagtatccccat

SEQ ID NO: 21553 - DNA, 565 bp, Homo sapiens
  ENST00000414465
agccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccagcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcagcaacaactccaggcccagcatttatcacatggacatg

SEQ ID NO: 21554 - DNA, 2793 bp, Homo sapiens
  ENST00000376537
gccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccagcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaagagggatatggggaaattgagtgaaacacgtcttagcgaagatgaacaatgcacattggggttacagagatggttttgtcgcctgtggtttatgaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaa

SEQ ID NO: 21555 - DNA, 2814 bp, Homo sapiens
  ENST00000462803
gttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccagcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagcaaaactacttgctgctcataatggatgaaattggagaccaaagaggaagaaccttctgggttcctgtcagtctaaatcctgattttaaaagacattcacctgccatgctagtgttgtgtgcttctactgagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgatacc

SEQ ID NO: 21556 - DNA, 468 bp, Homo sapiens
  ENST00000376524
gcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccagcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcagtattgcaggttgttaagaagaaattgacttgaagaggccgactgctgcccatcatggag

SEQ ID NO: 21557 - DNA, 486 bp, Homo sapiens
  ENST00000476523
gtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccagcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattgcaggttgttaagaagaaattgacttgaagaggccgactgctgcccatcatggagcaaataaagcaaaactgccgaagcatggtggagcagcgagacgggccctcagcaatttgttgctatt

SEQ ID NO: 21558 - DNA, 379 bp, Homo sapiens
  ENST00000376525
gcggccgcctcctcttcggggtcattaaagccaatgagccgcgcgcctctgccgagcgcagccaactaaatcggcttggatgattcgcgacctgagcaagatgtacccgcagaccagacacccagcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatggtaagaaaaccatgtcacagattcaaagtgcctattagtttggaataccaaaaacaagaatatgtttaaattgctgggggctgcaagatagat

SEQ ID NO: 21559 - DNA, 2382 bp, Homo sapiens
  ENST00000265284
atgagccgcgcgcctctgccgagcgcagccaactaaatcggcttggatgattcgcgacctgagcaagatgtacccgcagaccagacacccagcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaa

SEQ ID NO: 21560 - DNA, 656 bp, Homo sapiens
  ENST00000425506
gggcgaacgaacgagccgagagggtggcggccgcctccctcctcccccggcctgaccgcagcccgacgccatggcgcgggtccccccgacgggccagtttcgattccgggcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagag

SEQ ID NO: 21561 - DNA, 723 bp, Homo sapiens
  ENST00000485159
tccctcctcccccggcctgaccgcagcccgacgccatggcgcgggtccccccgacgggccagtttcgattccgggcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattggggtacgtggcctttccattttagctctgatcttagtgtttgtcatcagctctctcgctctctctttttacattttgttccgccaaaggggcaaaaagcaatagatgactacaaaatgaaattaagcactttgccttcaatctcctgtgaaatttgatggctgccttagaaactttggatcacattctcaccaatttaagtggatgtgttcatgaaaactctcctctaaggagactggatagctctttttcatatttctttgctttgcaatcagcttgtgttgctaacctaggccaaaaaaaaaaa

SEQ ID NO: 21562 - DNA, 531 bp, Homo sapiens
  ENST00000466428
acctcgaaaccagcctctgcctgggctgttgggcgcgaggagggttgcgggaggagagttttaatctctctttgcttgcgtgcgcgatgaccctcaccccccgctaacgccgcatagtaggttttctccgtctccctgcttcgcctgtgatgtgggctaattaaatattttattgttgttcttcaggcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattggg

SEQ ID NO: 21563 - DNA, 967 bp, Homo sapiens
  ENST00000428713
gcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgagaagagggatatggggaaattgagtgaaacacgtcttagcgaagatgaacaatgcacattggggttacagagatggttttgtcgcctgtggtttatgaatgaaaaatctactactcccgtctcaaagtccaatacccctactccacgaactgatgcgcccaccccaggcagtaactctactcccggattgaggcctgtacctggaaaaccaccaggagttgaccctttgg

SEQ ID NO: 21564 - DNA, 718 bp, Homo sapiens
  ENST00000455913
aaggcctccttccttaggcaggtgtaaataaattaaacatttcttctaccgtaaataaaaagaaggcagaacaatcgaaactggggagacttggaaaacgctgaggccaaactttcgatattgatttattggggccgggagaatgaaaggttgggaagattctggggccttttgacatccttggttctttattactccggacttgattccttctcacttttttctgccattccactgaagagctgagagcccagggaagtcggatctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagaggtgag

SEQ ID NO: 21565 - DNA, 535 bp, Homo sapiens
  ENST00000496853
attctttgctgttaacttgcctgctgtgcttaggaattaagagtccgtaggataccaaattttcatcagacttttttgatgcatctgcttgggatgtataaagaaactggagatgttaagaatgctgtgtttgaatttaatttttcttagttttgtgtgttttctcttagaatttgtgtcttaaggtggttaaagatagtgatgggctcttgatttattggcataggttatatgaagatactggtttaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcagcaacaactccaggcccagcatttatcacatggacatggtctccccgtacctctgactccacacccttcagggctccagccccctgccattccacccatcggtagcagtgccgggcttctggccctctccagtgctctaggaggtc

SEQ ID NO: 21566 - DNA, 470 bp, Homo sapiens
  ENST00000474519
ttctttgctgttaacttgcctgctgtgcttaggaattaagagtccgtaggataccaaattttcatcagacttttttgatgcatctgcttgggatgtataaagaaactggagatgttaagaatgctgtgtttgaatttaatttttcttagttttgtgtgttttctcttagaatttgtgtcttaaggtggttaaagatagtgatgggctcttgatttattggcataggttatatgaagatactggtttagtattatgaaatgtcctatgggttgaatatagaaatgcacaagcaggcagagattgtcaagaggctgaatgctatctgtgcacaagtcattcctttcctgtcccaagagcagcaacaactccaggcccagcatttatcacatggacatggtctccccgtacctctgactccacacccttcagggctccagccccctgccattccacccatcggtagcagtgcc

SEQ ID NO: 21567 - DNA, 465 bp, Homo sapiens
  ENST00000483597
atctgctggagaaaatgctgtccagggcagataaaaggctcggcatggtacagagaatagactggattggccaaaagcaggctgcagttaatgtgtaaataagtgaaatcaaggccactgttgcagaggaagctgttgttaattagcaccagcaacaagtggtgcaggctgtggaacgggccaagcaggtgaccatggcagaactgaacgccatcattgggatgggcagttcatcttaaacaaaatgttggacaaaatcagtgatgaaacaactgaggatgaaggagagttggagagttgaaggagcagtgaaaaagaatggaagaaaacatgatgtgcaggtggagaggctggcctttgaaaggaaaaggacccttctctaagattagcatacaagaggaagagaagaagctcattttagaactgttctgagatagaataaaaccaaacaaggacctcaggaag

SEQ ID NO: 21568 - DNA, 717 bp, Homo sapiens
  ENST00000490347
caacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgagaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcacca

SEQ ID NO: 21569 - DNA, 475 bp, Homo sapiens
  ENST00000493163
cccatcggtagcagtgccgggcttctggccctctccagtgctctaggaggtcagtcccatcttccaattaaagatgagaagaagcaccatgacaatgatcaccaaagagacagagactccatcaagcaaaactacttgctgctcataatggatgaaattggagaccaaagaggaagaaccttctgggttcctgtcagtctaaatcctgattttaaaagacattcacctgccatgctagtgttgtgtgcttctactggtaggaaaagctaataactaccctgacgagctcaacgagtggcccgaggactgtgatctcacagtttaccgtttttgcagagagcctcttttattttcgtgtcagattatctgtaaaatggacttctccctccagtgttgtaaaccataacaattctggcattcctctaattgtgtggggagagggagtatacccaacagatgcttgtcgagcaggaga

SEQ ID NO: 21570 - DNA, 526 bp, Homo sapiens
  ENST00000463431
atacagaaccttcccactgctgcagagagttctattggatgatgctgcgtctctgacagactctgatgaggcttgctggttctgacattccttctggctaaaactgactcctgatactcaaaagcaaggttcccctggtttcatagaaaacaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctact

SEQ ID NO: 21571 - DNA, 574 bp, Homo sapiens
  ENST00000495170
tttctcctatctcctcttaacagctttgcaagtatatgctaaagaataaaaagaaaagaaagtctcaagtgacttaaaaatcactcggctaaatagatgataatttctcaaccatgcttcctctccttctaattccagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctactccacgaactgatgcgcccaccccaggcagtaactctactcccggattgaggcctgtacctggaa

SEQ ID NO: 21572 - DNA, 497 bp, Homo sapiens
  ENST00000467142
agctcttcagtatccccatcagccagtttccgaggtgctgagaagcacagaaactccgcagactactcctcagagagcaaaaagcagaaaactgaagaaaaggaaattgcagctcgttataatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaa

SEQ ID NO: 21573 - DNA, 1028 bp, Homo sapiens
  ENST00000496114
agccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccgaccaaatgcttttaccacctgagggctttccctggaaatgaactggagatggaactgccaagagatactcacagagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcg

SEQ ID NO: 21574 - DNA, 632 bp, Homo sapiens
  ENST00000417836
ggagcccagcacattcccccagagagaatggcctagacaagacacgcctgctcaagaaagatgccccgattagtccagcctctattgcatcttccagcagtactccctcctccaaatccaaagaacttagccttaagagggatatggggaaattgagtgaaacacgtcttagcgaagatgaacaatgcacattggggttacagagatggttttgtcgcctgtggtttatgaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaa

SEQ ID NO: 21575 - DNA, 672 bp, Homo sapiens
  ENST00000478290
cctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtg

SEQ ID NO: 21576 - DNA, 4871 bp, Homo sapiens
  ENST00000376544
ggagagctcgccagagcgctcgcatggcgggccggtgattgtagtcaatctggccgtattctcaggcagggtcgcccggggcggactacatctcccgggatgctgcgcggccgccccgcggaagattgtgaatatgtatcagaatgttaatgattagctgctgctaaatttggtcaaagaagtcacctacacagagcgtgttgttagagctgtgctgagcgggtgtttgggttgttggctgctttcttccccctttctcacacacttgtatattattttgaggtggtgttcgcagagtttgaaaggagagagaattaaaaaaaaaagccgcaagcgtttcactcttttatttttataatccccttcaatttggggttaaaaaaaagacaagaaaacaggaaggaagagaaataaggaaatgagatgtggtaaaagaagctaaaaggtgccttttaaaagatcgttgctgtgaagtgaaaaaaatctccagagaaaccaaaaagcaccgccgagacctcttccgaaccaaaggagtttgtgtttgcttttagggaagaagaaagatcattcattcggaggaataacaaccaattaaaagacaaataaaaaaagtttggagtgggacgcagagcgagcgagaggagctgccggcgggcggtggggcgcggagcccgcactttcccggccgggtgagcggcggccgcggcgccgggctcggcgggtgcgcctcggcggagcgaacgtcggagcgttgccttgggagacgcgcgccggacaatgcccgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccagcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttataatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaatcttcagctgtctacttggaagaacatggaataagcatacttaacagtgaaaagaatctttaattatgtattatatctgtaatatatttattttgtttaaagaaggctttctaacaatgactgactaaataaagctgtctgctcctgcattgataatgaaggtgcgttgtatttgatacccctccccccctttttttggcaaaggaggggaaaggaaggtttaaaataattgatttaaaatgtcactaagtgtagactgatgactgtatagagatgtgaaatgtataattacacatggaagcaatatgttgctgtgttgttattaggttttttttgtttttgttttctacatcttttaaagacttttggaaatttggctgaacaattagaacacaacaggccaactcatactcatttggatctatttagacaacgttaaccaatatatctatagctttagattatattcgataaaagtaattggactttttttctttttttgactcgttgacaagtgtctttgtaatatgtttttagttccctttttttgttgtattataggcagatgaacaaattaaatttggcctcaaagagagaacttactcccttctggatatttttgccacatttctttgcaaaaggagatatatatatctttagtcagttttgttgttatgagaaattatgggttattttgtggcatgctctttgggagctgcacagttatggggaggactcccactgctgtgcaagttaagtcttttacaaaacaaggacagcagaggagggtttgcagagacctccctctgaaaaacacaaagaatggactctctcctgggatgaggacttgctttctttacctccggttctttccatgtcttagttggatgtccctgaaatggacacaggctgtgccattgtgccagaaacattgtgttatcttttatgttgttgttgttgctgttaaactataatatgtgacttctttttttattattttttgtttgaatgctttaaaaatcttttaagtctgtggatctgctgatgtacagtgcctttgctgctatggatcaaaatcaaaagaaccgtgtagatatactttattgtataagtagaaaattacttaatttcatactagaaatggatggatgctgcaagttgaaatggactgtccattgacgttcctaatgtggtagcagaaaaaaaaaaatggtgtcttaagtgcttagtgtttgatgtcattaacagtttcgtaaaactctacagtgtagaaagattttgatactaaactgtgcgttgtacatagttctaatgcattgtattgaccaccagtacttctataatggtagattgtttgtgaattcagacttttaagcattaaacataaataacttctagtatgcttatttttctaattctttgtcttgatgacattagtttattttttatctttggctgtgccactcctatatattaaaaatgcctagttttttcaagggagattgttgttaaagtaaagtggttttttttgttgttaaa

SEQ ID NO: 21577 - DNA, 2100 bp, Homo sapiens
  ENST00000246112
attgatctgcttcgcggtccaggtggcggctgggtggggcctgggcgggacggggcggggacaaggcgggacgaggcggggcccgatgggtcaaatggcccccggtgggggaaggaggagtttcctcttggcctgaacttggctgacctccgcagcttccgcccgactctggctaaagtcttggaggctactgccttgaagatgacctctagggaccagcccagacccaagggccccccgaaaagcacttcgccttgtcctgggatctcgaactctgagagctctccgacgctgaattatcagggcattctaaatcggctcaagcagttccccaggttttctcctcattttgctgcggagttggagagcatttactactcgctgcacaagatccagcaggatgtggcagaacatcacaagcagataggaaacgtcttacagattgtggagagctgcagccaactccagggtttccagtctgaggaggtctcacctgctgaaccagccagccctgggacgccccagcaggtgaaggacaagaccctgcaggagtcgagctttgaggacatcatggccaccaggtcctccgactggctccggcggcctttgggggaggacaatcagccggagacccagctgttctgggacaaggagccttggttttggcacgacactctgaccgagcaactctggcggatttttgccggcgtccacgatgagaaggcaaagcccagagacagacagcaggcaccaggcctggggcaggaaagcaaggcaccaggatcctgtgacccaggaacagacccatgtcctgaagatgcctccacccccaggccacctgaggcctcctccagtccccctgagggttcccaagacaggaacacaagttggggtgtggtccaggagcctcctggaagagcctctcggtttctacagtccatatcctgggaccctgaggactttgaagatgcatggaagaggccagatgccttgcccgggcagtcaaagagactcgccgtcccgtgcaaactggaaaagatgcggatcttggcacacggggagctcgtgctcgccacggccatcagcagcttcacgcggcacgtgttcacctgtggcagaagaggcatcaaggtgtggagcctgactggacaggtggctgaggacaggttccctgagagccacctgcctatacagacccctggggccttcctgcgcacctgcctgctgtcctcaaacagcaggagcctgctcaccggtggctacaacctggccagcgtgagcgtgtgggacctggcggcgccctccctgcatgtgaaggagcagttgccctgtgcaggtctcaactgccaggccctggatgccaacctggatgccaacctggccttcgccagcttcaccagtggtgtggtcaggatctgggacctgcgggatcagagtgtggtcagggacctcaagggttatcctgatggagtcaagagtatcgtggtcaagggctacaacatctggactgggggtccggatgcctgtctgcggtgctgggaccagaggaccatcatgaaacctctggagtaccaattcaagtctcagataatgagcctgtcccacagcccccaggaggactgggtgctgctgggcatggccaatggccagcagtggctgcaaagcaccagcgggagccagcggcacatggtggggcaaaaagacagcgtcatcctgagcgtcaagttctccccctttggccagtggtgggcaagcgttggaatggacgacttccttggcgtctacagcatgccggcggggacaaaagtgttcgaggtgcctgagatgtctccagtcacgtgctgtgacgtctcttccaacaaccgcctcgttgtcacaggctccggggagcacgcctccgtgtaccagatcacctactgaggggcctcgctgctgtcatcccactccggctcctcttttcatccccccccttccccccccccaacaagggggacatggtggagggaagcgggaaggctcttctgtggcatcgcacgatctagtctgtggtgtagactggtcgccatcacgtgtaataaagcacccgggaaaggcagagtg

SEQ ID NO: 21578 - DNA, 582 bp, Homo sapiens
  ENST00000453329
aaatggcccccggtgggggaaggaggagtttcctcttggcctgaacttggctgacctccgcagcttccgcccggtgagggacactctggctaaagtcttggaggctactgccttgaagatgacctctagggaccagcccagacccaagggccccccgaaaagcacttcgccttgtcctgggatctcgaactctgagagctctccgacgctgaattatcagggcattctaaatcggctcaagcagttccccaggttttctcctcattttgctgcggagttggagagcatttactactcgctgcacaagatccagcaggatgtggcagaacatcacaagcagataggaaacgtcttacagattgtggagagctgcagccaactccagggtttccagtctgaggaggtctcacctgctgaaccagccagccctgggacgccccagcaggtgaaggacaagaccctgcaggagtcgagctttgaggacatcatggccaccaggtcctccgactggctccggcggcctttgggggaggacaatcagccggagacccagctgttctgggacaaggagccttggttttg

SEQ ID NO: 21579 - DNA, 456 bp, Homo sapiens
  ENST00000482627
gtgggggaaggaggagtttcctcttggcctgaacttggctgacctccgcagcttccgcccgactctggctaaagtcttggaggctactgccttgaagatgacctctagggaccagcccagacccaagggccccccgaaaagcacttcgccttgtcctgggatctcgaactctgagagctctccgacgctgaattatcagggcattctaaatcggctcaagcagttccccaggtgagagcaattccaggggccggaggtctcacgctgggaaggagccccacctggcctctctcccgggggtcctagtgagtggtctagaggctgctggcccaagagccaggctcaggaacaggaagccatgcagatacccagcatggagaacccggcaatacccatcccagcttttgattaaacaaaattaccaacaaatattaaaattttgattttcctgttcga

SEQ ID NO: 21580 - DNA, 785 bp, Homo sapiens
  ENST00000468176
agtttcctcttggcctgaacttggctgacctccgcagcttccgcccgactctggctaaagtcttggaggctactgccttgaagatgacctctagggaccagcccagacccaagggccccccgaaaagcacttcgccttgtcctgggatctcgaactctgagagctctccgacgctgaattatcagggcattctaaatcggctcaagcagttccccaggttttctcctcattttgctgcggagttggagagcatttactactcgctgcacaagatccagcaggatgtggcagaacatcacaagcagataggaaacgtcttacagattgtggagagctgcagccaactccagggtttccagtctgaggaggtctcacctgctgaaccagccagccctgggacgccccagcaggtgaaggacaagaccctgcaggagtcgagctttgaggacatcatggccaccaggtcctccgactggctccggcggcctttgggggaggacaatcagccggagacccagctgttctgggacaaggagccttggttttggcacgacactctgaccgagcaactctggcggatttttgccggcgtccacgatgagaaggcaaagcccagagacagacagcaggcaccaggcctggggcaggaaagcaaggcaccaggatcctgtgacccaggaacagacccatgtcctgaagatgcctccacccccaggccacctgaggcctcctccagtccccctgagggttcccaagacaggaacacaagttggggtgtggtccag

SEQ ID NO: 21581 - DNA, 1883 bp, Homo sapiens
  ENST00000452088
gaacttggctgacctccgcagcttccgcccggtgagggacccttgtcctgggatctcgaactctgagagctctccgacgctgaattatcagggcattctaaatcggctcaagcagttccccaggttttctcctcattttgctgcggagttggagagcatttactactcgctgcacaagatccagcaggatgtggcagaacatcacaagcagataggaaacgtcttacagattgtggagagctgcagccaactccagggtttccagtctgaggaggtctcacctgctgaaccagccagccctgggacgccccagcaggtgaaggacaagaccctgcaggagtcgagctttgaggacatcatggccaccaggtcctccgactggctccggcggcctttgggggaggacaatcagccggagacccagctgttctgggacaaggagccttggttttggcacgacactctgaccgagcaactctggcggatttttgccggcgtccacgatgagaaggcaaagcccagagacagacagcaggcaccaggcctggggcaggaaagcaaggcaccaggatcctgtgacccaggaacagacccatgtcctgaagatgcctccacccccaggccacctgaggcctcctccagtccccctgagggttcccaagacaggaacacaagttggggtgtggtccaggagcctcctggaagagcctctcggtttctacagtccatatcctgggaccctgaggactttgaagatgcatggaagaggccagatgccttgcccgggcagtcaaagagactcgccgtcccgtgcaaactggaaaagatgcggatcttggcacacggggagctcgtgctcgccacggccatcagcagcttcacgcggcacgtgttcacctgtggcagaagaggcatcaaggtgtggagcctgactggacaggtggctgaggacaggttccctgagagccacctgcctatacagacccctggggccttcctgcgcacctgcctgctgtcctcaaacagcaggagcctgctcaccggtggctacaacctggccagcgtgagcgtgtgggacctggcggcgccctccctgcatgtgaaggagcagttgccctgtgcaggtctcaactgccaggccctggatgccaacctggatgccaacctggccttcgccagcttcaccagtggtgtggtcaggatctgggacctgcgggatcagagtgtggtcagggacctcaagggttatcctgatggagtcaagagtatcgtggtcaagggctacaacatctggactgggggtccggatgcctgtctgcggtgctgggaccagaggaccatcatgaaacctctggagtaccaattcaagtctcagataatgagcctgtcccacagcccccaggaggactgggtgctgctgggcatggccaatggccagcagtggctgcaaagcaccagcgggagccagcggcacatggtggggcaaaaagacagcgtcatcctgagcgtcaagttctccccctttggccagtggtgggcaagcgttggaatggacgacttccttggcgtctacagcatgccggcggggacaaaagtgttcgaggtgcctgagatgtctccagtcacgtgctgtgacgtctcttccaacaaccgcctcgttgtcacaggctccggggagcacgcctccgtgtaccagatcacctactgaggggcctcgctgctgtcatcccactccggctcctcttttcatccccccccttccccccccccaacaagggggacatggtggagggaagcgggaaggctcttctgtggcatcgcacgatctagtctgtggtgtagactggtcgccatcacgtgtaataaagcacccgggaaaggca

SEQ ID NO: 21582 - DNA, 582 bp, Homo sapiens
  ENST00000591953
atacgcagggggtgagggctccagagcaaaggagccacttcggttgcagccagacccaggagggtccctgcccagcccccactgcagggggccccaggatccctggcagcccagcctggcctgtggtcctgggcagtccgcttcccccacccgctgcttccagttccgggctttcccagccgcctcgctgtgctttcaaaatcgccatcagcacagccccctcctccgacagcccgcctgccactctcccccgggagggctgctagcaggcacaagggagccacacttttcatgctgagcgcattaaagtgccgataggaaacgtcttacagattgtggagagctgcagccaactccagggtttccagtctgaggaggtctcacctgctgaaccagccagccctgggacgccccagcaggtgaaggacaagaccctgcaggagtcgagctttgaggacatcatggccaccaggtcctccgactggctccggcggcctttgggggaggacaatcagccggagacccagctgttctgggacaaggagccttggttttggcacgacactctgaccgagcaactct

SEQ ID NO: 21583 - DNA, 1270 bp, Homo sapiens
  ENST00000478073
actctcccccgggagggctgctagcaggcacaagggagccacacttttcatgctgagcgcattaaagtgccggtaaattgcgcattaacgaggcggggtgaattggagagggctcccctgggatttgctgctgctgggcgggctcagctgggaaatccatcactggctgccccaggaggcatcagcctggagtccccccccccccgcggggctccgatggagggtctcccctcccggcccctccctccgccgtcctgctaaggaaacagacagataggaaacgtcttacagattgtggagagctgcagccaactccagggtttccagtctgaggaggtctcacctgctgaaccagccagccctgggacgccccagcaggtgaaggacaagaccctgcaggagtcgagctttgaggacatcatggccaccaggtcctccgactggctccggcggcctttgggggaggacaatcagccggagacccagctgttctgggacaaggagccttggttttggcacgacactctgaccgagcaactctggcggatttttgccggcgtccacgatgagaaggcaaagcccagagacagacagcaggcaccaggcctggggcaggaaagcaaggcaccaggatcctgtgacccaggaacagacccatgtcctgaagatgcctccacccccaggccacctgaggcctcctccagtccccctgagggttcccaagacaggaacacaagttggggtgtggtccaggagcctcctggaagagcctctcggtttctacagtccatatcctgggaccctgaggactttgaagatgcatggaagaggccagatgccttgcccgggcagtcaaagagactcgccgtcccgtgcaaactggaaaagatgcggatcttggcacacggggagctcgtgctcgccacggccatcagcagcttcacgcggcacgtgttcacctgtggcagaagaggcatcaaggtgtggagcctgactggacaggtggctgaggacaggttccctgagagccacctgcctatacagacccctggggccttcctgcgcacctgcctgctgtcctcaaacagcaggagcctgctcaccggtggctacaacctggccagcgtgagcgtgtgggacctggcggcgccctccctgcatgtgaaggagcagttgccctgtgcaggtctcaactgccaggccctggatgccaacctggatgccaacctggccttcgccagcttcaccagtggtgtggtcaggatctggg

SEQ ID NO: 21584 - DNA, 1188 bp, Homo sapiens
  ENST00000474207
acaagggagccacacttttcatgctgagcgcattaaagtgccgataggaaacgtcttacagattgtggagagctgcagccaactccagggtttccagtctgaggaggtctcacctgctgaaccagccagccctgggacgccccagcaggtgaaggacaagaccctgcaggagtcgagctttgaggacatcatggccaccaggtcctccgactggctccggcggcctttgggggaggacaatcagccggagacccagctgttctgggacaaggagccttggttttggcacgacactctgaccgagcaactctggcggatttttgccggcgtccacgatgagaaggcaaagcccagagacagacgtgagtgtccctgagggtgagggggaaggggcagccacaggctgcgtctcaggggctgtgcagtgaaccctgctgttctctctgtccccctcctcctctccgttgtcatggtgacagagcaggcaccaggcctggtgagtaaacaacctcagctctatccagaggggtgggcttccgggcaggcggttgggctcccccaggtcagggcactggggttcctgtgggatttgtcttccttccatcctgcccctcgggtcccccgggggggacttgggtgatccaggaggctatactggagtagcccaggacccacagcccagggcttccaggaccctataccctgactctctctctgcaactctgcctggacccgcagacaggaccccaggcagctgacaagccctgtgcaagctgcccaggaatccgaggtcttctggtcctaacaggcaggtcagcaggcctgatgagacttttccattttccaggggcaggaaagcaaggcaccaggatcctgtgacccaggaacagacccatgtcctgaagatgcctccagtaatcccagcgggcaggggccgaccgactccaggcgggatggggtgggggcatcctgtgctgaggagccaatgcaagccgcttagcccctcttgtctccccactagcccccaggccacctgaggcctcctccagtccccctgagggttcccaagacaggaacacaagttggggtgtggtccaggtgagacccaggcccgagctggtagcccagcgtgaaggctgcccagggtggggtagaggaggtgggcacagatgtgcggggaggctgggg

SEQ ID NO: 21585 - DNA, 1559 bp, Homo sapiens
  ENST00000497878
ttccgggcaggcggttgggctcccccaggggcaggaaagcaaggcaccaggatcctgtgacccaggaacagacccatgtcctgaagatgcctccagtaatcccagcgggcaggggccgaccgactccaggcgggatggggtgggggcatcctgtgctgaggagccaatgcaagccgcttagcccctcttgtctccccactagcccccaggccacctgaggcctcctccagtccccctgagggttcccaagacaggaacacaagttggggtgtggtccaggtgagacccaggcccgagctggtagcccagcgtgaaggctgcccagggtggggtagaggaggtgggcacagatgtgcggggaggctgggggcagctgtgatctcccccgcctgcaggagcctcctggaagagcctctcggtttctacagtccatatcctgggaccctgaggactttgaagatgcatggaagaggccagatgccttgcccgggcagtcaaagagactcgccgtcccgtgcaaactggaaaagatgcggatcttggcacacggggagctcgtgctcgccacggccatcagcagcttcacgcggcacgtgttcacctgtggcagaagaggcatcaaggtgtggagcctgactggacaggtggctgaggacaggttccctgagagccacctgcctatacagacccctggggccttcctgcgcacctgcctgctgtcctcaaacagcaggagcctgctcaccggtggctacaacctggccagcgtgagcgtgtgggacctggcggcgccctccctgcatgtgaaggagcagttgccctgtgcaggtctcaactgccaggccctggatgccaacctggatgccaacctggccttcgccagcttcaccagtggtgtggtcaggatctgggacctgcgggatcagagtgtggtcagggacctcaagggttatcctgatggagtcaagagtatcgtggtcaagggctacaacatctggactgggggtccggatgcctgtctgcggtgctgggaccagaggaccatcatgaaacctctggagtaccaattcaagtctcagataatgagcctgtcccacagcccccaggaggactgggtgctgctgggcatggccaatggccagcagtggctgcaaagcaccagcgggagccagcggcacatggtggggcaaaaagacagcgtcatcctgagcgtcaagttctccccctttggccagtggtgggcaagcgttggaatggacgacttccttggcgtctacagcatgccggcggggacaaaagtgttcgaggtgcctgagatgtctccagtcacgtgctgtgacgtctcttccaacaaccgcctcgttgtcacaggctccggggagcacgcctccgtgtaccagatcacctactgaggggcctcgctgctgtcatcccactccggctcctcttttcatccccccccttccccccccccaacaagggggacatggtggagggaagcgggaaggctcttctgtggcatcgcacgatctagtctgtggtgtagactggtcgccatc

SEQ ID NO: 21586 - DNA, 713 bp, Homo sapiens
  ENST00000469572
gagagggaccccaaaatctgaaaaagaagcccctctaggccttgatgtgtggctcccactgggcaaaggggctcacaagcaggtcagttaccccaaggcctcccctcccaagatcctgggaccctgaggactttgaagatgcatggaagaggccagatgccttgcccgggcagtcaaagagactcgccgtcccgtgcaaactggaaaagatgcggatcttggcacacggggagctcgtgctcgccacggccatcagcagcttcacgcggcacgtgttcacctgtggcagaagaggcatcaaggtgtggagcctgactggacaggtggctgaggacaggttccctgagagccacctgcctatacagacccctggggccttcctgcgcacctgcctgctgtcctcaaacagcaggagcctgctcaccggtggctacaacctggccagcgtgagcgtgtgggacctggcggcgccctccctgcatgtgaaggagcagttgccctgtgcaggtctcaactgccaggccctggatgccaacctggatgccaacctggccttcgccagcttcaccagtggtgtggtcaggatctgggacctgcgggatcagagtgtggtcagggacctcaagggttatcctgatggagtcaagagtatcgtggtcaagggctacaacatctggactgggggtccggatgcctgtctgcggtgctgggac

SEQ ID NO: 21587 - DNA, 6708 bp, Homo sapiens
  ENST00000061240
ctcacacttttgctctcttgcagtcagttgctttgctggcttctgcaggcttttaaggtctcgcggcgtagaaatgcctggcccccacccccttcctcggtctcccctttcaattcagatgtgctgatgtgcagaccggattcatcttctcggagctgcggcggcggctttgggctcaggcggcggcggctcgcgctcggccgcggagtcctggcagcagcggggacgcggcgcgggagtccgagctctggtggcagctgagcccgcggggcgccgctcgccgagccgcggccgcgggaagttcggcagccagaaggacgacctggcaggctgcgagcgccagcgccgccagagccgagtttgcctgcgccctccccgcctccgagtgcagagttccttacctgccctccgcccacccgtgggcccctagccaacttctccctgcgactgggggtaacaggcagtgcttgccctctctactgtcccggcggcatccacatgtttccggacacctgagcaccccggtcccgccgaggagcctccgggtggggagaagagcaccggtgcccctagccccgcacatcagcgcggaccgcggctgcctaacctctgggtcccgtcccctccttttcctccgggggaggaggatggggttgggaacgctttccccgaggatgctcgtgtggctggtggcctcggggattgttttctacggggagctatgggtctgcgctggcctcgattatgattacacttttgatgggaacgaagaggataaaacagagactatagattacaaggacccgtgtaaagccgctgtattttggggcgatattgccttagatgatgaagacttaaatatctttcaaatagataggacaattgaccttacgcagaacccctttggaaaccttggacataccacaggtggacttggagaccatgctatgtcaaagaagcgaggggccctctaccaacttatagacaggataagaagaattggctttggcttggagcaaaacaacacagttaagggaaaagtacctctacaattctcagggcaaaatgagaaaaatcgagttcccagagccgctacatcaagaacggaaagaatatggcctggaggcgttattccttatgttataggaggaaacttcactggcagccagagagccatgttcaagcaggccatgaggcactgggaaaagcacacatgtgtgactttcatagaaagaagtgatgaagagagttacattgtattcacctataggccttgtggatgctgctcctatgtaggtcggcgaggaaatggacctcaggcaatctctatcggcaagaactgtgataaatttgggattgttgttcatgaattgggtcatgtgataggcttttggcatgaacacacaagaccagatcgagataaccacgtaactatcataagagaaaacatccagccaggtcaagagtacaattttctgaagatggagcctggagaagtaaactcacttggagaaagatatgatttcgacagtatcatgcactatgccaggaacaccttctcaagggggatgtttctggataccattctcccctcccgtgatgataatggcatacgtcctgcaattggtcagcgaacccgtctaagcaaaggagatatcgcacaggcaagaaagctgtatagatgtccagcatgtggagaaactctacaagaatccaatggcaacctttcctctccaggatttcccaatggctacccttcttacacacactgcatctggagagtttctgtgaccccaggggagaagattgttttaaattttacaacgatggatctatacaagagtagtttgtgctggtatgactatattgaagtaagagacgggtactggagaaaatcacctctccttggtagattctgtggggacaaattgcctgaagttcttacttctacagacagcagaatgtggattgagtttcgtagcagcagtaattgggtaggaaaaggctttgcagctgtctatgaagcgatctgtggaggtgagatacgtaaaaatgaaggacagattcagtctcccaattatcctgatgactatcgcccgatgaaagaatgtgtgtggaaaataacagtgtctgagagctaccacgtcgggctgacctttcagtcctttgagattgaaagacatgacaattgtgcttatgactacctggaagttagagatggaaccagtgaaaatagccctttgatagggcgtttctgtggttatgacaaacctgaagacataagatctacctccaatactttgtggatgaagtttgtttctgacggaactgtgaacaaagcagggtttgctgctaacttttttaaagaggaagatgagtgtgccaaacctgaccgtggaggctgtgagcagcgatgtctgaacactctgggcagttaccagtgtgcctgtgagcctggctatgagctgggcccagacagaaggagctgtgaagctgcttgtggtggacttcttaccaaacttaacggcaccataaccacccctggctggcccaaggagtaccctcctaataagaactgtgtgtggcaagtggttgcaccaacccagtacagaatttctgtgaagtttgagttttttgaattggaaggcaatgaagtttgcaaatatgattatgtggagatctggagtggtctttcctctgagtctaaactgcatggcaaattctgtggcgctgaagtgcctgaagtgatcacatcccagttcaacaatatgagaattgaattcaaatctgacaatactgtatccaagaagggcttcaaagcacattttttctcagacaaagatgaatgctctaaggataatggtggatgtcagcacgaatgtgtcaacacgatggggagctacatgtgtcaatgccgtaatggatttgtgctacatgacaataaacatgattgcaaggaagctgagtgtgaacagaagatccacagtccaagtggcctcatcaccagtcccaactggccagacaagtacccaagcaggaaagaatgcacttgggaaatcagcgccactcctggccaccgaatcaaattagcctttagtgaatttgagattgagcagcatcaagaatgtgcttatgaccacttagaagtatttgatggagaaacagaaaagtcaccgattcttggacgactgtgtggcaacaagataccagatccccttgtggctactggaaataaaatgtttgttcggtttgtttctgatgcatctgttcaaagaaaaggctttcaagctacacattctacagagtgtggcggacgattgaaagcagaatcaaaaccaagagatctgtactcacatgctcagtttggtgataacaactacccaggacaggttgactgtgaatggctattagtatcagaacggggctctcgacttgaattatccttccagacatttgaagtggaggaagaagcagactgtggctatgactatgtggagctctttgatggtcttgattcaacagctgtggggcttggtcgattctgtggatccgggccaccagaagagatttattcaattggagattcagttttaattcatttccacactgatgacacaatcaacaagaagggatttcatataagatacaaaagcataagatatccagataccacacataccaaaaaataacaccaaaacctctgtcagaacacaaaggaatgtgcataatggagagaagacatattttttttaaaactgaagatattggcacaaatgttttatacaaagagtttgaacaaaaaatccctgtaagaccagaattatctttgtactaaaagagaagtttccagcaaaaccctcatcagcattacaaggatatttgaactccatgcttgatggtattaataaagctggtgaaagggcatcatatacttcaaggaagactctacaagcttttgttcacagcttgaaatagatgcctcacaattcagacagtttaattcaggaactgtgaccctgcagtgttctttttgacaatttgtcaagatttagggacataaaatgatcttgcaggtcgtaaactggaaaacagtattttggttgtcttaggataattgctgactttgtatcttggatacagtgtaaaccagatccatataaggtgaatgtgaaatgggagtcttctgagggtgatttgtactttccatgtgtatgtgtgtgtctggtgtttggaaactgggatatttcagcttcattatttccacttgcaggccagcttaacctctgaaacacaaatgatcttgagaccactttagtgtacttacatttagatgagtttgaaatctcaatggtgtctaattattgcagttaaattctagacatcagttctttaagtctcagaaaacgcccagtgaattggtaaacttagttcttttttttggaagtgctgccttttcacaccaaatccaagaagcctgtgatgtcttatgaaccttatgagaaaactccgaagaggtgtgagcaggattcttctgaatgactgtctggatggttcattactcaagttactgctgctgctattgtctttcctttgttgtcgatctgttattgttgtattattattgttgatgttgtcatggttaatctattttttaaaattgaaatgaagcagaagtaggccttgtgagaactgaaaggtctctttcatttttctcttcctgggattcattttttcaaaacacaatgctggaaaaaaaagatttgtttctgaaagacttcttatggtgctattccataaactttttttcaaacaagtttttgacctttgagccaacccacccgtagactacgaatgtctccctatggctggtagcatttgaagactaaagacttgtcaaatatatcaagagtatatcattgcaagggcagcacttgtcctgtggaacaactacttataatgccttagaattcctgcacatgatcaaacagatcctcctaaaacacaccttttgaaatgttgaacataatagtgtatgttaattaacagctctatgaagaaaatccatttccatgactgaagcattggatataaatatggtgtcctgctttttttgtagaaaatgtaatttgaggatgaattttctgctttaaaggcatgtgtgtttttaaaattaatgaatgtagatgtgtgattgtctgagtgagtgaaactacaagaggtaaaaaataatgggtggttgaaaagttaaaatgtatgtgccaagttctactagaattccatttgaaatagcaccttccttaggtttcatggacaaataatgggaacttctaattttgatcaatcccattaaaaaaaggctctttcctttagagaaactctattttgatgtcaatatagattactgtatgaagtagctttgtgtctgttacctgtccatgagcatacaacattgaatacaattgggtgtattctttcagttttacacaattaaagtatacacacagatgtagcttatctgtttttttcttaaattgttgccctgaaaaaatttcttgcatatgaattgtaaaatgtaaatacatttttataaccaatgttttgatcttattgaatgttactttgaaaatgtataactattgcctgcaatgtagatgagccttttagtagagctgatttattccagtaacttcttccatattttctcactaatctcccgttagccaaaatatgccagaaatgggaaagagaggagaaaaagtcattaacattaacacctatactgttctatactactcctacccgtgtgctaggaatgtgcactagctctttttaaattccatgctacactttgaggactgtcatcatgttctcgttttgtagttcagaaagtgaggctcaaagaatttatgtaaccttcccagagtcacagtgtaaagttagatgttgaaacccagtttatcttatacaaatgagcctctgcttgttctacaaaggtagtagaatcaatctcgacctatataaatagtagattttttatggtgaaactttcccacataaagtaaattttaggggtgaattagagtaaaacttacaggataagcattttgctctttttaagaacagcatgaaatttagaataccaatgatagctatctttaagaatcagaattagtactagaaatttaaaaaaccctatagtttggagttagtatgagccttttgtgaaaataaatatattaaattattttgcctgatgtggtaggggaaatgtattgctctatattaagaaatattctggatattctgattgacatcttattaggccatagtgagctatgctctgcacaactgagaaattaggtatttagaaggcatatagagatgttgtcataactaggtcttcaacgtgaaaattaatttttattgtatcatgtcaagtatcagtttaccacatattatttttatattaattcaacatttgccttaagtgtgttgttaaatgaaagtacagacagcttcattgttgtattgttaataattgttacttactgctccaggcattttattaaattaattttttaaattattttccaccctacatcagtatattggttgtgctttatatttgccaaagtcctaactgactatacatagaaaaaaaaaaaaacactgttctcacttgattttattaaattatttttaaaagtc

SEQ ID NO: 21588 - DNA, 4787 bp, Homo sapiens
  ENST00000509505
ccttcctcggtctcccctttcaattcagatgtgctgatgtgcagaccggattcatcttctcggagctgcggcggcggctttgggctcaggcggcggcggctcgcgctcggccgcggagtcctggcagcagcggggacgcggcgcgggagtccgagctctggtggcagctgagcccgcggggcgccgctcgccgagccgcggccgcgggaagttcggcagccagaaggacgacctggcaggctgcgagcgccagcgccgccagagccgagtttgcctgcgccctccccgcctccgagtgcagagttccttacctgccctccgcccacccgtgggcccctagccaacttctccctgcgactgggggtaacaggcagtgcttgccctctctactgtcccggcggcatccacatgtttccggacacctgagcaccccggtcccgccgaggagcctccgggtggggagaagagcaccggtgcccctagccccgcacatcagcgcggaccgcggctgcctaacctctgggtcccgtcccctccttttcctccgggggaggaggatggggttgggaacgctttccccgaggatgctcgtgtggctggtggcctcggggattgttttctacggggagctatgggtctgcgctggcctcgattatgattacacttttgatgggaacgaagaggataaaacagagactatagattacaaggacccgtgtaaagccgctgtattttggggcgatattgccttagatgatgaagacttaaatatctttcaaatagataggacaattgaccttacgcagaacccctttggaaaccttggacataccacaggtggacttggagaccatgctatgtcaaagaagcgaggggccctctaccaacttatagacaggataagaagaattggctttggtatatcaatgtttaaagttgcagacgcttgacttgatgcttggagcaaaacaacacagttaagggaaaagtacctctacaattctcagggcaaaatgagaaaaatcgagttcccagagccgctacatcaagaacggaaagaatatggcctggaggcgttattccttatgttataggaggaaacttcactggcagccagagagccatgttcaagcaggccatgaggcactgggaaaagcacacatgtgtgactttcatagaaagaagtgatgaagagagttacattgtattcacctataggccttgtggatgctgctcctatgtaggtcggcgaggaaatggacctcaggcaatctctatcggcaagaactgtgataaatttgggattgttgttcatgaattgggtcatgtgataggcttttggcatgaacacacaagaccagatcgagataaccacgtaactatcataagagaaaacatccagccaggtcaagagtacaattttctgaagatggagcctggagaagtaaactcacttggagaaagatatgatttcgacagtatcatgcactatgccaggaacaccttctcaagggggatgtttctggataccattctcccctcccgtgatgataatggcatacgtcctgcaattggtcagcgaacccgtctaagcaaaggagatatcgcacaggcaagaaagctgtatagatgtccagcatgtggagaaactctacaagaatccaatggcaacctttcctctccaggatttcccaatggctacccttcttacacacactgcatctggagagtttctgtgaccccaggggagaagattgttttaaattttacaacgatggatctatacaagagtagtttgtgctggtatgactatattgaagtaagagacgggtactggagaaaatcacctctccttggtagattctgtggggacaaattgcctgaagttcttacttctacagacagcagaatgtggattgagtttcgtagcagcagtaattgggtaggaaaaggctttgcagctgtctatgaagcgatctgtggaggtgagatacgtaaaaatgaaggacagattcagtctcccaattatcctgatgactatcgcccgatgaaagaatgtgtgtggaaaataacagtgtctgagagctaccacgtcgggctgacctttcagtcctttgagattgaaagacatgacaattgtgcttatgactacctggaagttagagatggaaccagtgaaaatagccctttgatagggcgtttctgtggttatgacaaacctgaagacataagatctacctccaatactttgtggatgaagtttgtttctgacggaactgtgaacaaagcagggtttgctgctaacttttttaaagaggaagatgagtgtgccaaacctgaccgtggaggctgtgagcagcgatgtctgaacactctgggcagttaccagtgtgcctgtgagcctggctatgagctgggcccagacagaaggagctgtgaagctgcttgtggtggacttcttaccaaacttaacggcaccataaccacccctggctggcccaaggagtaccctcctaataagaactgtgtgtggcaagtggttgcaccaacccagtacagaatttctgtgaagtttgagttttttgaattggaaggcaatgaagtttgcaaatatgattatgtggagatctggagtggtctttcctctgagtctaaactgcatggcaaattctgtggcgctgaagtgcctgaagtgatcacatcccagttcaacaatatgagaattgaattcaaatctgacaatactgtatccaagaagggcttcaaagcacattttttctcagacaaagatgaatgctctaaggataatggtggatgtcagcacgaatgtgtcaacacgatggggagctacatgtgtcaatgccgtaatggatttgtgctacatgacaataaacatgattgcaaggaagctgagtgtgaacagaagatccacagtccaagtggcctcatcaccagtcccaactggccagacaagtacccaagcaggaaagaatgcacttgggaaatcagcgccactcctggccaccgaatcaaattagcctttagtgaatttgagattgagcagcatcaagaatgtgcttatgaccacttagaagtatttgatggagaaacagaaaagtcaccgattcttggacgactgtgtggcaacaagataccagatccccttgtggctactggaaataaaatgtttgttcggtttgtttctgatgcatctgttcaaagaaaaggctttcaagctacacattctacagagtgtggcggacgattgaaagcagaatcaaaaccaagagatctgtactcacatgctcagtttggtgataacaactacccaggacaggttgactgtgaatggctattagtatcagaacggggctctcgacttgaattatccttccagacatttgaagtggaggaagaagcagactgtggctatgactatgtggagctctttgatggtcttgattcaacagctgtggggcttggtcgattctgtggatccgggccaccagaagagatttattcaattggagattcagttttaattcatttccacactgatgacacaatcaacaagaagggatttcatataagatacaaaagcataagatatccagataccacacataccaaaaaataacaccaaaacctctgtcagaacacaaaggaatgtgcataatggagagaagacatattttttttaaaactgaagatattggcacaaatgttttatacaaagagtttgaacaaaaaatccctgtaagaccagaattatctttgtactaaaagagaagtttccagcaaaaccctcatcagcattacaaggatatttgaactccatgcttgatggtattaataaagctggtgaaagggcatcatatacttcaaggaagactctacaagcttttgttcacagcttgaaatagatgcctcacaattcagacagtttaattcaggaactgtgaccctgcagtgttctttttgacaatttgtcaagatttagggacataaaatgatcttgcaggtcgtaaactggaaaacagtattttggttgtcttaggataattgctgactttgtatcttggatacagtgtaaaccagatccatataaggtgaatgtgaaatgggagtcttctgagggtgatttgtactttccatgtgtatgtgtgtgtctggtgtttggaaactgggatatttcagcttcattatttccacttgcaggccagcttaacctctgaaacacaaatgatcttgagaccactttagtgtacttacatttagatgagtttgaaatctcaatggtgtctaattattgcagttaaattctagacatcagttctttaagtctcagaaaacgcccagtgaattggtaaacttagttcttttttttggaagtgctgccttttcacaccaaatccaagaagcctgtgatgtcttatgaaccttatgagaaaactccgaagaggtgtgagcaggattcttctgaatgactgtctggatggttcattactcaagttactgctgctgctattgtctttcctttgttgtcgatctgttattgttgtattattattgttgatgttgtcatggttaatctattttttaaaattgaaatgaagcagaagtaggccttgtgagaactgaaaggtctctttcatttttctcttcctgggattcattttttcaaaacacaatgctggaaaaaaaagatttgtttctgaaagacttcttatggtgctattccataaactttttttcaaacaagtttttgacctttgagccaacccacc

SEQ ID NO: 21589 - DNA, 4818 bp, Homo sapiens
  ENST00000507499
ccttcctcggtctcccctttcaattcagatgtgctgatgtgcagaccggattcatcttctcggagctgcggcggcggctttgggctcaggcggcggcggctcgcgctcggccgcggagtcctggcagcagcggggacgcggcgcgggagtccgagctctggtggcagctgagcccgcggggcgccgctcgccgagccgcggccgcgggaagttcggcagccagaaggacgacctggcaggctgcgagcgccagcgccgccagagccgagtttgcctgcgccctccccgcctccgagtgcagagttccttacctgccctccgcccacccgtgggcccctagccaacttctccctgcgactgggggtaacaggcagtgcttgccctctctactgtcccggcggcatccacatgtttccggacacctgagcaccccggtcccgccgaggagcctccgggtggggagaagagcaccggtgcccctagccccgcacatcagcgcggaccgcggctgcctaacctctgggtcccgtcccctccttttcctccgggggaggaggatggggttgggaacgctttccccgaggatgctcgtgtggctggtggcctcggggattgttttctacggggagctatgggtctgcgctggcctcgattatgattacacttttgatgggaacgaagaggataaaacagagactatagattacaaggacccgtgtaaagccgctgtattttggggcgatattgccttagatgatgaagacttaaatatctttcaaatagataggacaattgaccttacgcagaacccctttggaaaccttggacataccacaggtggacttggagaccatgctatgtcaaagaagcgaggggccctctaccaacttatagacaggataagaagaattggctttggcttggagcaaaacaacacagttaagggaaaagtacctctacaattctcagggcaaaatgagaaaaatcgagttcccagagccgctacatcaagaacggaaagaatatggcctggaggcgttattccttatgttataggaggaaacttcactggcagccagagagccatgttcaagcaggccatgaggcactgggaaaagcacacatgtgtgactttcatagaaagaagtgatgaagagagttacattgtattcacctataggccttgtggatgctgctcctatgtaggtcggcgaggaaatggacctcaggcaatctctatcggcaagaactgtgataaatttgggattgttgttcatgaattgggtcatgtgataggcttttggcatgaacacacaagaccagatcgagataaccacgtaactatcataagagaaaacatccagccaggtcaagagtacaattttctgaagatggagcctggagaagtaaactcacttggagaaagatatgatttcgacagtatcatgcactatgccaggaacaccttctcaagggggatgtttctggataccattctcccctcccgtgatgataatggcatacgtcctgcaattggtcagcgaacccgtctaagcaaaggagatatcgcacaggcaagaaagctgtatagatgtccagcatgtggagaaactctacaagaatccaatggcaacctttcctctccaggatttcccaatggctacccttcttacacacactgcatctggagagtttctgtgaccccaggggagaagattgttttaaattttacaacgatggatctatacaagagtagtttgtgctggtatgactatattgaagtaagagacgggtactggagaaaatcacctctccttggtagattctgtggggacaaattgcctgaagttcttacttctacagacagcagaatgtggattgagtttcgtagcagcagtaattgggtaggaaaaggctttgcagctgtctatgaagcgatctgtggaggtgagatacgtaaaaatgaaggacagattcagtctcccaattatcctgatgactatcgcccgatgaaagaatgtgtgtggaaaataacagtgtctgagagctaccacgtcgggctgacctttcagtcctttgagcaggagcaccaggagaatccagggattgccagtaaagccagagaatctctcatcctcatctggaagcctattgaaagacatgacaattgtgcttatgactacctggaagttagagatggaaccagtgaaaatagccctttgatagggcgtttctgtggttatgacaaacctgaagacataagatctacctccaatactttgtggatgaagtttgtttctgacggaactgtgaacaaagcagggtttgctgctaacttttttaaagaggaagatgagtgtgccaaacctgaccgtggaggctgtgagcagcgatgtctgaacactctgggcagttaccagtgtgcctgtgagcctggctatgagctgggcccagacagaaggagctgtgaagctgcttgtggtggacttcttaccaaacttaacggcaccataaccacccctggctggcccaaggagtaccctcctaataagaactgtgtgtggcaagtggttgcaccaacccagtacagaatttctgtgaagtttgagttttttgaattggaaggcaatgaagtttgcaaatatgattatgtggagatctggagtggtctttcctctgagtctaaactgcatggcaaattctgtggcgctgaagtgcctgaagtgatcacatcccagttcaacaatatgagaattgaattcaaatctgacaatactgtatccaagaagggcttcaaagcacattttttctcagacaaagatgaatgctctaaggataatggtggatgtcagcacgaatgtgtcaacacgatggggagctacatgtgtcaatgccgtaatggatttgtgctacatgacaataaacatgattgcaaggaagctgagtgtgaacagaagatccacagtccaagtggcctcatcaccagtcccaactggccagacaagtacccaagcaggaaagaatgcacttgggaaatcagcgccactcctggccaccgaatcaaattagcctttagtgaatttgagattgagcagcatcaagaatgtgcttatgaccacttagaagtatttgatggagaaacagaaaagtcaccgattcttggacgactgtgtggcaacaagataccagatccccttgtggctactggaaataaaatgtttgttcggtttgtttctgatgcatctgttcaaagaaaaggctttcaagctacacattctacagagtgtggcggacgattgaaagcagaatcaaaaccaagagatctgtactcacatgctcagtttggtgataacaactacccaggacaggttgactgtgaatggctattagtatcagaacggggctctcgacttgaattatccttccagacatttgaagtggaggaagaagcagactgtggctatgactatgtggagctctttgatggtcttgattcaacagctgtggggcttggtcgattctgtggatccgggccaccagaagagatttattcaattggagattcagttttaattcatttccacactgatgacacaatcaacaagaagggatttcatataagatacaaaagcataagatatccagataccacacataccaaaaaataacaccaaaacctctgtcagaacacaaaggaatgtgcataatggagagaagacatattttttttaaaactgaagatattggcacaaatgttttatacaaagagtttgaacaaaaaatccctgtaagaccagaattatctttgtactaaaagagaagtttccagcaaaaccctcatcagcattacaaggatatttgaactccatgcttgatggtattaataaagctggtgaaagggcatcatatacttcaaggaagactctacaagcttttgttcacagcttgaaatagatgcctcacaattcagacagtttaattcaggaactgtgaccctgcagtgttctttttgacaatttgtcaagatttagggacataaaatgatcttgcaggtcgtaaactggaaaacagtattttggttgtcttaggataattgctgactttgtatcttggatacagtgtaaaccagatccatataaggtgaatgtgaaatgggagtcttctgagggtgatttgtactttccatgtgtatgtgtgtgtctggtgtttggaaactgggatatttcagcttcattatttccacttgcaggccagcttaacctctgaaacacaaatgatcttgagaccactttagtgtacttacatttagatgagtttgaaatctcaatggtgtctaattattgcagttaaattctagacatcagttctttaagtctcagaaaacgcccagtgaattggtaaacttagttcttttttttggaagtgctgccttttcacaccaaatccaagaagcctgtgatgtcttatgaaccttatgagaaaactccgaagaggtgtgagcaggattcttctgaatgactgtctggatggttcattactcaagttactgctgctgctattgtctttcctttgttgtcgatctgttattgttgtattattattgttgatgttgtcatggttaatctattttttaaaattgaaatgaagcagaagtaggccttgtgagaactgaaaggtctctttcatttttctcttcctgggattcattttttcaaaacacaatgctggaaaaaaaagatttgtttctgaaagacttcttatggtgctattccataaactttttttcaaacaagtttttgacctttgagccaacccacc

SEQ ID NO: 21590 - DNA, 686 bp, Homo sapiens
  ENST00000504560
agccaacttctccctgcgactgggggtaacaggcagtgcttgccctctctactgtcccggcggcatccacatgtttccggacacctgagcaccccggtcccgccgaggagcctccgggtggggagaagagcaccggtgcccctagccccgcacatcagcgcggaccgcggctgcctaacctctgggtcccgtcccctccttttcctccgggggaggaggatggggttgggaacgctttccccgaggatgctcgtgtggctggtggcctcggggattgttttctacggggagctatgggtctgcgctggcctcgattatgattacacttttgatgggaacgaagaggataaaacagagactatagattacaaggacccgtgtaaagccgactgaccactgctctaagcagtgttggggcaatgcctgggctgcccgagcccttgaagttcaagaagaagcacctggacttctcatgaggggaggtcagagtcaatctgtattttggggcgatattgccttagatgatgaagacttaaatatctttcaaatagataggacaattgaccttacgcagaacccctttggaaaccttggacataccacaggtggacttggagaccatgctatgtcaaagaagcgaggggccctctaccaacttatagacaggataagaagaattggctttg

SEQ ID NO: 21591 - DNA, 1829 bp, Homo sapiens
  ENST00000513213
tcccggcggcatccacatgtttccggacacctgagcaccccggtcccgccgaggagcctccgggtggggagaagagcaccggtgcccctagccccgcacatcagcgcggaccgcggctgcctaacctctgggtcccgtcccctccttttcctccgggggaggaggatggggttgggaacgctttccccgaggatgctcgtgtggctggtggcctcggggattgttttctacggggagctatgggtctgcgctggcctcgattatgattacacttttgatgggaacgaagaggataaaacagagactatagattacaaggacccgtgtaaagccgctgtattttggggcgatattgccttagatgatgaagacttaaatatctttcaaatagataggacaattgaccttacgcagaacccctttggaaaccttggacataccacaggtggacttggagaccatgctatgtcaaagaagcgaggggccctctaccaacttatagacaggataagaagaattggctttggcttggagcaaaacaacacagttaagggaaaagtacctctacaattctcagggcaaaatgagaaaaatcgagttcccagagccgctacatcaagaacggaaagaatatggcctggaggcgttattccttatgttataggaggaaacttcactggcagccagagagccatgttcaagcaggccatgaggcactgggaaaagcacacatgtgtgactttcatagaaagaagtgatgaagagagttacattgtattcacctataggccttgtggatgctgctcctatgtaggtcggcgaggaaatggacctcaggcaatctctatcggcaagaactgtgataaatttgggattgttgttcatgaattgggtcatgtgataggcttttggcatgaacacacaagaccagatcgagataaccacgtaactatcataagagaaaacatccagccaggtcaagagtacaattttctgaagatggagcctggagaagtaaactcacttggagaaagatatgatttcgacagtatcatgcactatgccaggaacaccttctcaagggggatgtttctggataccattctcccctcccgtgatgataatggcatacgtcctgcaattggtcagcgaacccgtctaagcaaaggagatatcgcacaggcaagaaagctgtatagatgtccagcatgtggagaaactctacaagaatccaatggcaacctttcctctccaggatttcccaatggctacccttcttacacacactgcatctggagagtttctgtgaccccaggggagaaggttgtattttcactctgttgattgtgtcttctgatgaacacaaattataaagtttgatgtcataccacttgtctacttttagttttattgcctgtgcttttggtgtcatagccaagaaatcatggccatatgtaatgacatgaagtttttaccctgtgttttcttctatgagttctatagttttacagtcttatatgtaggtttttaatcaatattgtgttaatagaaaccattcttgtacatgtggatatccagtttcttcaacaccatttgttaaagatttactaaatgtttttattcagcattcctgctcatgtttctgacttctattatggcttattttggtcctgcctatagcttacattatagattattttttaaattagcgtttttgtttttttctgtttgaaaatgtggattttttacatgaatttataaaactatagtttcactggatatagttggctgcacatttaactttgttttaaataaaagcttgcaaaaat

SEQ ID NO: 21592 - DNA, 558 bp, Homo sapiens
  ENST00000506144
actggccgcggctcgtgtccgggcttcgggagctcctggttccttgctctattgggctgtggctgaggtgatccgcgctcagtgtggacgcacaactgtattttggggcgatattgccttagatgatgaagacttaaatatctttcaaatagataggacaattgaccttacgcagaacccctttggaaaccttggacataccacaggtggacttggagaccatgctatgtcaaagaagcgaggggccctctaccaacttatagacaggataagaagaattggctttggcttggagcaaaacaacacagttaagggaaaagtacctctacaattctcagggcaaaatgagaaaaatcgagttcccagagccgctacatcaagaacggaaagaatatggcctggaggcgttattccttatgttataggaggaaacttcactggcagccagagagccatgttcaagcaggccatgaggcactgggaaaagcacacatgtgtgactttcatagaaagaagtgatgaagagagttacattgtattcacctataggccttgtgg

SEQ ID NO: 21593 - DNA, 6015 bp, Homo sapiens
  ENST00000296795
tttcactttcgagagtgccgtctatttgccacacacttccctgatgaaatgtctggatttggactaaagaaaaaaggaaaggctagcagtcatccaacagaatcatgagacagactttgccttgtatctacttttgggggggccttttgccctttgggatgctgtgtgcatcctccaccaccaagtgcactgttagccatgaagttgctgactgcagccacctgaagttgactcaggtacccgatgatctacccacaaacataacagtgttgaaccttacccataatcaactcagaagattaccagccgccaacttcacaaggtatagccagctaactagcttggatgtaggatttaacaccatctcaaaactggagccagaattgtgccagaaacttcccatgttaaaagttttgaacctccagcacaatgagctatctcaactttctgataaaacctttgccttctgcacgaatttgactgaactccatctcatgtccaactcaatccagaaaattaaaaataatccctttgtcaagcagaagaatttaatcacattagatctgtctcataatggcttgtcatctacaaaattaggaactcaggttcagctggaaaatctccaagagcttctattatcaaacaataaaattcaagcgctaaaaagtgaagaactggatatctttgccaattcatctttaaaaaaattagagttgtcatcgaatcaaattaaagagttttctccagggtgttttcacgcaattggaagattatttggcctctttctgaacaatgtccagctgggtcccagccttacagagaagctatgtttggaattagcaaacacaagcattcggaatctgtctctgagtaacagccagctgtccaccaccagcaatacaactttcttgggactaaagtggacaaatctcactatgctcgatctttcctacaacaacttaaatgtggttggtaacgattcctttgcttggcttccacaactagaatatttcttcctagagtataataatatacagcatttgttttctcactctttgcacgggcttttcaatgtgaggtacctgaatttgaaacggtcttttactaaacaaagtatttcccttgcctcactccccaagattgatgatttttcttttcagtggctaaaatgtttggagcaccttaacatggaagataatgatattccaggcataaaaagcaatatgttcacaggattgataaacctgaaatacttaagtctatccaactcctttacaagtttgcgaactttgacaaatgaaacatttgtatcacttgctcattctcccttacacatactcaacctaaccaagaataaaatctcaaaaatagagagtgatgctttctcttggttgggccacctagaagtacttgacctgggccttaatgaaattgggcaagaactcacaggccaggaatggagaggtctagaaaatattttcgaaatctatctttcctacaacaagtacctgcagctgactaggaactcctttgccttggtcccaagccttcaacgactgatgctccgaagggtggcccttaaaaatgtggatagctctccttcaccattccagcctcttcgtaacttgaccattctggatctaagcaacaacaacatagccaacataaatgatgacatgttggagggtcttgagaaactagaaattctcgatttgcagcataacaacttagcacggctctggaaacacgcaaaccctggtggtcccatttatttcctaaagggtctgtctcacctccacatccttaacttggagtccaacggctttgacgagatcccagttgaggtcttcaaggatttatttgaactaaagatcatcgatttaggattgaataatttaaacacacttccagcatctgtctttaataatcaggtgtctctaaagtcattgaaccttcagaagaatctcataacatccgttgagaagaaggttttcgggccagctttcaggaacctgactgagttagatatgcgctttaatccctttgattgcacgtgtgaaagtattgcctggtttgttaattggattaacgagacccataccaacatccctgagctgtcaagccactacctttgcaacactccacctcactatcatgggttcccagtgagactttttgatacatcatcttgcaaagacagtgccccctttgaactctttttcatgatcaataccagtatcctgttgatttttatctttattgtacttctcatccactttgagggctggaggatatctttttattggaatgtttcagtacatcgagttcttggtttcaaagaaatagacagacagacagaacagtttgaatatgcagcatatataattcatgcctataaagataaggattgggtctgggaacatttctcttcaatggaaaaggaagaccaatctctcaaattttgtctggaagaaagggactttgaggcgggtgtttttgaactagaagcaattgttaacagcatcaaaagaagcagaaaaattatttttgttataacacaccatctattaaaagacccattatgcaaaagattcaaggtacatcatgcagttcaacaagctattgaacaaaatctggattccattatattggttttccttgaggagattccagattataaactgaaccatgcactctgtttgcgaagaggaatgtttaaatctcactgcatcttgaactggccagttcagaaagaacggataggtgcctttcgtcataaattgcaagtagcacttggatccaaaaactctgtacattaaatttatttaaatattcaattagcaaaggagaaactttctcaatttaaaaagttctatggcaaatttaagttttccataaaggtgttataatttgtttattcatatttgtaaatgattatattctatcacaattacatctcttctaggaaaatgtgtctccttatttcaggcctatttttgacaattgacttaattttacccaaaataaaacatataagcacgtaagaacattgtctactgattaatatacaatcagccactgagcctatgacagcttaaggagtttgaaaacattcctcattttaagaaaagttagaggtatatgagggtttgtgatgatctttttgtattttggatgcacttagaatgaaagataattgtttcaatgggtataatgctatttcctttgtaaaagagtaaaatatatacccatatttttaacaagtttaattacagtattttttcaatggaaaaactttgtattttagtaagtacttgtctcagtgttgactttgttaaatgttaaatattttttaatatacatacccaagggcagaaaacatttgcaattcatttttattagttaatgagatgattatttgaatgaatattgacttgtattttcctgagattatgagtttctgctgtgggagggtggaaacaattctcttactaaaagtattgtaggcaggcttgctttctgaaggctaatcactatttggctttgtggaaacagaactttcctcccatggtcacagactcaggagatggcgttggcaaaatcacttggtcccactgggattctttgactcctgatcttgaaaattatgataataaatgcatcttagatattcctatgtaattagtgatgatgatcgctgtataatatattcaaaggaatgtattattttaccataaaataatgtgctacgcataaggtagtccttatctagaaagactatttttatttttgtttttttgtttgtttgttttttatttgtttgtttttgagacagagtctggctctgtcgcccaggctggagttcagtggtccaacctcggcccaccgcaacctccacctctgagttcaagctattctcctgcctcagccacccgagtagctgggattacaggcacatgccaccatgcctggctaatttttgtatttttagtagagatggggtttcaccatgttggccaggctggtcttgaactcctgacctcaagtgatcctctcgccttggcctcccaaagtgctaggattacaggtgtgagccaccgcgccccgcctttttattttgttttacaatacaacaaaaaatttttagttttacaataaaagagaatctgattattggaaatagacctgaatagctttttgaaatatttatagttctagtatttaaagagaaacctgaaattataaagctgagttaatttctatacctgaaatgttcatttgtctgctgaattcagggagcatttgagatgtcacattttggaactttgatttaaatagttcagtattcccaaggctgagttccatgaccctggaatgagaaatatccactgtacctctggttctgaagagtctatagtcggccaacactgtgaatgtgtggaggactaattgtcactttcatgttatttgccaccctgacagctgagacactgcttttcagcattttagttaagatttgctttttaactgtgcaataatcattttattttggcattataaaataaaaatcacaacttctgcttttcttatatgctttgtgtgttatcacacaaatattctcaaatattcataagatattttaaataaatcattgtgaattagtcaatatatcaagttgcttaatatgtcatatatcaatgctatttaatatataatatctatatttaatatattgatatgttactggtggagagtgtccaggttcttggtgctttgaacaaggaattggacaaaatgcacaaagaatgaggcgacaaaagcagaggtttattgaaaacgaaagcacaccccgcagggtgggagcggcccgagcaagcagctcaaaagccgggttacaggattttctggggtttaaatactctctagaggtttccattggttacttggtttatgccctatgtaaatgaagaggctaaagtgaaattacaaagttatttacttgttgtgcaccctacgcaaatgaatagctgtcacagctgaggtagagttacagtgatttacttggtggtagaatgttgggatttttccatttgattgagttctaggaagcctttagtttccctgcctgcagaccccattctcctgcctcagatatatcaatgacatattcaatacatcattaagttgcttaatatttaagaggttaagatgcacaggtaatgacctctaaatgaatgccaataaaaatagtaaaaggtgtaaactctgactcctatctgacctaggtaggaagtaacatccagaacttctgcaggctgtcctgtgtaattgttctccggaggaacccttgtccctggggtttgagagaaggggatcgaggaaaaggatgtttgtctgagctcttgtttgatttgcccaagtgacttgacttgtttgaatcctctcagggtgccatcatgtaatctgtccactccaacttcttcctgtttttcacattgcaaaacaaaacccaactgaatcgacactgagtttaaaataaatcttggtatttaggttgtacctaaaaatgataacttttagactgtaatcagaggtagatgctatcaatttgttagtgaggaggggaggagttttcgatgccacttagtttacaatgtctaattgttcaaatatacatctaggttgtaaaggagactcaacggtaagttatagtgaccattgaaaaatgtaaaggggcttcaaatcaagaacttagaaggaatttcttgcaatctattgagacacaaagcagatgagtggttgtctgggcctaggaacaggaatggggagtggctgcaaataggtggaagagaccttttttgggtgatgaaagtgctctataattgggttatggtaataattgtacaactatgtaaatttactgaaagtcattgagttggacacttaaaacaggtgaattttatgatatgtaaattatatattcacaaagccattaaaaattgtattttttgagca

SEQ ID NO: 21594 - DNA, 1156 bp, Homo sapiens
  ENST00000513189
cactttcgagagtgccgtctatttgccacacacttccctgatgaaatgtctggatttggactaaagaaaaaaggaaaggctagcagtcatccaacagaatcatgagacagactttgccttgtatctacttttgggggggccttttgccctttgggatgctgtgtgcatcctccaccaccaagtgcactgttagccatgaagttgctgactgcagccacctgaagttgactcaggtacccgatgatctacccacaaacataacagtgttgaaccttacccataatcaactcagaagattaccagccgccaacttcacaaggtatagccagctaactagcttggatgtaggatttaacaccatctcaaaactggagccagaattgtgccagaaacttcccatgttaaaagttttgaacctccagcacaatgagctatctcaactttctgataaaacctttgccttctgcacgaatttgactgaactccatctcatgtccaactcaatccagaaaattaaaaataatccctttgtcaagcagaagaatttaatcacattagatctgtctcataatggcttgtcatctacaaaattaggaactcaggttcagctggaaaatctccaagagcttctattatcaaacaataaaattcaagcgctaaaaagtgaagaactggatatctttgccaattcatctttaaaaaaattagagttgtcatcgaatcaaattaaagagttttctccagggtgttttcacgcaattggaagattatttggcctctttctgaacaatgtccagctgggtcccagccttacagagaagctatgtttggaattagcaaacacaagcattcggaatctgtctctgagtaacagccagctgtccaccaccagcaatacaactttcttgggactaaagtggacaaatctcactatgctcgatctttcctacaacaacttaaatgtgtggctaaaatgtttggagcaccttaacatggaagataatgatattccaggcataaaaagcaatatgttcacaggattgataaacctgaaatacttaagtctatccaactcctttacaagtttgcgaactttgacaaatgaaacatttgtatcacttgctcattctcccttacacatactcaacctaaccaa

SEQ ID NO: 21595 - DNA, 2942 bp, Homo sapiens
  ENST00000512264
ggcaccaagacacaaccaggaactgccccaggagtgacttcacgagcagtttattcattgcaattgttctcatggtgataaagaaaaagtaccaggagatggatcctggactggaaggtcagagaagcctccctgaaaaggtggcatctaagctgaggctgtgaatgctgagcagaagttagcccgtggccaggggaggtcagaggctggagtaagaggtgggcgctgcaggaaccgagtaaggaaggactcgtgcattacaggaagggggagaaatgctctgcccatgggatgtggtgaagggtgagcggagatggagtaaagaactgcatctggccgggtgcagcggctcaggcctataatcccagcactttgggaggctgaggcgggcggatcatgaggtcaggagttcaagaccagcctggcctacacggtgaaaccccgactctactaaaaatacaaaacttagctggacgtggtggcgcatgcctgtaatcccagctactcgggaggctgaggcaggagaattgcttgaactgaggaggtggagtttgcagtgagctgagattgcactgctgtactccagcctgggcgacagagcgagactccgtctcaaaaaaaaaaaaaaaaaaaaaaaaaaaggctttcaacagcattacagagtctgtgttcttttgattgttaacctctttttttttcctacctttagttttctccagggtgttttcacgcaattggaagattatttggcctctttctgaacaatgtccagctgggtcccagccttacagagaagctatgtttggaattagcaaacacaagcattcggaatctgtctctgagtaacagccagctgtccaccaccagcaatacaactttcttgggactaaagtggacaaatctcactatgctcgatctttcctacaacaacttaaatgtggttggtaacgattcctttgcttggcttccacaactagaatatttcttcctagagtataataatatacagcatttgttttctcactctttgcacgggcttttcaatgtgaggtacctgaatttgaaacggtcttttactaaacaaagtatttcccttgcctcactccccaagattgatgatttttcttttcagtggctaaaatgtttggagcaccttaacatggaagataatgatattccaggcataaaaagcaatatgttcacaggattgataaacctgaaatacttaagtctatccaactcctttacaagtttgcgaactttgacaaatgaaacatttgtatcacttgctcattctcccttacacatactcaacctaaccaagaataaaatctcaaaaatagagagtgatgctttctcttggttgggccacctagaagtacttgacctgggccttaatgaaattgggcaagaactcacaggccaggaatggagaggtctagaaaatattttcgaaatctatctttcctacaacaagtacctgcagctgactaggaactcctttgccttggtcccaagccttcaacgactgatgctccgaagggtggcccttaaaaatgtggatagctctccttcaccattccagcctcttcgtaacttgaccattctggatctaagcaacaacaacatagccaacataaatgatgacatgttggagggtcttgagaaactagaaattctcgatttgcagcataacaacttagcacggctctggaaacacgcaaaccctggtggtcccatttatttcctaaagggtctgtctcacctccacatccttaacttggagtccaacggctttgacgagatcccagttgaggtcttcaaggatttatttgaactaaagatcatcgatttaggattgaataatttaaacacacttccagcatctgtctttaataatcaggtgtctctaaagtcattgaaccttcagaagaatctcataacatccgttgagaagaaggttttcgggccagctttcaggaacctgactgagttagatatgcgctttaatccctttgattgcacgtgtgaaagtattgcctggtttgttaattggattaacgagacccataccaacatccctgagctgtcaagccactacctttgcaacactccacctcactatcatgggttcccagtgagactttttgatacatcatcttgcaaagacagtgccccctttgaactctttttcatgatcaataccagtatcctgttgatttttatctttattgtacttctcatccactttgagggctggaggatatctttttattggaatgtttcagtacatcgagttcttggtttcaaagaaatagacagacagacagaacagtttgaatatgcagcatatataattcatgcctataaagataaggattgggtctgggaacatttctcttcaatggaaaaggaagaccaatctctcaaattttgtctggaagaaagggactttgaggcgggtgtttttgaactagaagcaattgttaacagcatcaaaagaagcagaaaaattatttttgttataacacaccatctattaaaagacccattatgcaaaagattcaaggtacatcatgcagttcaacaagctattgaacaaaatctggattccattatattggttttccttgaggagattccagattataaactgaaccatgcactctgtttgcgaagaggaatgtttaaatctcactgcatcttgaactggccagttcagaaagaacggataggtgcctttcgtcataaattgcaagtagcacttggatccaaaaactctgtacattaaatttatttaaatattcaattagcaaaggagaaactttctcaatttaaaaagttctatggcaaatttaagttttccataaaggtgttataatttgtttattcatatttgtaaatgattatattctatcacaattacatctcttctaggaaaa

SEQ ID NO: 21596 - DNA, 2310 bp, Homo sapiens
  ENST00000504367
aagacacaaccaggaactgccccaggagtgacttcacgagcagtttattcattgcaattgttctcatggtgataaagaaaaagtaccaggagatggatcctggactggaaggtcagagaagcctccctgaaaaggtggcatctaagctgaggctgtgaatgctgagcagaagttagcccgtggccaggggaggtcagaggctggagtaagagttttctccagggtgttttcacgcaattggaagattatttggcctctttctgaacaatgtccagctgggtcccagccttacagagaagctatgtttggaattagcaaacacaagcattcggaatctgtctctgagtaacagccagctgtccaccaccagcaatacaactttcttgggactaaagtggacaaatctcactatgctcgatctttcctacaacaacttaaatgtggttggtaacgattcctttgcttggcttccacaactagaatatttcttcctagagtataataatatacagcatttgttttctcactctttgcacgggcttttcaatgtgaggtacctgaatttgaaacggtcttttactaaacaaagtatttcccttgcctcactccccaagattgatgatttttcttttcagtggctaaaatgtttggagcaccttaacatggaagataatgatattccaggcataaaaagcaatatgttcacaggattgataaacctgaaatacttaagtctatccaactcctttacaagtttgcgaactttgacaaatgaaacatttgtatcacttgctcattctcccttacacatactcaacctaaccaagaataaaatctcaaaaatagagagtgatgctttctcttggttgggccacctagaagtacttgacctgggccttaatgaaattgggcaagaactcacaggccaggaatggagaggtctagaaaatattttcgaaatctatctttcctacaacaagtacctgcagctgactaggaactcctttgccttggtcccaagccttcaacgactgatgctccgaagggtggcccttaaaaatgtggatagctctccttcaccattccagcctcttcgtaacttgaccattctggatctaagcaacaacaacatagccaacataaatgatgacatgttggagggtcttgagaaactagaaattctcgatttgcagcataacaacttagcacggctctggaaacacgcaaaccctggtggtcccatttatttcctaaagggtctgtctcacctccacatccttaacttggagtccaacggctttgacgagatcccagttgaggtcttcaaggatttatttgaactaaagatcatcgatttaggattgaataatttaaacacacttccagcatctgtctttaataatcaggtgtctctaaagtcattgaaccttcagaagaatctcataacatccgttgagaagaaggttttcgggccagctttcaggaacctgactgagttagatatgcgctttaatccctttgattgcacgtgtgaaagtattgcctggtttgttaattggattaacgagacccataccaacatccctgagctgtcaagccactacctttgcaacactccacctcactatcatgggttcccagtgagactttttgatacatcatcttgcaaagacagtgccccctttgaactctttttcatgatcaataccagtatcctgttgatttttatctttattgtacttctcatccactttgagggctggaggatatctttttattggaatgtttcagtacatcgagttcttggtttcaaagaaatagacagacagacagaacagtttgaatatgcagcatatataattcatgcctataaagataaggattgggtctgggaacatttctcttcaatggaaaaggaagaccaatctctcaaattttgtctggaagaaagggactttgaggcgggtgtttttgaactagaagcaattgttaacagcatcaaaagaagcagaaaaattatttttgttataacacaccatctattaaaagacccattatgcaaaagattcaaggtacatcatgcagttcaacaagctattgaacaaaatctggattccattatattggttttccttgaggagattccagattataaactgaaccatgcactctgtttgcgaagaggaatgtttaaatctcactgcatcttgaactggccagttcagaaagaacggataggtgcctttcgtcataaattgcaagtagcacttggatccaaaaactctgtacattaaatttatttaaatattc

SEQ ID NO: 21597 - DNA, 628 bp, Homo sapiens
  ENST00000508051
gacacaaccaggaactgccccaggagtgacttcacgagcagtttattcattgcaattgttctcatggtgataaagaaaaagtaccaggagatggatcctggactggaaggtcagagaagcctccctgaaaaggtggcatctaagctgaggctgtgaatgctgagcagaagttagcccgtggccaggggaggtcagaggctggagtaagaggtgggcgctgcaggaaccgattttctccagggtgttttcacgcaattggaagattatttggcctctttctgaacaatgtccagctgggtcccagccttacagagaagctatgtttggaattagcaaacacaagcattcggaatctgtctctgagtaacagccagctgtccaccaccagcaatacaactttcttgggactaaagtggacaaatctcactatgctcgatctttcctacaacaacttaaatgtggttggtaacgattcctttgcttggcttccacaactagaatatttcttcctagagtataataatatacagcatttgttttctcactctttgcacgggcttttcaatgtgaggtacctgaatttgaaacggtcttttactaaacaaagtatttcccttgcctcactccc

SEQ ID NO: 21598 - DNA, 3908 bp, Homo sapiens
  ENST00000394487
tttgaatacaccaattgctgtggggcggctcgaggaagagaagacaccagtgcctcagaaactgctcggtcagacggtgatagcgagccacgcattcacagggccactgctgctcacagaagcagtgaggatgatgccaggatgatgtctgcctcgcgcctggctgggactctgatcccagccatggccttcctctcctgcgtgagaccagaaagctgggagccctgcgtggagacttggccctaaaccacacagaagagctggcatgaaacccagagctttcagactccggagcctcagcccttcaccccgattccattgcttcttgctaaatgctgccgttttatcacggaggtggttcctaatattacttatcaatgcatggagctgaatttctacaaaatccccgacaacctccccttctcaaccaagaacctggacctgagctttaatcccctgaggcatttaggcagctatagcttcttcagtttcccagaactgcaggtgctggatttatccaggtgtgaaatccagacaattgaagatggggcatatcagagcctaagccacctctctaccttaatattgacaggaaaccccatccagagtttagccctgggagccttttctggactatcaagtttacagaagctggtggctgtggagacaaatctagcatctctagagaacttccccattggacatctcaaaactttgaaagaacttaatgtggctcacaatcttatccaatctttcaaattacctgagtatttttctaatctgaccaatctagagcacttggacctttccagcaacaagattcaaagtatttattgcacagacttgcgggttctacatcaaatgcccctactcaatctctctttagacctgtccctgaaccctatgaactttatccaaccaggtgcatttaaagaaattaggcttcataagctgactttaagaaataattttgatagtttaaatgtaatgaaaacttgtattcaaggtctggctggtttagaagtccatcgtttggttctgggagaatttagaaatgaaggaaacttggaaaagtttgacaaatctgctctagagggcctgtgcaatttgaccattgaagaattccgattagcatacttagactactacctcgatgatattattgacttatttaattgtttgacaaatgtttcttcattttccctggtgagtgtgactattgaaagggtaaaagacttttcttataatttcggatggcaacatttagaattagttaactgtaaatttggacagtttcccacattgaaactcaaatctctcaaaaggcttactttcacttccaacaaaggtgggaatgctttttcagaagttgatctaccaagccttgagtttctagatctcagtagaaatggcttgagtttcaaaggttgctgttctcaaagtgattttgggacaaccagcctaaagtatttagatctgagcttcaatggtgttattaccatgagttcaaacttcttgggcttagaacaactagaacatctggatttccagcattccaatttgaaacaaatgagtgagttttcagtattcctatcactcagaaacctcatttaccttgacatttctcatactcacaccagagttgctttcaatggcatcttcaatggcttgtccagtctcgaagtcttgaaaatggctggcaattctttccaggaaaacttccttccagatatcttcacagagctgagaaacttgaccttcctggacctctctcagtgtcaactggagcagttgtctccaacagcatttaactcactctccagtcttcaggtactaaatatgagccacaacaacttcttttcattggatacgtttccttataagtgtctgaactccctccaggttcttgattacagtctcaatcacataatgacttccaaaaaacaggaactacagcattttccaagtagtctagctttcttaaatcttactcagaatgactttgcttgtacttgtgaacaccagagtttcctgcaatggatcaaggaccagaggcagctcttggtggaagttgaacgaatggaatgtgcaacaccttcagataagcagggcatgcctgtgctgagtttgaatatcacctgtcagatgaataagaccatcattggtgtgtcggtcctcagtgtgcttgtagtatctgttgtagcagttctggtctataagttctattttcacctgatgcttcttgctggctgcataaagtatggtagaggtgaaaacatctatgatgcctttgttatctactcaagccaggatgaggactgggtaaggaatgagctagtaaagaatttagaagaaggggtgcctccatttcagctctgccttcactacagagactttattcccggtgtggccattgctgccaacatcatccatgaaggtttccataaaagccgaaaggtgattgttgtggtgtcccagcacttcatccagagccgctggtgtatctttgaatatgagattgctcagacctggcagtttctgagcagtcgtgctggtatcatcttcattgtcctgcagaaggtggagaagaccctgctcaggcagcaggtggagctgtaccgccttctcagcaggaacacttacctggagtgggaggacagtgtcctggggcggcacatcttctggagacgactcagaaaagccctgctggatggtaaatcatggaatccagaaggaacagtgggtacaggatgcaattggcaggaagcaacatctatctgaagaggaaaaataaaaacctcctgaggcatttcttgcccagctgggtccaacacttgttcagttaataagtattaaatgctgccacatgtcaggccttatgctaagggtgagtaattccatggtgcactagatatgcagggctgctaatctcaaggagcttccagtgcagagggaataaatgctagactaaaatacagagtcttccaggtgggcatttcaaccaactcagtcaaggaacccatgacaaagaaagtcatttcaactcttacctcatcaagttgaataaagacagagaaaacagaaagagacattgttcttttcctgagtcttttgaatggaaattgtattatgttatagccatcataaaaccattttggtagttttgactgaactgggtgttcactttttcctttttgattgaatacaatttaaattctacttgatgactgcagtcgtcaaggggctcctgatgcaagatgccccttccattttaagtctgtctccttacagaggttaaagtctagtggctaattcctaaggaaacctgattaacacatgctcacaaccatcctggtcattctcgagcatgttctattttttaactaatcacccctgatatatttttatttttatatatccagttttcatttttttacgtcttgcctataagctaatatcataaataaggttgtttaagacgtgcttcaaatatccatattaaccactatttttcaaggaagtatggaaaagtacactctgtcactttgtcactcgatgtcattccaaagttattgcctactaagtaatgactgtcatgaaagcagcattgaaataatttgtttaaagggggcactcttttaaacgggaagaaaatttccgcttcctggtcttatcatggacaatttgggctagaggcaggaaggaagtgggatgacctcaggaggtcaccttttcttgattccagaaacatatgggctgataaacccggggtgacctcatgaaatgagttgcagcagaagtttatttttttcagaacaagtgatgtttgatggacctctgaatctctttagggagacacagatggctgggatccctcccctgtacccttctcactgccaggagaacta

SEQ ID NO: 21599 - DNA, 4844 bp, Homo sapiens
  ENST00000355622
aagacaccagtgcctcagaaactgctcggtcagacggtgatagcgagccacgcattcacagggccactgctgctcacagaagcagtgaggatgatgccaggatgatgtctgcctcgcgcctggctgggactctgatcccagccatggccttcctctcctgcgtgagaccagaaagctgggagccctgcgtggaggtggttcctaatattacttatcaatgcatggagctgaatttctacaaaatccccgacaacctccccttctcaaccaagaacctggacctgagctttaatcccctgaggcatttaggcagctatagcttcttcagtttcccagaactgcaggtgctggatttatccaggtgtgaaatccagacaattgaagatggggcatatcagagcctaagccacctctctaccttaatattgacaggaaaccccatccagagtttagccctgggagccttttctggactatcaagtttacagaagctggtggctgtggagacaaatctagcatctctagagaacttccccattggacatctcaaaactttgaaagaacttaatgtggctcacaatcttatccaatctttcaaattacctgagtatttttctaatctgaccaatctagagcacttggacctttccagcaacaagattcaaagtatttattgcacagacttgcgggttctacatcaaatgcccctactcaatctctctttagacctgtccctgaaccctatgaactttatccaaccaggtgcatttaaagaaattaggcttcataagctgactttaagaaataattttgatagtttaaatgtaatgaaaacttgtattcaaggtctggctggtttagaagtccatcgtttggttctgggagaatttagaaatgaaggaaacttggaaaagtttgacaaatctgctctagagggcctgtgcaatttgaccattgaagaattccgattagcatacttagactactacctcgatgatattattgacttatttaattgtttgacaaatgtttcttcattttccctggtgagtgtgactattgaaagggtaaaagacttttcttataatttcggatggcaacatttagaattagttaactgtaaatttggacagtttcccacattgaaactcaaatctctcaaaaggcttactttcacttccaacaaaggtgggaatgctttttcagaagttgatctaccaagccttgagtttctagatctcagtagaaatggcttgagtttcaaaggttgctgttctcaaagtgattttgggacaaccagcctaaagtatttagatctgagcttcaatggtgttattaccatgagttcaaacttcttgggcttagaacaactagaacatctggatttccagcattccaatttgaaacaaatgagtgagttttcagtattcctatcactcagaaacctcatttaccttgacatttctcatactcacaccagagttgctttcaatggcatcttcaatggcttgtccagtctcgaagtcttgaaaatggctggcaattctttccaggaaaacttccttccagatatcttcacagagctgagaaacttgaccttcctggacctctctcagtgtcaactggagcagttgtctccaacagcatttaactcactctccagtcttcaggtactaaatatgagccacaacaacttcttttcattggatacgtttccttataagtgtctgaactccctccaggttcttgattacagtctcaatcacataatgacttccaaaaaacaggaactacagcattttccaagtagtctagctttcttaaatcttactcagaatgactttgcttgtacttgtgaacaccagagtttcctgcaatggatcaaggaccagaggcagctcttggtggaagttgaacgaatggaatgtgcaacaccttcagataagcagggcatgcctgtgctgagtttgaatatcacctgtcagatgaataagaccatcattggtgtgtcggtcctcagtgtgcttgtagtatctgttgtagcagttctggtctataagttctattttcacctgatgcttcttgctggctgcataaagtatggtagaggtgaaaacatctatgatgcctttgttatctactcaagccaggatgaggactgggtaaggaatgagctagtaaagaatttagaagaaggggtgcctccatttcagctctgccttcactacagagactttattcccggtgtggccattgctgccaacatcatccatgaaggtttccataaaagccgaaaggtgattgttgtggtgtcccagcacttcatccagagccgctggtgtatctttgaatatgagattgctcagacctggcagtttctgagcagtcgtgctggtatcatcttcattgtcctgcagaaggtggagaagaccctgctcaggcagcaggtggagctgtaccgccttctcagcaggaacacttacctggagtgggaggacagtgtcctggggcggcacatcttctggagacgactcagaaaagccctgctggatggtaaatcatggaatccagaaggaacagtgggtacaggatgcaattggcaggaagcaacatctatctgaagaggaaaaataaaaacctcctgaggcatttcttgcccagctgggtccaacacttgttcagttaataagtattaaatgctgccacatgtcaggccttatgctaagggtgagtaattccatggtgcactagatatgcagggctgctaatctcaaggagcttccagtgcagagggaataaatgctagactaaaatacagagtcttccaggtgggcatttcaaccaactcagtcaaggaacccatgacaaagaaagtcatttcaactcttacctcatcaagttgaataaagacagagaaaacagaaagagacattgttcttttcctgagtcttttgaatggaaattgtattatgttatagccatcataaaaccattttggtagttttgactgaactgggtgttcactttttcctttttgattgaatacaatttaaattctacttgatgactgcagtcgtcaaggggctcctgatgcaagatgccccttccattttaagtctgtctccttacagaggttaaagtctagtggctaattcctaaggaaacctgattaacacatgctcacaaccatcctggtcattctcgagcatgttctattttttaactaatcacccctgatatatttttatttttatatatccagttttcatttttttacgtcttgcctataagctaatatcataaataaggttgtttaagacgtgcttcaaatatccatattaaccactatttttcaaggaagtatggaaaagtacactctgtcactttgtcactcgatgtcattccaaagttattgcctactaagtaatgactgtcatgaaagcagcattgaaataatttgtttaaagggggcactcttttaaacgggaagaaaatttccgcttcctggtcttatcatggacaatttgggctagaggcaggaaggaagtgggatgacctcaggaggtcaccttttcttgattccagaaacatatgggctgataaacccggggtgacctcatgaaatgagttgcagcagaagtttatttttttcagaacaagtgatgtttgatggacctctgaatctctttagggagacacagatggctgggatccctcccctgtacccttctcactgccaggagaactacgtgtgaaggtattcaaggcagggagtatacattgctgtttcctgttgggcaatgctccttgaccacattttgggaagagtggatgttatcattgagaaaacaatgtgtctggaattaatggggttcttataaagaaggttcccagaaaagaatgttcatccagcctcctcagaaacagaacattcaagaaaaggacaatcaggatgtcatcagggaaatgaaaataaaaaccacaatgagatatcaccttataccaggtagaatggctactataaaaaaatgaagtgtcatcaaggatatagagaaattggaacccttcttcactgctggagggaatggaaaatggtgtagccgttatgaaaaacagtacggaggtttctcaaaaattaaaaatagaactgctatatgatccagcaatctcacttctgtatatatacccaaaataattgaaatcagaatttcaagaaaatatttacactcccatgttcattgtggcactcttcacaatcactgtttccaaagttatggaaacaacccaaatttccattgaaaaataaatggacaaagaaaatgtgcatatacgtacaatgggatattattcagcctaaaaaaagggggaatcctgttatttatgacaacatgaataaacccggaggccattatgctatgtaaaatgagcaagtaacagaaagacaaatactgcctgatttcatttatatgaggttctaaaatagtcaaactcatagaagcagagaatagaacagtggttcctagggaaaaggaggaagggagaaatgaggaaatagggagttgtctaattggtataaaattatagtatgcaagatgaattagctctaaagatcagctgtatagcagagttcgtataatgaacaatactgtattatgcacttaacattttgttaagagggtacctctcatgttaagtgttcttaccatatacatatacacaaggaagcttttggaggtgatggatatatttattaccttgattgtggtgatggtttgacaggtatgtgactatgtctaaactcatcaaattgtatacattaaatatatgcagttttataatatcaa

SEQ ID NO: 21600 - DNA, 2741 bp, Homo sapiens
  ENST00000472304
gaaactgctcggtcagacggtgatagcgagccacgcattcacagggccactgctgctcacagaagcagtgaggatgatgccaggatgatgtctgcctcgcgcctggctgggactctgatcccagccatggccttcctctcctgcgtgagaccagaaagctgggagccctgcgtggaggtgtgaaatccagacaattgaagatggggcatatcagagcctaagccacctctctaccttaatattgacaggaaaccccatccagagtttagccctgggagccttttctggactatcaagtttacagaagctggtggctgtggagacaaatctagcatctctagagaacttccccattggacatctcaaaactttgaaagaacttaatgtggctcacaatcttatccaatctttcaaattacctgagtatttttctaatctgaccaatctagagcacttggacctttccagcaacaagattcaaagtatttattgcacagacttgcgggttctacatcaaatgcccctactcaatctctctttagacctgtccctgaaccctatgaactttatccaaccaggtgcatttaaagaaattaggcttcataagctgactttaagaaataattttgatagtttaaatgtaatgaaaacttgtattcaaggtctggctggtttagaagtccatcgtttggttctgggagaatttagaaatgaaggaaacttggaaaagtttgacaaatctgctctagagggcctgtgcaatttgaccattgaagaattccgattagcatacttagactactacctcgatgatattattgacttatttaattgtttgacaaatgtttcttcattttccctggtgagtgtgactattgaaagggtaaaagacttttcttataatttcggatggcaacatttagaattagttaactgtaaatttggacagtttcccacattgaaactcaaatctctcaaaaggcttactttcacttccaacaaaggtgggaatgctttttcagaagttgatctaccaagccttgagtttctagatctcagtagaaatggcttgagtttcaaaggttgctgttctcaaagtgattttgggacaaccagcctaaagtatttagatctgagcttcaatggtgttattaccatgagttcaaacttcttgggcttagaacaactagaacatctggatttccagcattccaatttgaaacaaatgagtgagttttcagtattcctatcactcagaaacctcatttaccttgacatttctcatactcacaccagagttgctttcaatggcatcttcaatggcttgtccagtctcgaagtcttgaaaatggctggcaattctttccaggaaaacttccttccagatatcttcacagagctgagaaacttgaccttcctggacctctctcagtgtcaactggagcagttgtctccaacagcatttaactcactctccagtcttcaggtactaaatatgagccacaacaacttcttttcattggatacgtttccttataagtgtctgaactccctccaggttcttgattacagtctcaatcacataatgacttccaaaaaacaggaactacagcattttccaagtagtctagctttcttaaatcttactcagaatgactttgcttgtacttgtgaacaccagagtttcctgcaatggatcaaggaccagaggcagctcttggtggaagttgaacgaatggaatgtgcaacaccttcagataagcagggcatgcctgtgctgagtttgaatatcacctgtcagatgaataagaccatcattggtgtgtcggtcctcagtgtgcttgtagtatctgttgtagcagttctggtctataagttctattttcacctgatgcttcttgctggctgcataaagtatggtagaggtgaaaacatctatgatgcctttgttatctactcaagccaggatgaggactgggtaaggaatgagctagtaaagaatttagaagaaggggtgcctccatttcagctctgccttcactacagagactttattcccggtgtggccattgctgccaacatcatccatgaaggtttccataaaagccgaaaggtgattgttgtggtgtcccagcacttcatccagagccgctggtgtatctttgaatatgagattgctcagacctggcagtttctgagcagtcgtgctggtatcatcttcattgtcctgcagaaggtggagaagaccctgctcaggcagcaggtggagctgtaccgccttctcagcaggaacacttacctggagtgggaggacagtgtcctggggcggcacatcttctggagacgactcagaaaagccctgctggatggtaaatcatggaatccagaaggaacagtgggtacaggatgcaattggcaggaagcaacatctatctgaagaggaaaaataaaaacctcctgaggcatttcttgcccagctgggtccaacacttgttcagttaataagtattaaatgctgccacatgtcaggccttatgctaagggtgagtaattccatggtgcactagatatgcagggctgctaatctcaaggagcttccagtgcagagggaataaatgctagactaaaatacagagtcttccaggtgggcatttcaaccaactcagtcaaggaacccatgacaaagaaagtcatttcaactcttacctcatcaagttgaataaagacagagaaaacagaaa

SEQ ID NO: 21601 - DNA, 539 bp, Homo sapiens
  ENST00000490685
agacttggccctaaaccacacagaagagctggcatgaaacccagagctttcagactccggagcctcagcccttcaccccgattccattgcttcttgctaaatgctgccgttttatcacggaggtggttcctaatattacttatcaatgcatggagctgaatttctacaaaatccccgacaacctccccttctcaaccaagaacctggacctgagctttaatcccctgaggcatttaggcagctatagcttcttcagtttcccagaactgcaggtgctggatttatccaggtaatgaatccacttttacatactgcacaaggtgaggtgttcattgtcctgtcatttcattattggactggaaagcttggtttgtggagtctcatcttcattcacttattcattcatacaacagatgtcttattaactatataaccttgagcaagctacctctattctccaggtctcagttttctaatctgtgaagtaggcagttggctgagacagcttctaagggcaattctaattttaggttttcttt

SEQ ID NO: 21602 - DNA, 3295 bp, Homo sapiens
  ENST00000456845
ggggttgtggttgaggccgggtctccgctcctgtgcccgggaagatggtgctaggtggttgcccgaatcttgttgtttgcctactgaagagatgaaaccatggcagaagtagaatccttatagaaacaggaccagaaacacctcccttctccaacaaaaggttcattttggtggctgtccgtttgacctgctgtgcttcagtttaattggcttggaaaggggtcagcagggtgaaaccgaaccccagaaaacttgatgaagaaatgtcttttgcccgttttgattacgtgcatgcaaacagcgatttgcaaagaccgtatgatgatgatcatgatcttactggtgaattacagacctgatgaatttatagaatgtgaagacccagtggatcatgttggaaatgcaactgcatcccaggaacttggttatggttgtctcaagttcggcggtcaggcctacagcgacgtggaacacacttcagtccagtgccatgccttagatggaattgagtgtgccagtcctaggacctttctacgagaaaataaaccttgtataaagtataccggacactacttcataaccactttactctactccttcttcctgggatgttttggtgtggatcgattctgtttgggacacactggcactgcagtagggaagctgttgacgcttggaggacttgggatttggtggtttgttgaccttattttgctaattactggagggctgatgccaagtgatggcagcaactggtgcactgtttactaagaagagctgccatcatggcccagggaggcgggtgaaagctccgtcttctgaattcatctctacaggctcaaaactcctctttgatatcagacctgatgttattttccttcttttggagggcatttgtttggttaagaaggcttctttggactttggaatttcaacccagattttaccttgcagacggaatgacaagcaaaaagtgttgtggggaatcaaatttgttcctttcctcatgcacaaaacataaaggatagtggcgagtttacaagctgtggatgggtttccatagtcttcctttctgtacattgctatatcttcagtcctttggagcaagtggacctaacaagttgagcaaaatgaatatttggatccatgttcctcttgtgaccctgagtcttcatgcaaggagatctgaagctgaacaatgaaaatcttcagcagaaatagaaatggccgtggattgtaatacacactgaaattctgactttctgaatttaaatgtagaataaattttaccaacttggagtactgtatgagtattttcagtagggggaataaactcaaaattatatttgttttgcagaaacctagtcatttgaaatgagccatcctattaagccctcttttgtctccattatgttccagaggcagtatatgcagtgcaataattttttcattccacttatgttttgaaagccagcggcatcagatgtgtgagttgagctattcctcctggcagaattgtccaatctaaaaatcagcgtttaccagcccatgctaataaaattaagatttcatacaagtttctgtaaaactattcttcatgattagctctccctgtgggctgcagcagtcagaaagagataacagccacacctctgcattccccggtcaccaggaataaaaggaaatgttccagattgtaagtggttttaaaaactcagttctcatcgtttgcaatctaagttgaaagaactattaaatataaaatcaaaggtgggcaatgtggccaagtcaatggaagaggctttactcagaataacttacaaattctagaaacaaggtagaactcactcagtttacctaataataattgaatttaagaccaaatatcacagttgaaataacttccctggatacattctatcattttgtagctttcctaagaatttcttgctttatcattcctgattaatcactgtttttacattattaaaggtggcaattttctgtaaaaaatttaaaacagatgatcctattctgtcttgaaagttctgtaccacactgaccttaaccttgcttataacataacaattggtaaacttttaattcataatctttataccctaagatagtatttattaaatttttatgggtcatgaagaaactagaccctctccccagaaaaatctacatacacagaatttacatagaacttgggttcatctacacaatttatgcatgaaataaaattgtactggtaccctataaatttatacaaataaaagagtttaagggagttcaaggatgccatatgtatattttaaaaaaatttctaagggaagtctaaaaaacataaattataatattacccaaaataagatgctacttttcacctaaccaagtcctgcctcatttcacactttaacctcctaagtatattcataaccctaccaaaagttgttttctttaaaaaataagaaactttagggccagcgcaatggtgcaagcctgtaatccctgcactttgggaggccgaggcaggtgaatcctttaaggtcaggagttcgagaccagcctggccaacatggtgagacacactcccccacccccgcccagtctctagtaaaaatgcaaaaattagccgggcgtggtggcgtgcacctgtaatcccagctactcgggaggctgaggtaagagaatcacttgaactgaggaggcagagattgcagtgagccgagatcctgccactgcacttcagcctgggcaacagagtgagactctgaccaaaaaagaaattttgcagctccaaggcttgaagtcatttatgttgccaggggtaagagcttggttgaagggctaaaagactagaaactactgaagatgcccttcttactgtcagtaaagctgctggagacaaaagaagttgttctcgctgctagagtggtaatttgagaatcatcagtattcctatgtgacaatccaaaattactggttttcatttgacttgtaaatgacacccatcatccatctgcccacaaacctggccaaatgtgatacaacctgaaaacctgatggactaaaggagtactatttaacaattgattgcctttgcactttattcaggttgtttcttaaattttggtagacagatccatttgtatatgtgtgtgttatatctagtttatggctatagagaaggtttaaaatactacagtgtccttccctcaaggttaaattagaagctgcctgccttttagttgtttcttgcctttaataaaatgttatcagttcccccaga

SEQ ID NO: 21603 - DNA, 3263 bp, Homo sapiens
  ENST00000456397
ctacgcggaaaggcctgaccacgcagttcttgggtctgtgctgctggcctggggttgtggttgaggccgggtctccgctcctgtgcccgggaagatggtgctaggtggttgcccggttagttacttacttctgtgcggccaggcggctttgctgctggggaatttacttctgctgcattgtgtgtctcggagccactcgcaaaatgcgaccgctgagcctgagctcacatccgctggcgccgcccagccggagggccccgggggtgctgcgagctgggaatatggcgacccccactctccggtcatcctctgctcttacctacctgatgaatttatagaatgtgaagacccagtggatcatgttggaaatgcaactgcatcccaggaacttggttatggttgtctcaagttcggcggtcaggcctacagcgacgtggaacacacttcagtccagtgccatgccttagatggaattgagtgtgccagtcctaggacctttctacgagaaaataaaccttgtataaagtataccggacactacttcataaccactttactctactccttcttcctgggatgttttggtgtggatcgattctgtttgggacacactggcactgcagtagggaagctgttgacgcttggaggacttgggatttggtggtttgttgaccttattttgctaattactggagggctgatgccaagtgatggcagcaactggtgcactgtttactaagaagagctgccatcatggcccagggaggcgggtgaaagctccgtcttctgaattcatctctacaggctcaaaactcctctttgatatcagacctgatgttattttccttcttttggagggcatttgtttggttaagaaggcttctttggactttggaatttcaacccagattttaccttgcagacggaatgacaagcaaaaagtgttgtggggaatcaaatttgttcctttcctcatgcacaaaacataaaggatagtggcgagtttacaagctgtggatgggtttccatagtcttcctttctgtacattgctatatcttcagtcctttggagcaagtggacctaacaagttgagcaaaatgaatatttggatccatgttcctcttgtgaccctgagtcttcatgcaaggagatctgaagctgaacaatgaaaatcttcagcagaaatagaaatggccgtggattgtaatacacactgaaattctgactttctgaatttaaatgtagaataaattttaccaacttggagtactgtatgagtattttcagtagggggaataaactcaaaattatatttgttttgcagaaacctagtcatttgaaatgagccatcctattaagccctcttttgtctccattatgttccagaggcagtatatgcagtgcaataattttttcattccacttatgttttgaaagccagcggcatcagatgtgtgagttgagctattcctcctggcagaattgtccaatctaaaaatcagcgtttaccagcccatgctaataaaattaagatttcatacaagtttctgtaaaactattcttcatgattagctctccctgtgggctgcagcagtcagaaagagataacagccacacctctgcattccccggtcaccaggaataaaaggaaatgttccagattgtaagtggttttaaaaactcagttctcatcgtttgcaatctaagttgaaagaactattaaatataaaatcaaaggtgggcaatgtggccaagtcaatggaagaggctttactcagaataacttacaaattctagaaacaaggtagaactcactcagtttacctaataataattgaatttaagaccaaatatcacagttgaaataacttccctggatacattctatcattttgtagctttcctaagaatttcttgctttatcattcctgattaatcactgtttttacattattaaaggtggcaattttctgtaaaaaatttaaaacagatgatcctattctgtcttgaaagttctgtaccacactgaccttaaccttgcttataacataacaattggtaaacttttaattcataatctttataccctaagatagtatttattaaatttttatgggtcatgaagaaactagaccctctccccagaaaaatctacatacacagaatttacatagaacttgggttcatctacacaatttatgcatgaaataaaattgtactggtaccctataaatttatacaaataaaagagtttaagggagttcaaggatgccatatgtatattttaaaaaaatttctaagggaagtctaaaaaacataaattataatattacccaaaataagatgctacttttcacctaaccaagtcctgcctcatttcacactttaacctcctaagtatattcataaccctaccaaaagttgttttctttaaaaaataagaaactttagggccagcgcaatggtgcaagcctgtaatccctgcactttgggaggccgaggcaggtgaatcctttaaggtcaggagttcgagaccagcctggccaacatggtgagacacactcccccacccccgcccagtctctagtaaaaatgcaaaaattagccgggcgtggtggcgtgcacctgtaatcccagctactcgggaggctgaggtaagagaatcacttgaactgaggaggcagagattgcagtgagccgagatcctgccactgcacttcagcctgggcaacagagtgagactctgaccaaaaaagaaattttgcagctccaaggcttgaagtcatttatgttgccaggggtaagagcttggttgaagggctaaaagactagaaactactgaagatgcccttcttactgtcagtaaagctgctggagacaaaagaagttgttctcgctgctagagtggtaatttgagaatcatcagtattcctatgtgacaatccaaaattactggttttcatttgacttgtaaatgacacccatcatccatctgcccacaaacctggccaaatgtgatacaacctgaaaacctgatggactaaaggagtactatttaacaattgattgcctttgcactttattcaggttgtttcttaaattttggtagacagatccatttgtatatgtgtgtgttatatctagtttatggctatagagaaggtttaaaatactacagtgtccttccctcaaggttaaattagaagctgcctgccttttagttgtttcttgcctttaataaaatgttatcagttcccccaga

SEQ ID NO: 21604 - DNA, 1631 bp, Homo sapiens
  ENST00000397070
agttcttgggtctgtgctgctggcctggggttgtggttgaggccgggtctccgctcctgtgcccgggaagatggtgctaggtggttgcccggttagttacttacttctgtgcggccaggcggctttgctgctggggaatttacttctgctgcattgtgtgtctcggagccactcgcaaaatgcgaccgctgagcctgagctcacatccgctggcgccgcccagccggagggccccgggggtgctgcgagctgggaatatggcgacccccactctccggtcatcctctgctcttacctaatcacgccattttttaacatctctttttgatcaaacaagaaaaggcatttgggaaatgcaaagaggactgagaatactttggcttaaattttgcccccagaatcttgttgtttgcctactgaagagatgaaaccatggcagaagtagaatccttatagaaacaggaccagaaacacctcccttctccaacaaaaggttcattttggtggctgtccgtttgacctgctgtgcttcagtttaattggcttggaaaggggtcagcagggtgaaaccgaaccccagaaaacttgatgaagaaatgtcttttgcccgttttgattacgtgcatgcaaacagcgatttgcaaagaccgtatgatgatgatcatgatcttactggtgaattacagacctgatgaatttatagaatgtgaagacccagtggatcatgttggaaatgcaactgcatcccaggaacttggttatggttgtctcaagttcggcggtcaggcctacagcgacgtggaacacacttcagtccagtgccatgccttagatggaattgagtgtgccagtcctaggacctttctacgagaaaataaaccttgtataaagtataccggacactacttcataaccactttactctactccttcttcctgggatgttttggtgtggatcgattctgtttgggacacactggcactgcagtagggaagctgttgacgcttggaggacttgggatttggtggtttgttgaccttattttgctaattactggagggctgatgccaagtgatggcagcaactggtgcactgtttactaagaagagctgccatcatggcccagggaggcgggtgaaagctccgtcttctgaattcatctctacaggctcaaaactcctctttgatatcagacctgatgttattttccttcttttggagggcatttgtttggttaagaaggcttctttggactttggaatttcaacccagattttaccttgcagacggaatgacaagcaaaaagtgttgtggggaatcaaatttgttcctttcctcatgcacaaaacataaaggatagtggcgagtttacaagctgtggatgggtttccatagtcttcctttctgtacattgctatatcttcagtcctttggagcaagtggacctaacaagttgagcaaaatgaatatttggatccatgttcctcttgtgaccctgagtcttcatgcaaggagatctgaagctgaacaatgaaaatcttcagcagaaatagaaatggccgtggattgtaatacacactgaaattctgactttctgaatttaaatgtagaataaattttaccaacttgg

SEQ ID NO: 21605 - DNA, 469 bp, Homo sapiens
  ENST00000522434
agttcttgggtctgtgctgctggcctggggttgtggttgaggccgggtctccgctcctgtgcccgggaagatggtgctaggtggttgcccgacctgatgaatttatagaatgtgaagacccagtggatcatgttggaaatgcaactgcatcccaggaacttggttatggttgtctcaagttcggcggtcaggcctacagcgacgtggaacacacttcagtccagtgccatgccttagatggaattgagtgtgccagtcctaggacctttctacgagaaaataaaccttgtataaagtataccggacactacttcataaccactttactctactccttcttcctgggatgttttggtgtggatcgattctgtttgggacacactggcactgcagtagggaagctgttgacgcttggaggacttgggatttggtggtttgttgaccttattttgctaattactggagggct

SEQ ID NO: 21606 - DNA, 885 bp, Homo sapiens
  ENST00000522142
ggatttctaaaccggcggtggcaaccagcactagtcggcccgccagtcatatccgccccgccccgtcggctgccgggcacgcccacctaggggggtcgacggatccgattggagaacgcattcggcgcaaaagaaggaggagcatgagacccagaagaggaatcgagaagcagaagcagagggcggagtagccccgcccgtctgctcgaccttttctagttggttggcggagaatcacgccattttttaacatctctttttgatcaaacaagaaaaggcatttgggaaatgcaaagaggactgagaatactttggcttaaattttgcccccagaatcttgttgtttgcctactgaagagatgaaaccatggcagaagtagaatccttatagaaacaggaccagaaacacctcccttctccaacaaaaggttcattttggtggctgtccgtttgacctgctgtgcttcagtttaattggcttggaaaggggtcagcagggtgaaaccgaaccccagaaaacttgatgaagaaatgtcttttgcccgttttgattacgtgcatgcaaacagcgatttgcaaagaccgtatgatgatgatcatgatcttactggtgaattacagacctgatgaatttatagaatgtgaagacccagtggatcatgttggaaatgcaactgcatcccaggaacttggttatggttgtctcaagttcggcggtcaggcctacagcgacgtggaacacacttcagtccagtgccatgccttagatggaattgagtgtgccagtcctaggacctttctacgagaaaataaaccttgtataaagtataccggacactacttcataaccactttactctactccttcttcctgggatgttttgg

SEQ ID NO: 21607 - DNA, 284 bp, Homo sapiens
  ENST00000521060
gaaacacctcccttctccaacaaaagacctgatgaatttatagaatgtgaagacccagtggatcatgttggaaatgcaactgcatcccaggaacttggttatggttgtctcaagttcggcggtcaggcctacagcgacgtggaacacacttcagtccagtgccatgccttagatggaattgagtgtgccagtcctaggacctttctacgagaaaataaaccttgtataaagtataccggacactacttcataaccactttactctactccttcttcctgggatg

SEQ ID NO: 21608 - DNA, 544 bp, Homo sapiens
  ENST00000524331
tatgtataagcttatacatataaatatgtataagcatatacatatgcttataagtaaagataagtaaagcattgtgttcatctcttctaaatggcctttaatgacactgagtgtgtttgggggttttttttactatattattgaagaagccagtcatgaagaagaaagcaggagtttatttaagacagtgtacctttaagatggactcagaagtgtgtcactaaattccttgcccttgagcacagctgtacctcaaccttgttggaataattgtagtcctgaggccgctttcattctgttattagtgaatataaagatagatgtttgtgtcacttgctctggtgagttggttttggtcttggttgttattccacagttcggcggtcaggcctacagcgacgtggaacacacttcagtccagtgccatgccttagatggaattgagtgtgccagtcctaggacctttctacgagaaaataaaccttgtataaagtataccggacactacttcataaccactttactctactccttcttcctggga

SEQ ID NO: 21609 - DNA, 573 bp, Homo sapiens
  ENST00000519186
ctgtgctgctggcctggggttgtggttgaggccgggtctccgctcctgtgcccgggaagatggtgctaggtggttgcccggttagttacttacttctgtgcggccaggcggctttgctgctggggaatttacttctgctgcattgtgtgtctcggagccactcgcaaaatgcgaccgctgagcctgagctcacatccgctggcgccgcccagccggagggccccgggggtgctgcgagctgggaatatggcgacccccactctccggtcatcctctgctcttacctacctgatgaatttatagaatgtgaagacccagtggatcatgttggaaatgcaactgcatcccaggaacttggttatggttgtctcaaggtgagtttttgttttgtcgtaagagcaaacccttcgataacgaaataggaatgtctgaatgctattacataaaagtataagaggtacaaagttttttgaagaatttcctcagaaagaccgttactggaaatttccagtatggccagggtcagtgactgaacaagatatttggtttccttatgaaggagcaatctctgtg

SEQ ID NO: 21610 - DNA, 570 bp, Homo sapiens
  ENST00000517872
agttcttgggtctgtgctgctggcctggggttgtggttgaggccgggtctccgctcctgtgcccgggaagatggtgctaggtggttgcccgaatcacgccattttttaacatctctttttgatcaaacaagaaaaggcatttgggaaatgcaaagaggactgagaatactttggcttaaattttgcccccagaatcttgttgtttgcctactgaagagatgaaaccatggcagaagtagaatccttatagaaacaggaccagaaacacctcccttctccaacaaaaggttcattttggtggctgtccgtttgacctgctgtgcttcagtttaattggcttggaaaggggtcagcagggtgaaaccgaaccccagaaaacttgatgaagaaatgtcttttgcccgttttgattacgtgcatgcaaacagcgatttgcaaagaccgtatgatgatgatcatgatcttactggtgaattacagacctgatgaatttatagaatgtgaagacccagtggatcatgttggaaatgcaactgcatcccaggaacttggttatggttgtctcaaggt

SEQ ID NO: 21611 - DNA, 549 bp, Homo sapiens
  ENST00000520152
aaaccggcggtggcaaccagcactagtcggcccgccagtcatatccgccccgccccgtcggctgccgggcacgcccacctaggggggtcgacggatccgattggagaacgcattcggcgcaaaagaaggaggagcatgagacccagaagaggaatcgagaagcagaagcagagggcggagtagccccgcccgtctgctcgaccttttctagttggttggcggagaatcttgttgtttgcctactgaagagatgaaaccatggcagaagtagaatccttatagaaacaggaccagaaacacctcccttctccaacaaaaggttcattttggtggctgtccgtttgacctgctgtgcttcagtttaattggcttggaaaggggtcagcagggtgaaaccgaaccccagaaaacttgatgaagaaatgtcttttgcccgttttgattacgtgcatgcaaacagcgatttgcaaagaccgtatgatgatgatcatgatcttactggtgaattacagacctgatgaatttatagaatgtgaagacccagtggat

SEQ ID NO: 21612 - DNA, 1771 bp, Homo sapiens
  ENST00000305366
attaatcattttccctgttgcctatgactgaggctgtttctcacatcctgcccctggttttgcctgtcccaaggatttcgtctgaagggcgggacattccccctgcctcttcgcaccacagccagagcctgccattaggaccaatgaaagcaaagtacctcatcccctcagtgactaagaatcgcagtatttaagaggtagcaggaatgggctgagagtggtgtttgctttctccaccagaagggcacactttcatctaatttggggtatcactgagctgaagacaaagagaagggggagaaaacctagcagaccaccatgtgctatgggaagtgtgcacgatgcatcggacattctctggtggggctcgccctcctgtgcatcgcggctaatattttgctttactttcccaatggggaaacaaagtatgcctccgaaaaccacctcagccgcttcgtgtggttcttttctggcatcgtaggaggtggcctgctgatgctcctgccagcatttgtcttcattgggctggaacaggatgactgctgtggctgctgtggccatgaaaactgtggcaaacgatgtgcgatgctttcttctgtattggctgctctcattggaattgcaggatctggctactgtgtcattgtggcagcccttggcttagcagaaggaccactatgtcttgattccctcggccagtggaactacacctttgccagcactgagggccagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacagcaatatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttatttgtttttgtttttttttaaggaatgaggaaacaaaccaccctctgggggtaatttacagactgagtgacagtactcagtatatctgagataaactctataatgttttggataaaaataacattccaatcactattgtatatatgtgcatgtattttttaaattaaagatgtctagttgctttttataagaccaagaaggagaaaatccgacaacctggaaagatttttgttttcactgcttgtatgatgtttcccattcatacacctataaatctctaacaagaggccctttgaactgccttgtgttctgtgagaaacaaatatttacttagagtggaaggactgattgagaatgttccaatccaaatgaatgcatcacaacttacaatgctgctcattgttgtgagtactatgagattcaaatttttctaacatatggaaagccttttgtcctccaaagatgagtactagggatcatgtgtttaaaaaaagaaaggctacgatgactgggcaagaagaaagatgggaaactgaataaagcagttgatcagcatcattggaacatggggacgagtgacggcaggaggaccacgaggaaataccctcaaaactaacttgtttacaacaaaataaagtattcactacca

SEQ ID NO: 21613 - DNA, 3115 bp, Homo sapiens
  ENST00000472441
tgtggccatgaaaactgtggcaaacgatgtgcggtaggtcctcctgccctggtggtgaaaatgactcctaagatgtagctgtggcactctgtggctcacttcctgtgtgtctgcttttccctagatgctttcttctgtattggctgctctcattggaattgcaggatctggctactgtgtcattgtggcagcccttggcttagcagaaggaccactatgtcttgattccctcggccagtggaactacacctttgccagcactgagggccagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacaggtaagaacctgcatgaaaatgtcgtagtctggccctggtgttaatataccattgttttcatcataaagaaaaaggcaaaaccaaacatgctcgacctaccagcatttattctgatatcatctttgtagcaacacaattatagcattcactttagctgtcagtaacaagcttcctcgagtctcacagtcacaggattgtcttagttctttgcagttggctctatgtacacaagaacatgctgcccatagacacagcgctcccttcaggatctaattcactgcctctgctctcgctgcagagacagaaaaaaaagtgatgtctgctctttgtttgctgttatattcccaactagtatacataagtaatagccaaccattcaatgcatcaggcactatgctaaacccatatgactcaaatattaagcaataggcttaagatcacctactcaggaaataacaggcttcaaaccttgagtcgctctgtgcaaaagctcctacttttaacctgtattccacacttgctgtttggttggattttctgcaattccttcctaataaggagtcataaaaatgcctaagcagtaagtatggagaatcactagcaatctttgaacagcagctcatgaaaagcctttcgttgtgaaagaaaaccaggaagcacttgtttcctggggatatgatttaggagaaaaaaatgcatttgtttgtagcagtgaaagttcttgtttctatatcctcctaaaatatatatattattgaattaatgaaagtccagctttgatcctatctttgagagggttattttatgtcttatatttttcaaaccatttactcctctggtgccagatctgttaactttcttttaaaaataagacaaaaacctaatgaaaactgaaagcccattgctaccatgaaaaactttgctgaaaataaaaggaaactttctgtaattttgggggaaggttaaaatgaaaatctagttttccttatcaggcaagtatagcaagattaataatttctttggcaaatttccaagaaaataagggaatgggaaaccttcaatatggagcttctttcaagcagtacggttggggaagggcagagaagtatcctctagggattgctgtcatgcagcttacctttagccttgaatttcatacaaggcagagttcaaagtaagtgattacttgtactaaatgtactcacttagtacgttttggggacaggcataaagagccaatgaccaaaatggctgaagtgatttggcagggaatgatactctcctctgatttggggtagtaaatacaccaggtttcccagctgagtcactgtagggatggcttcttcccagatactacagggaagatctgttacctttgtttataagacaaaagacactttcaaagggcaggtcttttcatgtagaagagtcaggtccataactcggtagcatttaatttgaaaggttacccacattgagctcataccagtgtgaaacttccatggcattatcttttaaatccctaagattaaaaccccacacaaatgcactcaaagcaacccaatatcagtatcctgcagtttctatgggccctttctgcagcctttactcatggaagacaagggatctgggtttgtttaggaaacattttgtgagcattgtccaagccctaagtatggttggcctaagctttgctgaagctaagatcagtctgtttatgtttgcttaaaataggaacttaaaggactaaaatgtcatcattatttatcctgattatagcctaatggtattttattttctctacagcaatatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttatttgtttttgtttttttttaaggaatgaggaaacaaaccaccctctgggggtaatttacagactgagtgacagtactcagtatatctgagataaactctataatgttttggataaaaataacattccaatcactattgtatatatgtgcatgtattttttaaattaaagatgtctagttgctttttataagaccaagaaggagaaaatccgacaacctggaaagatttttgttttcactgcttgtatgatgtttcccattcatacacctataaatctctaacaagaggccctttgaactgccttgtgttctgtgagaaacaaatatttacttagagtggaaggactgattgagaatgttccaatccaaatgaatgcatcacaacttacaatgctgctcattgttgtgagtactatgagattcaaatttttctaacatatggaaagccttttgtcctccaaagatgagtactagggatcatgtgtttaaaaaaagaaaggctacgatgactgggcaagaagaaagatgggaaactgaataaagcagttgatcagcatcattggaacatggggacgagtgacggcaggaggaccacgaggaaataccctcaaaactaacttgtttacaacaaaataaagtattcactacc

SEQ ID NO: 21614 - DNA, 976 bp, Homo sapiens
  ENST00000493348
actaagaatcgcagtatttaagaggtagcaggaatgggctgagagtggtgtttgctttctccaccagaagggcacactttcatctaatttggggtatcactgagctgaagacaaagagaagggggagaaaacctagcagaccaccatgtgctatgggaagtgtgcacgatgcatcggacattctctggtggggctcgccctcctgtgcatcgcggctaatattttgctttactttcccaatggggaaacaaagtatgcctccgaaaaccacctcagccgcttcgtgtggttcttttctggcatcgtaggaggtggcctgctgatgctcctgccagcatttgtcttcattgggctggaacaggatgactgctgtggctgctgtggccatgaaaactgtggcaaacgatgtgcggtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacagcaatatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttatttgtttttgtttttttttaaggaatgaggaaacaaaccaccctctgggggtaatttacagactgagtgacagtactcagtatatctgagataaactctataatgttttggataaaaataacattccaatcactattgtatatatgtgcatgtattttttaaattaaagatgt

SEQ ID NO: 21615 - DNA, 702 bp, Homo sapiens
  ENST00000493298
agtggtgtttgctttctccaccagaagggcacactttcatctaatttggggtatcactgagctgaagacaaagagaagggggagaaaacctagcagaccaccatgtgctatgggaagtgtgcacgatgcatcggacattctctggtggggctcgccctcctgtgcatcgcggctaatattttgctttactttcccaatggggaaacaaagtatgcctccgaaaaccacctcagccgcttcgtgtggttcttttctggcatcgtaggaggtggcctgctgatgctcctgccagcatttgtcttcattgggctggaacaggatgactgctgtggctgctgtggccatgaaaactgtggcaaacgatgtgcggtaggtcctcctgccctggtggtgaaaatgactcctaagatgtagctgtggcactctgtggctcacttcctgtgtgtctgcttttccctagatgctttcttctgtattggctgctctcattggaattgcaggatctggctactgtgtcattgtggcagcccttggcttagcagaaggaccactatgtcttgattccctcggccagtggaactacacctttgccagcactgagggccagtaccttctggatacctccacatggtccgagtgcactgaacccaagcacattgtggaatggaatgtatctctgttttctatcctcttggctcttgg

SEQ ID NO: 21616 - DNA, 3201 bp, Homo sapiens
  ENST00000297784
cagaaactatgagggcagaacccagcaatctgtgctttctttcacaagccctccaggagttgctgaaatttaggaatcattgccccaaaaagtggccctcataatgatgccagatgggatcttactctgttgcccaggctggagtgcagtggtgcgatctcggctctctgcaacctccgcctcccaggttcaagtgattctcctgcctcggcctcctgagtagctgggatttcaggccatgaaagatcactgttttagtctgcgtggtgcagtggaacagatagacctcggtttgaatctcagctctactgtttactagacatgaaatggggaaatctaaaatgagatgccagaagcctcaaaaatggaaaaccccctgtgcttcacatctgaaaatctctgctgggggcagcaactttgagcctgtggggaaggaactgtccacgtggagtggtctggtgaatgcttaaggagctgcagaagggaagtccctctccaaactagccagccactgagaccttctgacaggacacccccaggatgtcacccaaaaaagtacaaatcaaagtggaggaaaaagaagacgagactgaggaaagctcaagtgaagaggaagaggaggtggaagataagctacctcgaagagagagcttgagaccaaagaggaaacggaccagagatgttatcaatgaggatgacccagaacctgaaccagaggatgaagaaacaaggaaggcaagagaaaaagagaggaggaggaggctaaagagaggagcagaagaagaagaaattgatgaagaggaattggaaagattgaaggcagagttagatgagaaaagacaaataattgctactgtcaaatgcaaaccatggaagatggagaagaaaattgaagttctcaaggaggcaaaaaaatttgtgagtgaaaatgaaggggctcttgggaaaggaaaaggaaaacggtggtttgcatttaagatgatgatggccaagaaatgggcaaaattcctccgtgattttgagaacttcaaagctgcgtgtgtcccatgggaaaataaaatcaaggctattgaaagtcagtttggctcctcagtggcctcatacttcctcttcttgagatggatgtatggagtcaatatggttctctttatcctgacatttagcctcatcatgttgccagagtacctctggggtttgccatatggcagtttacctaggaaaaccgttcccagagccgaagaggcatcggcagcaaactttggtgtgttgtacgacttcaatggtttggcacaatattccgttctcttttatggctattatgacaataaacgaacaattggatggatgaatttcaggttgccgctctcctattttctagtggggattatgtgcattggatacagctttctggttgtcctcaaagcaatgaccaaaaacattggtgatgatggaggtggagatgacaacactttcaatttcagctggaaggtctttaccagctgggactacctgatcggcaatcctgaaacagcagacaacaaatttaattctatcacaatgaactttaaggaagctatcacagaagaaaaagcagcccaagtagaagaaaacgtccacttgatcagattcctgaggtttctggctaacttcttcgtgtttctaacacttggagggagtggatacctcatcttttgggctgtgaagcgatcccaggaatttgcacagcaagatcctgacacccttgggtggtgggaaaaaaatgaaatgaacatggttatgtccctcctagggatgttctgtccaacattgtttgacttatttgctgaattagaagactaccatcctctcatcgctttgaaatggctactgggacgcatttttgctcttcttttaggcaatttatacgtatttattcttgcattaatggatgagattaacaacaagattgaagaggagaagctagtaaaggccaatattaccctttgggaagccaatatgatcaaggcctacaatgcatcattctctgaaaatagcactggaccacccttttttgttcaccctgcagatgtacctcgaggaccttgctgggaaacaatggtgggacaggagtttgtgaggctgacagtctctgatgttctgaccacctacgtcacaatcctcattggggactttctaagggcatgttttgtgaggttttgcaattattgctggtgctgggacttggagtatggatatccttcatacaccgaattcgacatcagtggcaacgtcctcgctctgatcttcaaccaaggcatgatctggatgggctccttctttgctcccagcctcccaggcatcaatatccttcgactccatacatccatgtacttccagtgctgggccgttatgtgctgcaatgttcctgaggccagggtcttcaaagcttccagatcaaataacttctacctgggcatgctactgctcatcctcttcctgtccacaatgcctgtcttgtacatgatcgtgtccctcccaccatcttttgattgtggtccattcagtggcaaaaatagaatgtttgaagtcattggagagaccctggagcacgatttcccaagctggatggcgaagatcttgagacagctttcaaaccctgggctggtcattgctgtcattttggtgatggttttggccatctattatctcaatgctactgccaagggccagaaggcagcgaatctggatctcaaaaagaagatgaaaatgcaagctttggagaacaaaatgcgaaacaagaaaatggcagctgcacgagcagctgcagctgctggtcgccagtaataagtatcctgagagcccagaaaaggtacactttgccttgctgtttaaaagtaatgcaatatgtgaacgcccagagaacaagcactgtggaactgctattttcctgttctacccttgatggattttcaaggtcatgctggccaattaaggcatcatcagtcctacctgagcaacaagaatctaaactttattccaagtcagaaactgtttctgcagagccactctctcccctgctccatttcgtgactttttttttttttttaacaaattgagtttagaagtgagtgtaatccagcaatacagtttactggtttagttggtgggttaattaaaaaaaatttgctcatatgaactttcattttatatgtttcttttgcc

SEQ ID NO: 21617 - DNA, 782 bp, Homo sapiens
  ENST00000497073
gagttatgggtcttcacgcagccagcatgctgtgttttgggctctgcctcttgtaatttttagaaattaattagtttattctttatttatatttatttatttatttattttcagatgggatcttactctgttgcccaggctggagtgcagtggtgcgatctcggctctctgcaacctccgcctcccaggttcaagtgattctcctgcctcggcctcctgagtagctgggatttcagagtctcaagcaggccatgaaagatcactgttttagtctgcgtggtgcagtggaacagatagacctcggtttgaatctcagctctactgtttactagacatgaaatggggaaatctaaaatgagatgccagaagcctcaaaaatggaaaaccccctgtgcttcacatctgaaaatctctgctgggggcagcaactttgagcctgtggggaaggaactgtccacgtggagtggtctggtgaatgcttaaggagctgcagaagggaaggtagtgaggagacagttaaatattgagcacgttttggtgcctagcattgtactggcctttcacatgctatgtttaatcacgcaggattgtatggaatgggattgtacagaatgaggcctgggtttgctaaatcctgggggagattgtctaagctgtcacttgaagggaaaactgtagcatgtgggacttaaaaacagcttgggatggagtttgaggtagggcgagagggaaaaagatcttggcagatacattctgaacaaatacttgtgtcatcctcaact

SEQ ID NO: 21618 - DNA, 562 bp, Homo sapiens
  ENST00000492418
agtggtctggtgaatgcttaaggagctgcagaagggaagtccctctccaaactagccagccactgagaccttctgacaggacacccccaggatgtcacccaaaaaagttgggacagaacaagtcaactggcaagtccattgctcagcttgttgaaatactctgcacagaatgcaaggaaaaactgttttcatgaggtagcccatgaagcgatgaagcaaggcaaatttatctgcctggataacctcctgtatgctgttttcactccatggagagtcaacacaacagacttctgagttgtattatcgagctccttcaacagggcattgctgtaagatcctagatcccacactccatggtgtgatgttttagccaagtctggaagtagcacaggccctaaaatctcatgattgcaggttgtcaactctgctgtaggcttgccacttcaagggcaagtggttggttggggctgggatttgggcagagccatagaaagaaagggaacattcaagggaatttgatgatgtgcatgatgtctctgtctgatacaaaaagaaaaaaaaa

SEQ ID NO: 21619 - DNA, 1528 bp, Homo sapiens
  ENST00000486417
tgcattaatggatgagattaacaacaagattgaagaggagaagctagtaaaggccaatattaccctttgggaagccaatatgatcaaggcctacaatgcatcattctctgaaaatagcactggaccacccttttttgttcaccctgcagatgtacctcgaggaccttgctgggaaacaatggtgggacaggagtttgtgaggctgacagtctctgatgttctgaccacctacgtcacaatcctcattggggactttctaagggcatgttttgtgaggttttgcaattattgctggtgctgggacttggagtatggatatccttcatacaccgaattcgacatcagtggcaacgtcctcgctctgatcttcaaccaaggcatgatctgatctgtcctgaattattaaacctttgggtgctgacagacaccggacccctctgcaaatgctaaaaccgtcttgcttctgtcacacaaagacaactctccagggctccatcgtcctgccatgggatgactgttaaattcctgtgcctgactaggtgaatcaatatggaaaagatattataaaaatattgtttcctcctttgtcaggaagaaaagaattttataaggctaaagtgttacaatgatttttactgacagatgatgggatcatgcctgggatgggctccttctttgctcccagcctcccaggcatcaatatccttcgactccatacatccatgtacttccagtgctgggccgttatgtgctgcaatgttcctgaggccagggtcttcaaagcttccagatcaaataacttctacctgggcatgctactgctcatcctcttcctgtccacaatgcctgtcttgtacatgatcgtgtccctcccaccatcttttgattgtggtccattcagtggcaaaaatagaatgtttgaagtcattggagagaccctggagcacgatttcccaagctggatggcgaagatcttgagacagctttcaaaccctgggctggtcattgctgtcattttggtgatggttttggccatctattatctcaatgctactgccaagggccagaaggcagcgaatctggatctcaaaaagaagatgaaaatgcaagctttggagaacaaaatgcgaaacaagaaaatggcagctgcacgagcagctgcagctgctggtcgccagtaataagtatcctgagagcccagaaaaggtacactttgccttgctgtttaaaagtaatgcaatatgtgaacgcccagagaacaagcactgtggaactgctattttcctgttctacccttgatggattttcaaggtcatgctggccaattaaggcatcatcagtcctacctgagcaacaagaatctaaactttattccaagtcagaaactgtttctgcagagccactctctcccctgctccatttcgtgactttttttttttttttaacaaattgagtttagaagtgagtgtaatccagcaatacagtttactggtttagttggtgggttaattaaaaaaaatttgctcat

SEQ ID NO: 21620 - DNA, 679 bp, Homo sapiens
  ENST00000469455
ctggctgtctgactttgagatggtaccttttataaggtcgtctccatcaccctcattgaaagtgcctcctcggactggccaaaagcagttaggtaatgctcttcggtgaacgacagtgaggtaatggctacagatacaggatgctcttgtgttgctttcccattctttgctatgagccttcatacaccgaattcgacatcagtggcaacgtcctcgctctgatcttcaaccaaggcatgatctggatgggctccttctttgctcccagcctcccaggcatcaatatccttcgactccatacatccatgtacttccagtgctgggccgttatgtgctgcaatgttcctgaggccagggtcttcaaagcttccagatcaaataacttctacctgggcatgctactgctcatcctcttcctgtccacaatgcctgtcttgtacatgatcgtgtccctcccaccatcttttgattgtggtccattcagtggcaaaaatagaatgtttgaagtcattggagagaccctggagcacgatttcccaagctggatggcgaagatcttgagacagctttcaaaccctgggctggtcattgctgtcattttggtgatggttttggccatctattatctcaatgctactgccaagggccagaaggcagcgaatctggatctcaaaaagaa

SEQ ID NO: 21621 - DNA, 3068 bp, Homo sapiens
  ENST00000340019
ttcacaaagttggtttacagcagaactgtgctacagttatctggattcagatccaagtcccctccaaatgaatcacaaccacttctacctttataattccaggccatgaaagatcactgttttagtctgcgtggtgcagtggaacagatagacctcggtttgaatctcagctctactgtttactagacatgaaatggggaaatctaaaatgagatgccagaagcctcaaaaatggaaaaccccctgtgcttcacatctgaaaatctctgctgggggcagcaactttgagcctgtggggaaggaactgtccacgtggagtggtctggtgaatgcttaaggagctgcagaagggaagtccctctccaaactagccagccactgagaccttctgacaggacacccccaggatgtcacccaaaaaagtacaaatcaaagtggaggaaaaagaagacgagactgaggaaagctcaagtgaagaggaagaggaggtggaagataagctacctcgaagagagagcttgagaccaaagaggaaacggaccagagatgttatcaatgaggatgacccagaacctgaaccagaggatgaagaaacaaggaaggcaagagaaaaagagaggaggaggaggctaaagagaggagcagaagaagaagaaattgatgaagaggaattggaaagattgaaggcagagttagatgagaaaagacaaataattgctactgtcaaatgcaaaccatggaagatggagaagaaaattgaagttctcaaggaggcaaaaaaatttgtgagtgaaaatgaaggggctcttgggaaaggaaaaggaaaacggtggtttgcatttaagatgatgatggccaagaaatgggcaaaattcctccgtgattttgagaacttcaaagctgcgtgtgtcccatgggaaaataaaatcaaggctattgaaagtcagtttggctcctcagtggcctcatacttcctcttcttgagatggatgtatggagtcaatatggttctctttatcctgacatttagcctcatcatgttgccagagtacctctggggtttgccatatggcagtttacctaggaaaaccgttcccagagccgaagaggcatcggcagcaaactttggtgtgttgtacgacttcaatggtttggcacaatattccgttctcttttatggctattatgacaataaacgaacaattggatggatgaatttcaggttgccgctctcctattttctagtggggattatgtgcattggatacagctttctggttgtcctcaaagcaatgaccaaaaacattggtgatgatggaggtggagatgacaacactttcaatttcagctggaaggtctttaccagctgggactacctgatcggcaatcctgaaacagcagacaacaaatttaattctatcacaatgaactttaaggaagctatcacagaagaaaaagcagcccaagtagaagaaaacgtccacttgatcagattcctgaggtttctggctaacttcttcgtgtttctaacacttggagggagtggatacctcatcttttgggctgtgaagcgatcccaggaatttgcacagcaagatcctgacacccttgggtggtgggaaaaaaatgaaatgaacatggttatgtccctcctagggatgttctgtccaacattgtttgacttatttgctgaattagaagactaccatcctctcatcgctttgaaatggctactgggacgcatttttgctcttcttttaggcaatttatacgtatttattcttgcattaatggatgagattaacaacaagattgaagaggagaagctagtaaaggccaatattaccctttgggaagccaatatgatcaaggcctacaatgcatcattctctgaaaatagcactggaccacccttttttgttcaccctgcagatgtacctcgaggaccttgctgggaaacaatggtgggacaggagtttgtgaggctgacagtctctgatgttctgaccacctacgtcacaatcctcattggggactttctaagggcatgttttgtgaggttttgcaattattgctggtgctgggacttggagtatggatatccttcatacaccgaattcgacatcagtggcaacgtcctcgctctgatcttcaaccaaggcatgatctggatgggctccttctttgctcccagcctcccaggcatcaatatccttcgactccatacatccatgtacttccagtgctgggccgttatgtgctgcaatgttcctgaggccagggtcttcaaagcttccagatcaaataacttctacctgggcatgctactgctcatcctcttcctgtccacaatgcctgtcttgtacatgatcgtgtccctcccaccatcttttgattgtggtccattcagtggcaaaaatagaatgtttgaagtcattggagagaccctggagcacgatttcccaagctggatggcgaagatcttgagacagctttcaaaccctgggctggtcattgctgtcattttggtgatggttttggccatctattatctcaatgctactgccaagggccagaaggcagcgaatctggatctcaaaaagaagatgaaaatgcaagctttggagaacaaaatgcgaaacaagaaaatggcagctgcacgagcagctgcagctgctggtcgccagtaataagtatcctgagagcccagaaaaggtacactttgccttgctgtttaaaagtaatgcaatatgtgaacgcccagagaacaagcactgtggaactgctattttcctgttctacccttgatggattttcaaggtcatgctggccaattaaggcatcatcagtcctacctgagcaacaagaatctaaactttattccaagtcagaaactgtttctgcagagccactctctcccctgctccatttcgtgactttttttttttttttaacaaattgagtttagaagtgagtgtaatccagcaatacagtttactggtttagttggtgggttaattaaaaaaaatttgctcatatgaactttcattttatatgtttcttttgcc

SEQ ID NO: 21622 - DNA, 2195 bp, Homo sapiens
  ENST00000559781
cttcatgtcccgctgtgggaggggctctggagcgccgggactgtgagatggccaatgacggtctgacccgttgggccgggccaggtcgcggacaacgtcgaccgtttgtttaagaagcgtggactcttgtcctgagtgcaccgaggctttcagcctgcgggacagtggtgcgatttgcattagagaaagggagatgccatgtgctggcccagcactccaacaggggcctgacctctaggaacgggacactggaggaagcctagacatctgaacaaatcaagtcatccagatccacggtcagctcctgccccgacttggccttcctcctgctgggctggcccacggacctcgggaacctgccctggctgtgggtgacctgcagcctatctcccaggactatggaagccccatgcaggaacatggttctgacactttggggattataccctaagcttaaaggactggaaaagcccctgaagtcccgagaccacaaccctccaccttctaaagataagacaagtcactgaaggtctcagaactgtggcccattcaccccttccctcaagacaagagtgtggccaagcatcaatctcacccccagagaccagacggtgtccaggtcttgggcagacgaaacctgctccttggggatggtcttcctggctgtgcttccaaagggctggcctgcaatcagctggttttcacttgatcctttcggggtttgcattatatctgactgaaggaatgaactgggagagaacagcagagccgcagcggaatgtggaaaggcccacgtccagactgttcccattctgatttaaaagcctgatgaaggaacagctgaactcagagaaacagcagaggaaaggtcctgtgagggtacagtgagaagatggccatctaccagccaggaggaaaggcctaacaagaaaccaactctgctggcaccttgatcgtgaactcccgccctctagaactgtgagaaaataaacgtctgtttaagccacctggtctgtggtattttgttatggaagcccgagcagaccaatatgcctactaagctctgtgacctagaaggctcctcttctgtctttttcctcctggaatgtgagaaaatctggcaaagtgggagccagagaggctaggccactaaaagcctgtgtgcgaaatgatctgtacacagcgaattgactccacctttcacacattactacttaaatcatgaaaggagcattgcaaggaggaagtattttaacagcagaagaaaacatgcctccaatgtcaagaaatttcagcacaattttgtgcagccaggaccagatgaagggaaaggccaagcaatatgttttgaggactgaatatctatgcttccccaaattcatatgttgaaatcctaacttccgatgtgaagatatttgtaggtggggctttaagagataattaggtcacaagggcagagcccccatgagtgggattagtgctcttagaaaagggacccaagagggctgtctctcttgccctctttccgccatatgagaatccaatgagatggcatcatctgcaaatcaggaagaggatgctcaccagacaccagatctgccagcaccttgatcttggactcctcagcctctagaactgtaagaaataacgtttgttgtttaagcaacccagtctatggcaacttgttatagcagcctgaactaagataatctataaggtaaggcaaataagaaaaaaatccaaacccaaaatgactttaagcgactcctagaggaaccctgccaacatcactaagttcagagaggtaaaatcaggcaacaagcagaattatcttcgggggtccataaaaatttccaggtctggtcgcaactgtcatatcttgacacaaaggggcacatattggatcccagaaagttctatggacttcttagggcttgcaaaagttgtataattttattgattatataagtaatacatgttcattgttgagattttggaaataataatctatcatctgacctctctgagaaaaccattattaaccttttaactttctactttctgttatttgcattcatacatgtttatccattatccatgtagcattttttatcatgcttttgaactccattttatttacatcatgatgacttgatagtgacaaaaaagattccaaaatatgattttaatgacag

SEQ ID NO: 21623 - DNA, 273 bp, Homo sapiens
  ENST00000560973
tctgacccgttgggccgggccaggtcgcggacaacgtcgaccgtttgtttaagaagcgtggactcttgtcctgagtgcaccgaggctttcagcctgcgggacagtggtgcgatttgcattagagcctatctcccaggactatggaagccccatgcaggaacatggttctgacactttggggattataccctaagcttaaaggactggaaaagcccctgaagtcccgagaccacaaccctccaccttctaaagataagacaagtcactgaaggt

SEQ ID NO: 21624 - DNA, 1269 bp, Homo sapiens
  ENST00000560851
atcgtggggagaagcaacgcaagaccccggaagcatgccaacgtgtaaaaccccaagtcaaaggtcaaacagtgcactggatctctcaagtcgcctgcttggccctctactaaaaagggagatgccatgtgctggcccagcactccaacaggggcctgacctctaggaacgggacactggaggaagcctagacatctgaacaaatcaagtcatccagatccacggtcagctcctgccccgacttggccttcctcctgctgggctggcccacggacctcgggaacctgccctggctgtgggtgacctgcagcctatctcccaggactatggaagccccatgcaggaacatggttctgacactttggggattataccctaagcttaaaggactggaaaagcccctgaagtcccgagaccacaaccctccaccttctaaagataagacaagtcactgaaggtctcagaactgtggcccattcaccccttccctcaagacaagagtgtggccaagcatcaatctcacccccagagaccagacggtgtccaggtcttgggcagacgaaacctgctccttggggatggtcttcctggctgtgcttccaaagggctggcctgcaatcagctggttttcacttgatcctttcggggtttgcattatatctgactgaaggaatgaactgggagagaacagcagagccgcagcggaatgtggaaaggcccacgtccagactgttcccattctgatttaaaagcctgatgaaggaacagctgaactcagagaaacagcaggtgaaaagtccaagtcaaggaatagaagtagtcagttcgtggtggagttgcattgatgattccagagcggttcctgctcctcctctttaagccagtgtgttttaccaaagattttcgggacaaagaaaaagccaggcagtaggtgccaaatacagtgactcatcagatgaccctgctgtttatctccaacattttcatgaacagctttcaaggaatgaaggaaggaaatgttctgtgtccataaagtaggattggaaacagttgacttgtatgaacatggccaacacaaaatagtccagggggatgtggaatatttgaggagaacaacattagactgagaaattatgacagtcaggaaaagaaaaattgtaccaaatatcaaagaacgtgagtttttttcaacagaaaactaaagcgatagatggaacctgtgagttcacttctaaaggagcattaaaaaaaaaatgaaacctaggaaaa

SEQ ID NO: 21625 - DNA, 479 bp, Homo sapiens
  ENST00000559277
agcccctgaagtcccgagaccacaaccctccaccttctaaagataagacaagtcactgaaggtaaaatcagctcctcagtgtctccaaggacaggaatgccatgggctgggaggcgccatgggtgaacagacttccctacttcctgcctccccaagggtggggagcagtctaggggatggctgtactcctgggcccagtgtctaagtgaaaattaggaggaaatggagggagggtggcgagcgaggacagactggccaaggtcccccgcagccactcctgaagtcctcacgagggagaagcagcctctccttccagccttccccaagtcctccctaagagtgtattctactggtttctgtgcagatttttttcggctgcgaccaatagtagcttaaacatggattattttctttttaatttcttcctgcaaaattcttaggaaaccattaataaaagtaatatacatgtgaaataataa

SEQ ID NO: 21626 - DNA, 2726 bp, Homo sapiens
  ENST00000612811
tatatctgactgaaggaatgaactgggagagaacagcagagccgcagcggaatgtggaaaggcccacgtccagactgttcccattctgatttaaaagcctgatgaaggaacagctgaactcagagaaacagcaggtgaaaagcctttctactctgtgttctccaattcatcctaaaatcaagaccaaggtagaattctcgaacttggcctattctgaaaaaaatggacatggctgggacagagagcttgtgtgaatattcccaattgtgaacatggaagctataaattgaggtgtcagaaccacaagatggaagtacgttggatttctgagtcaccacctggaggagagcttccctgcagcattgctggaatctgatgtgaactagatattcatcttgatcgtgttgacttgaacctaattcaggcctaagacataatatatactgcataatatatgccgtataatgataatatatttatgcagcctttattgatatgagtagtggtttatctcagttttataataaaaatctctcaaagaacattgactccaaggaataacaatcacaaaaggattacagctttgtttaacactttctgcaaatccttgaagctgatctttcctgttgtttctaatcccaatagccagcctaaaccttttggtgtaatctcatgtattctgacctctgttatttcctgctgcttaatgatctttctataaattgtatgggaaatgaagcaaatgtaattacagtgtctgccagccctgatgcagataaataggtgggagtctggccaagtgtctccccaagctagcctttggtgtctttcactcacagcagaaagaaataggtcataaattacagcactgatttgttccaatgatatcattagctcctggaaaacaaggatcatgaaaaacccatttcaaatgaacatatgagtcaataccaaccaagcatcttttggaaaagagcccttataaattcatactagaattctgactcctaagtgaatatctctggatcttcagaacatagaagacttagctccagcccatgcatcagtcccttcagaccatagagtcataaccaggcctattgaaagagctggttacatgagacagtcagagatttacctaggtgagaaaataaagattagatggtttgaagcagagttctagcccttccaaatcagacctccaacccctttcttaattctatagtttgtagttttcaaaggagaagttgtaataaagagtaagtaaactaacttctttttttcttatggtttttgtttgataatatgaggataaaagcatacccttttttgacctatcccaggataaaatgcaggtggagaaaaggttttccgtattgtctttagccttgacacaacaaaataggaaaagatattttccgatctgggttgagtagatgcaaagaagtgttttaaggtacatctgtagagcacactcagcacttggggactcaggtgcctcaagagaagctagagacctaatgtagggatatagaggccaggaggacacactggaacacagaagatgacagcttttgaaagagctcaagattctaatttcttgaaccagaggacagattctcctctatgtccgttcacactttcagactttactctgcattagccctctgttccccacacctgcttctggacccctgggtggttacacactctgacttcatcaacccttatccttattgtagggatatgaaatttaaaattggcatcttccacagccaattctggtcactattcttgttactttaactgatatgcaataaagaatatgcctgactttgtccctggttcctgggaagtagcatcaaaacctttagaatttcttaagtggtaggagtgtctattattcatggtgaactcctgggatcaaacttgatagtctgtgctaaagagatgactcaggacaggagctggctgctcctgccagaaagaccaaccatgtgattagagggtggggctttgagccaggtgatatcagctcagtctccagggagccaaggggagctagagattgaattcaactgcaaggccaaagattccatcagtcatgattgtgtaatgatacctcaataaaaactctgggcagcaaagctcagttgagcttcacaggttgttaatattctgataatgtcacacattgatatgccaggaaggtaatgcatccttactctttggggatagaacaacagaagctttgtgttgaactcccctagacctcattatatgtgtatctctttccctttggctggttctgatgtgtatccttttgctgtaataagactacaactgtaatttataggactttcttgagttccatgagtcattttagtgaattattaatcctgagggggttatgggaaccaccaaatttgtagcaagctggtcaggagtaagagtggcctgtgagcctttgaacttgtgtctgatgtctttagtttgtgtagtcttgtggaaaactgtgtccctaacctgtaaagtaactggtgtcaaaagtcagtgaaactaggcataattagaactcatggacattcacacccattccacttcagtcacatgcttccgaggcctcactgagttccttttacacatctatcttctctactttggttcttattccgtatgatggcaaaaagaaatacaactggactctaagatgatggtgactcatg

SEQ ID NO: 21627 - DNA, 658 bp, Homo sapiens
  ENST00000558086
gtgttgctgacaagagaggagcaggctgagagaaaacgccctgtttgtcacaaagttacatctgcgagctccttcaaggaagggagtgcccctggagagtggagagggtggttctcttggctgtctctggaacaaatttgggtaagtgctcaaagatgtgttactacagaatgtacttgtgaagttcttgttgcagtgcagtcagataagcaaagatatctgctagaaaataaagaaaaagctacacaattttagactttgtagttcattgtcttttaagacagcaagtcctgctattgtctgtcataaagctacagaaaaagaccatattgaaaactgacgatagcagttgattatttgtgaaaagcctgagagatgattcagtaaatacaaggtgaatttcattgcatcttcatgcaatcagagacttgcatacactttttatcccctaaacagatgaacgaatggcatgggccagctagcagggagttggcaggataaagttctaaccaacaattgccacttgccttcctttcttccatcagcttctagcttacctttcagagacaggttctatcaaaggaaacctaaagggaaccttcctccctggccctgccccatctagcgtccacaaggatactacactccagtgaagact

SEQ ID NO: 21628 - DNA, 2043 bp, Homo sapiens
  ENST00000642113
gcctgacgctccttgttaatgccggttgctgttacagacttgcaattgtgcaactctgtgatgtaaacaggcaggctttgtatttttgcagtgcccctggagagtggagagggtggttctcttggctgtctctggaacaaatttggaggaaaggtcctgtgagggtacagtgagaagatggccatctaccagccaggaggaaaggcctaacaagaaaccaactctgctggcaccttgatcgtgaactcccgccctctagaactgtgagaaaataaacgtctgtttaagccacctggtctgtggtattttgttatggaagcccgagcagaccaatatgcctactaaagtccaagtcaaggaatagaagtagtcagttcgtggtggagttgcattgatgattccagagcggttcctgctcctcctctttaagccagtgtgttttaccaaagattttcgggacaaagaaaaagccaggcagtaggtgccaaatacagtgactcatcagatgaccctgctgtttatctccaacattttcatgaacagctttcaaggaatgaaggaaggaaatgttctgtgtccataaagtaggattggaaacagttgacttgtatgaacatggccaacacaaaatagtccagggggatgtggaatatttgaggagaacaacattagactgagaaattatgacagtcaggaaaagaaaaattgtaccaaatatcaaagaacgtgagtttttttcaacagaaaactaaagcgatagatggaacctgtgagttcacttctaaaggagcattaaaaaaaaaatgaaacctaggaaaatttctgggaagaacatcattgtaaggagtggaaatatagttttcctgaagcattagatgcaaccaatgatgctataatgcatgcttgtttaagggttctggtaaaacagtatggttgttaaaagataagctccagaatttgagacagcatagatgacaagttacagagaaacatcttgaataaaacagcggaagttgttcatgggtaggatttatggtagatccttggagacagggaggacccttctgaattcaagaaagccaacattaattaccaagaaaaagaggagttacagattagaaaatttgactctggtgataggaaaagtcacagaaacttgatatgaaataagataataaaccagatggagaaatacgactgatggagctataagaagtctcaactgtgtaattaaaataaactcattttgctaatgagttagatatttttaagtctacacatttgaaaagggaacggagaagaaaagaaaaacttcattgtatttcaggagcaatctgtctcacctgctacacaaggaatattgctatgtgaaaacaaaggtttactcagcaatcatgcagtgacggcgttccaaattttcagttatttatttccttgcgttggagtaaataagagtaaataacaaatatagtactgatcaatcatgcttatccagctggagctggtgagacagcagattgcagaaatatcattcatttatccaacaaacaatggtagaaaatttatgtgccaaatcctgtgttggacactagaaattcaaagatcagtaagacattgcacctcgatgagtttaccatgtgggagagatacataatgccataattactatctaatgtgataatagagccctcctcaccagtctatggagacaaagatagacacttaatgcagcccgaaagagagaagtgaccagtcaagccttccttggttagagagatcccagccatgtttagagtgacagcaaagatttcagtgatttgggaaagaagagagatgcttcacattttaagcacaagatagttttcagggtgcagagaagagtaatttttctaaggacccagaggatccagtagacctctgtggatcaggacacctgggagagtcccagacatcagggcgactggaaggctcttccccaaccagggcatattccaaggctccaaggctccagctctcagaaagctttggggaatgttctaacag

SEQ ID NO: 21629 - DNA, 2738 bp, Homo sapiens
  ENST00000569532
actccggcttctgtgatgtcagcgccggaacctggaatcccggctccgcgagggaaggccggggaggcggcggcggcggcggcggctggagagggtcctcggcagcctctgaggagcgcggggcgcggccatgagcgagtccagcggcagtgcgctccagcccggcaggcccagccggcagccggcggtccatccagagaacctctctctagactccagttgcttctcttctccacctgtgaacttcctccaagaattgccaagctaccggtccattgcacgtaggagaacgactgtccattcccgggacaagcaaagcggaactttgctaaagccaaccgactcttacagctcccagctggaggacagaatcgctgaaaacctcagcagccattctcttcgaaattatgcactgaacatctctgagaagcggagactaagggacattcaagagacacaaatgaagtatctctccgaatgggaccagtggaagcggtatagcagcaagtcttggaagaggttcctagagaaggctcgagagatgacgacccacctggagctgtggcgggaggacatccgcagcatagaagggaaatttggcactgggattcagtcctatttctccttcttgagattcctggtgttgctgaatttggtgatatttctgatcatctttatgctggttttgctcccagtcttactcacgaaatacaagatcaccaacagcagcttcgtgctcattcctttcaaagacatggataaacaatgtacagtctatccagtaagcagttctggactcatttacttttacagttatatcatagacttgctttctggcactggtttcctggaggaaactagcctcttttacggacattacaccattgatggggtgaaatttcagaacttcacctatgatctgcccctggcgtatttgttaagcacaatcgcctccctggccctgagccttctttggatagtgaaaaggtcggtggaaggattcaaaatcaacctgattcggagtgaggagcactttcagagttactgcaacaagatatttgccggctgggacttctgcatcactaaccgcagcatggcggatctgaagcacagcagcttgcggtacgagctccgagcagatctggaggaagaaagaatgcggcagaaaatagcagaaaggacctcagaagaaacaatacgcatttactctttgagactgtttttgaactgtattgttctggctgttttaggggcatgcttttatgcaatatacgtagcaactgtcttctcgcaagagcacatgaaaaaggaaatcgacaagatggtttttggagagaacctcttcatattgtatctaccgtctattgtgatcacgctggccaattttatcaccccaatgatctttgccaagatcatccgctatgaggattattctccaggctttgagatccgtctgacaatccttaggtgtgtctttatgcggctggccaccatatgtgtcctggtgttcacgctgggctccaagatcacatcctgtgatgatgacacatgtgacctttgcggctacaaccagaaactctacccgtgctgggagacccaagttgggcaggaaatgtacaagctgatgatcttcgacttcatcatcatcttggctgtgacactcttcgtggattttcctagaaagctcctggtgacctactgttcctcttgcaagctgattcagtgctgggggcagcaggagtttgccattcctgataacgtcctggggatagtttacgggcaaaccatctgctggatcggagcctttttctcaccccttctccctgcaattgcaaccctgaaattcattatcatcttctatgtgaaagagtggagtctgctttacacctgcagaccctcccccaggccgttcagagcatccaattctaatttcttcttcctgttggtgttgttgatcgggctgtgtttggcaataatacctctgacaatcagcatatcacgcatcccttcctcgaaagcctgtgggccgttcaccaacttcaacaccacctgggaggtcatccccaagacggtgagcaccttccccagctcgctgcagtccttcatccatggtgtcacatccgaagcctttgcagttcctttcttcatgattatttgcctcatcatgttttacttcattgccttagctggagcacacaaacgggtggtcatccagctccgagagcagctatccctggtaaggaagcatagctccagagggtcatggctggggacatttacccaggacactgcaaggaaagtgctgttttcctgggagggagtgaaattactgcagccttctctcaccaccacctccccaaaactctgccttgaggcccagccgcgtccagcttcattaattcactgattcatccattccttcaagatgtgtattaagggggatgtggtggctcatgcctgtaatcccagcacttttgggaggccgaggcaggcagattacttgagctcaggagttcaagaccagcctggccaacatggtgaaaccccgtctctactaaaaatacaaaaagtagttgggcgtggtggtgggcacctgtaatcccagctacttgggaggctgaggcaggagaatcccttgaactcaggaggtggaggtcgcagtgagctgagattgcgctattgcactccagcctgggtgacagagtgagactccatcttaaaaataaaaataaaaaaag

SEQ ID NO: 21630 - DNA, 3640 bp, Homo sapiens
  ENST00000304381
actccggcttctgtgatgtcagcgccggaacctggaatcccggctccgcgagggaaggccggggaggcggcggcggcggcggcggctggagagggtcctcggcagcctctgaggagcgcggggcgcggccatgagcgagtccagcggcagtgcgctccagcccggcaggcccagccggcagccggcggtccatccagagaacctctctctagactccagttgcttctcttctccacctgtgaacttcctccaagaattgccaagctaccggtccattgcacgtaggagaacgactgtccattcccgggacaagcaaagcggaactttgctaaagccaaccgactcttacagctcccagctggaggacagaatcgctgaaaacctcagcagccattctcttcgaaattatgcactgaacatctctgagaagcggagactaagggacattcaagagacacaaatgaagtatctctccgaatgggaccagtggaagcggtatagcagcaagtcttggaagaggttcctagagaaggctcgagagatgacgacccacctggagctgtggcgggaggacatccgcagcatagaagggaaatttggcactgggattcagtcctatttctccttcttgagattcctggtgttgctgaatttggtgatatttctgatcatctttatgctggttttgctcccagtcttactcacgaaatacaagatcaccaacagcagcttcgtgctcattcctttcaaagacatggataaacaatgtacagtctatccagtaagcagttctggactcatttacttttacagttatatcatagacttgctttctggcactggtttcctggaggaaactagcctcttttacggacattacaccattgatggggtgaaatttcagaacttcacctatgatctgcccctggcgtatttgttaagcacaatcgcctccctggccctgagccttctttggatagtgaaaaggtcggtggaaggattcaaaatcaacctgattcggagtgaggagcactttcagagttactgcaacaagatatttgccggctgggacttctgcatcactaaccgcagcatggcggatctgaagcacagcagcttgcggtacgagctccgagcagatctggaggaagaaagaatgcggcagaaaatagcagaaaggacctcagaagaaacaatacgcatttactctttgagactgtttttgaactgtattgttctggctgttttaggggcatgcttttatgcaatatacgtagcaactgtcttctcgcaagagcacatgaaaaaggaaatcgacaagatggtttttggagagaacctcttcatattgtatctaccgtctattgtgatcacgctggccaattttatcaccccaatgatctttgccaagatcatccgctatgaggattattctccaggctttgagatccgtctgacaatccttaggtgtgtctttatgcggctggccaccatatgtgtcctggtgttcacgctgggctccaagatcacatcctgtgatgatgacacatgtgacctttgcggctacaaccagaaactctacccgtgctgggagacccaagttgggcaggaaatgtacaagctgatgatcttcgacttcatcatcatcttggctgtgacactcttcgtggattttcctagaaagctcctggtgacctactgttcctcttgcaagctgattcagtgctgggggcagcaggagtttgccattcctgataacgtcctggggatagtttacgggcaaaccatctgctggatcggagcctttttctcaccccttctccctgcaattgcaaccctgaaattcattatcatcttctatgtgaaagagtggagtctgctttacacctgcagaccctcccccaggccgttcagagcatccaattctaatttcttcttcctgttggtgttgttgatcgggctgtgtttggcaataatacctctgacaatcagcatatcacgcatcccttcctcgaaagcctgtgggccgttcaccaacttcaacaccacctgggaggtcatccccaagacggtgagcaccttccccagctcgctgcagtccttcatccatggtgtcacatccgaagcctttgcagttcctttcttcatgattatttgcctcatcatgttttacttcattgccttagctggagcacacaaacgggtggtcatccagctccgagagcagctatccctggaaagtcgtgacaagtgctacctaatccagaaactaacagaagcccaaagggacatgaggaactaactagactgagcgtgaagatggtgctgcctgttgcttctaagctgacctagtgattctgctgagcctacagagtctacctgggttttgagtggacatttaaaaatatatttttcttgagtttaggcttttccatatgtgcagctgtgtttacctaacccagcccttaattagggcttcagtgacttagaaaagcaggggaaacccaaggctttgcctgcagaccggccactctgtgacaactctaccaaaaaccaacaagccattcaagcttttacaagaatgaaagagcggagacggtagtttagtatttgagccacgagtttatgtgcacaagtgttttgggttgtggactgaagctcagcctgttaatcagaccagcccatgagtgtataacaaacagaattggaggctggtttcttaaacacacacgtccacattttttagggttgttttcctgtgcttacaatttttaatgcatgtgcctttatttcacaaaacatgtggctgggcgcagcggctcacgcctgttatcccaacactttgggaggccgaggcaggcggagcacctaagttggggagttcaagaccagcctgaccaacgtggagaaactccgtctccactaaaatacaaaattagctgggtgtggtggcacatgcctgtaatatcagctactcaggaggctgaggcaggagaattgcttgaacccaggaggtggagtttgcagtgagctgagatcacaccattgcactccagcctgggcaaaaagagcaaaactctccctaaaaaaaaaatgtagaatatctcttaagatttccgttatggtaaaaaccatatgcaataaatacctcattgtaagcttacccaaaattgatagatgtcaaccttttaacagaagaacagaagtttaagttattgtttaatgtaatcagttttcattttaatatctttgaaatctttttcaaaggactgtagttttgtaatggacttttcaagccttccttccattgtttttcttccgttcactggctccacacgtttcctggggagtagcctggaatttaaagttgggtgcaggttttagaaagctgttgctgttaacaataattctcccggccatctccactccactactcaaaaatgcctgaatccttgctcagaggagcaaaggtatcttctcgtccctttcttacagccattttcttgcttttccacaaagatattatttaaagtggaatatttttgtaactgggataccaatgagcttttcggtcttttcctgacttggtaaggtttatgggtttctaaatctaataactacagtcataccaccctgaaaa

SEQ ID NO: 21631 - DNA, 1617 bp, Homo sapiens
  ENST00000568469
agagggtcctcggcagcctctgaggagcgcggggcgcggccatgagcgagtccagcggcagtgcgctccagcccggcaggcccagccggcagccggcggtccatccagagaacctctctctagactccagttgcttctcttctccacctgtgaacttcctccaagaattgccaagctaccggtccattgcacgtaggagaacgactgtccattcccgggacaagcaaagcggaactttgctaaagccaaccgactcttacagctcccagctggaggacagaatcgctgaaaacctcagcagccattctcttcgaaattatgcactgaacatctctgagaagcggagactaagggacattcaagagacacaaatgaagtatctctccgaatgggaccagtggaagcggtatagcagcaagtcttggaagaggttcctagagaaggctcgagagatgacgacccacctggagctgtggcgggaggacatccgcagcatagaagggaaatttggcactgggattcagtcctatttctccttcttgagattcctggtgttgctgaatttggtgatatttctgatcatctttatgctggttttgctcccagtcttactcacgaaatacaagatcaccaacagcagcttcgtgctcattcctttcaaagacatggataaacaatgtacagtctatccagtaagcagttctggactcatttacttttacagttatatcatagacttgctttctggcactggtttcctggaggaaactagcctcttttacggacattacaccattgatggggtgaaatttcagaacttcacctatgatctgcccctggcgtatttgttaagcacaatcgcctccctggccctgagccttctttggatagtgaaaaggtcggtggaaggattcaaaatcaacctgattcggagtgaggagcactttcagagttactgcaacaagatatttgccggctgggacttctgcatcactaaccgcagcatggcggatctgaagcacagcagcttgcgatctggaggaagaaagaatgcggcagaaaatagcagaaaggacctcagaagaaacaatacgcatttactctttgagactgtttttgaactgtattgttctggctgttttaggggcatgcttttatgcaatatacgtagcaactgtcttctcgcaagagcacatgaaaaaggaaatcgacaagatggtttttggagagaacctcttcatattgtatctaccgtctattgtgatcacgctggccaattttatcaccccaatgatctttgccaagatcatccgctatgaggattattctccaggctttgagatccgtctgacaatccttaggtgtgtctttatgcggctggccaccatatgtgtcctggtgttcacgctgggctccaagatcacatcctgtgatgatgacacatgtgacctttgcggctacaaccagaaactctacccggtgagttgcggggcgggggcgttcggctgggtgggtccttctggaatacagtgtcatggtcaagagaacagcggttgaagccatgggtttgaactgcatttgcttcgctttcttgttctagtgatgagacagagtctg

SEQ ID NO: 21632 - DNA, 4499 bp, Homo sapiens
  ENST00000421369
ttccttattcctgctccctccacaaacgcgtcctcatccaatccagtggaacccagccgggccaaaaggacacgagaactgcagtctggaccgtggtgggtttgtcttccagctgttgaccgagacagtctttcaatagcctcatctgctgttaaatgaaaggatttgagcaccccctccacgcctaacattctggtatgaggtgcctgcctcccggacatttcagccttcacatacagttagaccaacttgaaaccgaattctgccttgtctgtttattgctgtgggacctttgagaacctctctctagactccagttgcttctcttctccacctgtgaacttcctccaagaattgccaagctaccggtccattgcacgtaggagaacgactgtccattcccgggacaagcaaagcggaactttgctaaagccaaccgactcttacagctcccagctggaggacagaatcgctgaaaacctcagcagccattctcttcgaaattatgcactgaacatctctgagaagcggagactaagggacattcaagagacacaaatgaagtatctctccgaatgggaccagtggaagcggtatagcagcaagtcttggaagaggttcctagagaaggctcgagagatgacgacccacctggagctgtggcgggaggacatccgcagcatagaagggaaatttggcactgggattcagtcctatttctccttcttgagattcctggtgttgctgaatttggtgatatttctgatcatctttatgctggttttgctcccagtcttactcacgaaatacaagatcaccaacagcagcttcgtgctcattcctttcaaagacatggataaacaatgtacagtctatccagtaagcagttctggactcatttacttttacagttatatcatagacttgctttctggcactggtttcctggaggaaactagcctcttttacggacattacaccattgatggggtgaaatttcagaacttcacctatgatctgcccctggcgtatttgttaagcacaatcgcctccctggccctgagccttctttggatagtgaaaaggtcggtggaaggattcaaaatcaacctgattcggagtgaggagcactttcagagttactgcaacaagatatttgccggctgggacttctgcatcactaaccgcagcatggcggatctgaagcacagcagcttgcggtacgagctccgagcagatctggaggaagaaagaatgcggcagaaaatagcagaaaggacctcagaagaaacaatacgcatttactctttgagactgtttttgaactgtattgttctggctgttttaggggcatgcttttatgcaatatacgtagcaactgtcttctcgcaagagcacatgaaaaaggaaatcgacaagatggtttttggagagaacctcttcatattgtatctaccgtctattgtgatcacgctggccaattttatcaccccaatgatctttgccaagatcatccgctatgaggattattctccaggctttgagatccgtctgacaatccttaggtgtgtctttatgcggctggccaccatatgtgtcctggtgttcacgctgggctccaagatcacatcctgtgatgatgacacatgtgacctttgcggctacaaccagaaactctacccgtgctgggagacccaagttgggcaggaaatgtacaagctgatgatcttcgacttcatcatcatcttggctgtgacactcttcgtggattttcctagaaagctcctggtgacctactgttcctcttgcaagctgattcagtgctgggggcagcaggagtttgccattcctgataacgtcctggggatagtttacgggcaaaccatctgctggatcggagcctttttctcaccccttctccctgcaattgcaaccctgaaattcattatcatcttctatgtgaaagagtggagtctgctttacacctgcagaccctcccccaggccgttcagagcatccaattctaatttcttcttcctgttggtgttgttgatcgggctgtgtttggcaataatacctctgacaatcagcatatcacgcatcccttcctcgaaagcctgtgggccgttcaccaacttcaacaccacctgggaggtcatccccaagacggtgagcaccttccccagctcgctgcagtccttcatccatggtgtcacatccgaagcctttgcagttcctttcttcatgattatttgcctcatcatgttttacttcattgccttagctggagcacacaaacgggtggtcatccagctccgagagcagctatccctggaaagtcgtgacaagtgctacctaatccagaaactaacagaagcccaaagggacatgaggaactaactagactgagcgtgaagatggtgctgcctgttgcttctaagctgacctagtgattctgctgagcctacagagtctacctgggttttgagtggacatttaaaaatatatttttcttgagtttaggcttttccatatgtgcagctgtgtttacctaacccagcccttaattagggcttcagtgacttagaaaagcaggggaaacccaaggctttgcctgcagaccggccactctgtgacaactctaccaaaaaccaacaagccattcaagcttttacaagaatgaaagagcggagacggtagtttagtatttgagccacgagtttatgtgcacaagtgttttgggttgtggactgaagctcagcctgttaatcagaccagcccatgagtgtataacaaacagaattggaggctggtttcttaaacacacacgtccacattttttagggttgttttcctgtgcttacaatttttaatgcatgtgcctttatttcacaaaacatgtggctgggcgcagcggctcacgcctgttatcccaacactttgggaggccgaggcaggcggagcacctaagttggggagttcaagaccagcctgaccaacgtggagaaactccgtctccactaaaatacaaaattagctgggtgtggtggcacatgcctgtaatatcagctactcaggaggctgaggcaggagaattgcttgaacccaggaggtggagtttgcagtgagctgagatcacaccattgcactccagcctgggcaaaaagagcaaaactctccctaaaaaaaaaatgtagaatatctcttaagatttccgttatggtaaaaaccatatgcaataaatacctcattgtaagcttacccaaaattgatagatgtcaaccttttaacagaagaacagaagtttaagttattgtttaatgtaatcagttttcattttaatatctttgaaatctttttcaaaggactgtagttttgtaatggacttttcaagccttccttccattgtttttcttccgttcactggctccacacgtttcctggggagtagcctggaatttaaagttgggtgcaggttttagaaagctgttgctgttaacaataattctcccggccatctccactccactactcaaaaatgcctgaatccttgctcagaggagcaaaggtatcttctcgtccctttcttacagccattttcttgcttttccacaaagatattatttaaagtggaatatttttgtaactgggataccaatgagcttttcggtcttttcctgacttggtaaggtttatgggtttctaaatctaataactacagtcataccaccctgaaaatgcctgatctcgtctaaatctaataactggtgtcatggaattttgagtaaccaaagattcattccagtctcacttaaaaaaataaattctgctgggcacagtggctcatgcctgcaatcccagaactttgggagtccaaggagggcagatcacctgaagtcagaagtttgagaccagcctggtcaatgtggcaagaccccgtctctactaaaagtacaaaaattagccaggcatggtggcgtgtgcctgtaatcccagctacttgggaggctgaggcatgagaatcacttgaacctgggaggtgaaggctgcagtgtgcgagaccgtgccactgtactccagcctaggtgacagagggagaccctatctcaaaaaaaaagataggtgaaaagaaaaaaaaagttgtaattgtaaacatttctgcccagtgcctttatatttatataacattttcactgtgaccagacttgatgatattcaagttttctatttgtgtgtgtgtgtgtgtgtgtgtgtgatgaacacaacgaaaacgtactgcgttttttttcctattataaaagtgatactgaaatatgctaattaatatattaattttagttaaatgctgctaatatgcatacctcttacttgaaggtttttaatatgttttgataactttaataacttcaggtgatgtctgtataacttttaaagtgcagctctctctaacaaatgtgccttacaactcctgattaaacggcgtcttgaaggttttaaaa

SEQ ID NO: 21633 - DNA, 594 bp, Homo sapiens
  ENST00000561963
ctacaaaaaatacaaataattagctaggtgtggtagcgtgtgcttatagtttgagctatgcgggaggctgaggtgggaggatcacctgaacttggtgaggctgaggctgcagtgagccatgatcacactgctgcactccaccctgggtgacagagtgagaccccatctcaaaaagtaaaaaataaaataaaatgtaggtctggtctgaatcagaggcttgcaactgagatgggtcagcatgagctttataacatggcatatttctggagcccacatgagacctatcgaattgaaaatctcaggtcggtggaaggattcaaaatcaacctgattcggagtgaggagcactttcagagttactgcaacaagatatttgccggctgggacttctgcatcactaaccgcagcatggcggatctgaagcacagcagcttgcggcagatctggaggaagaaagaatgcggcagaaaatagcagaaaggacctcagaagaaacaatacgcatttactctttgagactgtttttgaactgtattgttctggctgttttaggggcatgcttttatgcaatatacgtagcaactgtcttctcgc

SEQ ID NO: 21634 - DNA, 1747 bp, Homo sapiens
  ENST00000424486
ggaacagaggtagcctgaaagaagcaggaactccaggatcccaaaccagagcagaccctatagtaaagtatttttacatcttttcctttccccagaagagatccctaacctattgttttattgacagccttgctgttagaggctctttcccagaagttggacgaagaggctcaggcgttgctgtttcttgtcttccaagtcaagtggttactctggtaatggattgcctctctccgagctttcaccctggtgagactgtccagatctagtctgtaaacccagcttagaagcactgttgtaaaaatgactgaagagcccatcaaggagatcctgggagccccaaaggctcacatggcagcgacgatggagaagagccccaagagtgaagttgtgatcaccacagtccctctggtcagtgagattcagttgatggctgctacagggggtaccgagctctcctgctaccgctgcatcatcccctttgctgtggttgtcttcatcgccggcatcgtggtcaccgcggtggcttacagcttcaattcccatgggtctattatctccatctttggcctggttgttctgtcatctggactttttttactagcctccagtgccttgtgctggaaagtgagacaaaggagcaagaaagccaagagacgggagagtcaaacagctctcgtggcaaatcagagaagcttgtttgcttgagactgaatacgaccaaatgggccattgggcctggaaaacgtgctctgactttgtcacccaattcacccagaaccatggtgggagagaacagacttggcgttggagcagactggaagaatgggggtgggagggtggaggggcttctcctttgtgaggaatgactcatgtcttctttaacgacaaacttaaccctaagggctacttctgagactgaaaaatcagctttctatttacatgaaacactttgggggtcatgggagtgcacagcattagacagtatttggttcaccctgtaaagtagccaagaaaagatgagaaaaatcaagataggcctggcacactagacatttgcctccaaaagaaataacctacagtcttaagatgtatcataaaaatgttctgccaaggatctaaattaccttgggtttcgcatatgtctatgaaattctgtgataatttttttcaatacattgattcactggcgtctgttttcattttatacttttaataactcatcactggtggtactttatcttgaaaagtaatattttttatattttaacattggacagtgttagccagttgtaatgatgtatcagaagtaaagaaaaacccattaaagttatagctaatagatgctgttgggggttaaattaatagtaaaataatccaatatagcacttttgatgatttttatataaaagtcaactgtacatttcattcagaataataaatacttattgctgctaaaacttcttaaatggttgtttctgctatagttatttctattgcagttccaaattgccatcttcccttgtctcatttgcaagttctcaattgtatttctctcaaatggacaggttccttctttactggaggatttttgtttttatcatattggtttttcattacttctgaatagtcttaattacgtttactaaattctaaaggatttctgtgctattataattaggaaatcaacgtctttggtcaggaactttataatgtgctattaaatgtatattacatttttgtggaa

SEQ ID NO: 21635 - DNA, 1962 bp, Homo sapiens
  ENST00000575734
cagttgcttctacaaaacccgtgaaagttctctgtccaaaagccttgttggtcccgcggtacatgcttcctgttcccagagagattcacccttgggctttcctatcagtcttccctaaagttggctgctcctgtgtcctgtcacataaaactgtgaaccgaggtctccgacttacgtcatgtcagtcacagcagggtgaggctccacaagtgtgagttctggcccctgctgctttcctttcaaatgcagtttacagtttattatggtattggacaccccatgctccttactgcattggctttgggtaagaaggagtgaaaattagtgtgcgaacctgaaaacctagaatttctgattgggactgaagaaaacctttgtgctgcagtcagtccccgagccagacgcctgtgactctcttcacatggaaatagatgactatccacagtaaaagcaaaattaaaaagtgacttgtgaaaaatatcctccatgctcctcttaccaagcctgcaacttaaaacctatggtttaaactgtgctttcaattatctggaggaggccagcactgatgagcccatcctgagccagtcattttaaggccagtgctacctaactgagacaaggctaatctggtcgccttgctgttagaggctctttcccagaagttggacgaagaggctcaggcgttgctgtttcttgtcttccaagtcaagtggttactctggtaatggattgcctctctccgagctttcaccctggtgagactgtccagatctagtctgtaaacccagcttagaagcactgttgtaaaaatgactgaagagcccatcaaggagatcctgggagccccaaaggctcacatggcagcgacgatggagaagagccccaagagtgaagttgtgatcaccacagtccctctggtcagtgagattcagttgatggctgctacagggggtaccgagctctcctgctaccgctgcatcatcccctttgctgtggttgtcttcatcgccggcatcgtggtcaccgcggtggcttacagcttcaattcccatgggtctattatctccatctttggcctggttgttctgtcatctggactttttttactagcctccagtgccttgtgctggaaagtgagacaaaggagcaagaaagccaagagacgggagagtcaaacagctctcgtggcaaatcagagaagcttgtttgcttgagactgaatacgaccaaatgggccattgggcctggaaaacgtgctctgactttgtcacccaattcacccagaaccatggtgggagagaacagacttggcgttggagcagactggaagaatgggggtgggagggtggaggggcttctcctttgtgaggaatgactcatgtcttctttaacgacaaacttaaccctaagggctacttctgagactgaaaaatcagctttctatttacatgaaacactttgggggtcatgggagtgcacagcattagacagtatttggttcaccctgtaaagtagccaagaaaagatgagaaaaatcaagataggcctggcacactagacatttgcctccaaaagaaataacctacagtcttaagatgtatcataaaaatgttctgccaaggatctaaattaccttgggtttcgcatatgtctatgaaattctgtgataatttttttcaatacattgattcactggcgtctgttttcattttatacttttaataactcatcactggtggtactttatcttgaaaagtaatattttttatattttaacattggacagtgttagccagttgtaatgatgtatcagaagtaaagaaaaacccattaaagttatagctaatagatgctgttgggggttaaattaatagtaaaataatccaatatagcacttttgatgatttttatataaaagtcaactgtacatttcattcagaataataaatacttattgctgct

SEQ ID NO: 21636 - DNA, 720 bp, Homo sapiens
  ENST00000571679
cacttcagaccacaaatccccacctcattttcaatgaattttttgctgaactgtccacctaaagtgggtaataaaaagatcccagggagcaggttgcactgtgtttaatagtaacacaataaagatttgttggctgtcattcaatggagaagaacatcatttgttgctggccacttgccttgacattgattttgtgggcagccaatgggtgatagtttgcaaagaatgcatgttatgcccagcaagattggcggagtctgagttgctctttcaccctggtgagactgtccagatctagtctgtaaacccagcttagaagcactgttgtaaaaatgactgaagagcccatcaaggagatcctgggagccccaaaggctcacatggcagcgacgatggagaagagccccaagagtgaagttgtgatcaccacagtccctctggtcagtgagattcagttgatggctgctacagggggtaccgagctctcctgctaccgctgcatcatcccctttgctgtggttgtcttcatcgccggcatcgtggtcaccgcggtggcttacagcttcaattcccatgggtctattatctccatctttggcctggttgttctgtcatctggactttttttactagcctccagtgccttgtgctggaaagtgagacaaaggagcaagaaagccaagagacgggagagtcaaacagctctcgtggcaaatcaga

SEQ ID NO: 21637 - DNA, 566 bp, Homo sapiens
  ENST00000575685
gtagaaatgattcggactcatcatgtcactgagcaaagctgggggaagccaaaactcagaatctgctggcaaggaaaagaacgaaggaaaaaaaaaaatccttgctgttagaggctctttcccagaagttggacgaagaggctcaggcgttgctgtttcttgtcttccaagtcaagtggttactctggtaatggattgcctctctccgagcagattggaagatattgttacacttcagaccacaaatccccacctcattttcaatgaattttttgctgaactgtccacctaaagtgggtaataaaaagatcccagggagcaggttgcactgtgtttaatagtaacacaataaagatttgttggctgtcattcaatggagaagaacatcatttgttgctggccacttgccttgacattgattttgtgggcagccaatgggtgatagtttgcaaagaatgcatgttatgcccagcaagattggcggagtctgagttgctgtaagttctgggattaatggtacgaaatattgtttgtaatgtattctcctcttgaatgagaccatcttt

SEQ ID NO: 21638 - DNA, 570 bp, Homo sapiens
  ENST00000570586
gtcatttaggaacagaggtagcctgaaagaagcaggaactccaggatcccaaaccagagcagaccctatagtaaagtatttttacatcttttcctttccccagaagagatccctaacctattgttttattgacagccttgctgttagaggctctttcccagaagttggacgaagaggctcaggcgttgctgtttcttgtcttccaagtcaagtggttactctggtaatggattgcctctctccgaggtgagtcagattggaagatattgttacacttcagaccacaaatccccacctcattttcaatgaattttttgctgaactgtccacctaaagtgggtaataaaaagatcccagggagcaggttgcactgtgtttaatagtaacacaataaagatttgttggctgtcattcaatggagaagaacatcatttgttgctggccacttgccttgacattgattttgtgggcagccaatgggtgatagtttgcaaagaatgcatgttatgcccagcaagattggcggagtctgagttgctgtaagttctgggattaatggtacgaaatatt

SEQ ID NO: 21639 - DNA, 570 bp, Homo sapiens
  ENST00000575806
tttcaaatgcagtttacagtttattatggtattggacaccccatgctccttactgcattggctttgggtaagaaggagtgaaaattagtgtgcgaacctgaaaacctagaatttctgattgggactgaagaaaacctttgtgctgcagtcagtccccgagccagacgcctgtgactctcttcacatggaaatagatgactatccacagtaaaagcaaaattaaaaagtgacttgtgaaaaatatcctccatgctcctcttaccaagcctgcaacttaaaacctatggtttaaactgtgctttcaattatctggaggaggccagcactgatgagcccatcctgagccagtcattttaaggccagtgctacctaactgagacaaggctaatctggtcgccttgctgttagaggctctttcccagaagttggacgaagaggctcaggcgttgctgtttcttgtcttccaagtcaagtggttactctggtaatggattgcctctctccgaggtgagtgtaagtaatttggggacagatcttgattttcaggttagctcaatctcagctttgggg

SEQ ID NO: 21640 - DNA, 555 bp, Homo sapiens
  ENST00000514529
gctttctcctgagccgtcggagggagccggagcgcttctcccgagttggtgatagattggtggtcatccaacatgcagaaatgaatgagcagtgaaaagcagcagagccgatgggtcatgaggatgtaagtgcgtttgaaggcttccacaccctctactccaggatgcttttcaacttatggtggtgtgacatcctgataaacacaatcctccgaagtactttggaaacgtactagcaccattctccgaggcccgatgatcgtacagtggctggaaacggcattttcgcatgtgcttttcctgagtctaggttgtcaggtggatccttcttaggctcctcagtttgaacaagctgtcagagtgtatcaaagaataccagataggaggagaagaaaaagtaacagctgaaaaaaaaaaagagggaaaaaagagtaggcactcccctccacccactctccggttccattcagcacactgacttcattcagcagtttttttcctgctttgtatgcaaagacagagcctctcatgagaacttggatggtggagtataaa

SEQ ID NO: 21641 - DNA, 3744 bp, Homo sapiens
  ENST00000321871
gctttctcctgagccgtcggagggagccggagcgcttctcccgagttggtgatagattggtggtcatccaacatgcagaaatgaatgagcagtgaaaagcagcagagccgatgggtcatgaggatgtaagtgcgtttgaaggcttccacaccctctactccaggacagaatcatgaataaactggaggataagcaggaccagatgataccatgaagagaagtttacaggccctctattgccaactgttaagtttcctgctgatcttggcactgaccgaagcgctggcatttgccatccaggaaccatctcccagggaatctcttcaggtcctcccttcaggcactcccccgggaaccatggtgacagcaccccacagctctaccagacatacttctgtggtgatgctgacccccaatcccgatggacccccctcacaggctgcagctcccatggcaacaccgacaccccgtgcagaggggcaccctcctacgcacaccatctccaccatcgctgcgacagtaaccgccccccattctgaaagctccctgtccacagggcccgctccagcagccatggcaaccacatcctccaagccagagggccgccctcgagggcaggctgcccccaccatcctgctgacaaagccaccgggggccaccagccgccccaccacagcgcccccccgcactaccacacgcaggccccccaggcccccaggctcttcccgaaaaggggctggtaattcatcacgccctgtcccgcctgcacctggtggccactccaggagtaaagaaggacagcgaggacgaaatccaagctccacacctctggggcagaagcggcccctggggaaaatctttcagatctacaagggcaacttcacagggtctgtggaaccggagccctctaccctcacccccaggaccccactctggggctactcctcttcaccacagccccagacagtggctgcgaccacagtgcccagcaatacctcatgggcacccaccaccacctccctggggcctgcaaaggacaagccaggccttcgcagagcagcccaggggggtggttctaccttcaccagccaaggagggacaccagatgccacagcagcctcaggtgcccctgtcagtccacaagctgccccagtgccttctcagcgcccccaccacggtgacccacaggatggccccagccatagtgactcttggcttactgttacccctggcaccagcagacctctgtctaccagctctggggtcttcacggctgccacggggcccaccccagctgccttcgataccagtgtctcagccccttcccaggggattcctcagggagcatccacaaccccacaagctccaacccatccctccagggtctcagaaagcactatttctggagccaaggaggagactgtggccaccctcaccatgaccgaccgggtgcccagtcctctctccacagtggtatccacagccacaggcaatttcctcaaccgcctggtccccgccgggacctggaagcctgggacagcagggaacatctcccatgtggccgagggggacaaaccgcagcacagagccaccatctgcctgagcaagatggatatcgcctgggtgatcctggccatcagcgtgcccatctcctcctgctctgtcctgctgacggtgtgctgcatgaagaggaagaagaagaccgccaacccggagaacaacctgagctactggaacaacaccatcaccatggactacttcaacaggcatgctgtggagctgcccagggagatccagtcccttgaaacctctgaggaccagctctcagagccccgctccccagccaatggcgactatagagacactgggatggtccttgttaaccccttctgtcaagaaacactgtttgtgggaaacgatcaagtatctgagatctaactacagcaggcatcactttgccattccgtatttttcgtctctaaattataaatatacaaatacatatattataaatataacctttgtgtaaccctgacttaatgagaaacattttcagctttttttcctatgaattgtcaacatcttttttacaagtgtggtttaaaaaaaaaaaaaactttacagaatgatctgtggctttataaaataaaggtatttctaagcaaagcagttgcattgattgcttctcttaataactattcttgagcacctggggatcccaggaaccctggtcaggtgaggtaagagactgacctcctgtagaagctgaatgttacagtgcaagcgcacgattctttgagtgattcttaaagctctggttcctcttgatttggtgtgaccccatttcctcccttctcatacgcacacctgtaaagggaactggaccgcctcaggggaagacggcagactcatgcacagagaaggaaaagggaacatctcatcacctctgaggatgagtaccctggagccttatgacggcaccattggatgtcatgtttaattccatccaagttgtggatggcaggcaggagcatggagccctcaggaatccatggaggacatcaaggcatcccaaggccatattcccctaacattacttccactgctaacaacaggactgcctttccctggtgggaaaatgctccctttatgcccattcctgtatcccctccaacacccacatctgcattaaacacccgtgcctttctcttggagagggtttagatgcagatcccggccctggagctttaaaatgcttgcccttccttcttcaaggatcaaatgtttattggggttcagctttgttttctcaaaaggccatggtatcgtgcccctgaggaacatgtttatctaagaagctttgaggtagtagagcgataatttttgaaaccttcctcctgcaatctttaaaaaagaaaaaaaagattgcccaaacaaatcatttgggagaagacatcattatactcctacttggcactgcaaacctgctcgcagcaccagccggtggacttgccatccagctctcagcttccactgctccccttgttcccggccggctggctgcctccccgtgctgtgtccagcacggccaacaacgtcagaccctcagagacgcccaaggggcttccagaggtggccgcttctctattttttcctgattgtggctgagagagatgattactgctttgacacttcctttctctaaaagaaaaatagtttgatagtatattttgaatatagatgctcttatagtcagattgggaattgaacttgaatattgggtcatatgtttgtgttgttgctgtagtctatcatgacttttttctttctgcattttccttaaaaaaaaaaaaaagatggccttcaaaagtgtgttctcaatgttgtatgaacctccttcacatgagttcggttgttgtctctcttcaaagactcttcaacccacaaagaagcaactaaatgtttctctaagtttaattttctagcgtgttgttgtcttacctttttaaccttaccataatatttctgttaactgttacatttaatataccaatgtgtgtaagtatacagagaaaaatctgtttgtaaagtaaaatttatatataatatatgtaatcaaagatacatatgttatatatacatatgtggatgtatgacttatttttccttatccacagatttcagctaccatgtatatataaataaacttattttattagccagaggattctgttgctaatacat

SEQ ID NO: 21642 - DNA, 2165 bp, Homo sapiens
  ENST00000393130
agccgtcggagggagccggagcgcttctcccgagttggtgatagattggtggtcatccaacatgcagaaatgaatgagcagtgaaaagcagcagagccgatgggtcatgaggatgtaagtgcgtttgaaggcttccacaccctctactccaggaatcatgaataaactggaggataagcaggaccagatgataccatgaagagaagtttacaggccctctattgccaactgttaagtttcctgctgatcttggcactgaccgaagcgctggcatttgccatccaggaaccatctcccagggaatctcttcaggtcctcccttcaggcactcccccgggaaccatggtgacagcaccccacagctctaccagacatacttctgtggtgatgctgacccccaatcccgatggacccccctcacaggctgcagctcccatggcaacaccgacaccccgtgcagaggggcaccctcctacgcacaccatctccaccatcgctgcgacagtaaccgccccccattctgaaagctccctgtccacagggcccgctccagcagccatggcaaccacatcctccaagccagagggccgccctcgagggcaggctgcccccaccatcctgctgacaaagccaccgggggccaccagccgccccaccacagcgcccccccgcactaccacacgcaggccccccaggcccccaggctcttcccgaaaaggggctggtaattcatcacgccctgtcccgcctgcacctggtggccactccaggagtaaagaaggacagcgaggacgaaatccaagctccacacctctggggcagaagcggcccctggggaaaatctttcagatctacaagggcaacttcacagggtctgtggaaccggagccctctaccctcacccccaggaccccactctggggctactcctcttcaccacagccccagacagtggctgcgaccacagtgcccagcaatacctcatgggcacccaccaccacctccctggggcctgcaaaggacaagccaggccttcgcagagcagcccaggggggtggttctaccttcaccagccaaggagggacaccagatgccacagcagcctcaggtgcccctgtcagtccacaagctgccccagtgccttctcagcgcccccaccacggtgacccacaggatggccccagccatagtgactcttggcttactgttacccctggcaccagcagacctctgtctaccagctctggggtcttcacggctgccacggggcccaccccagctgccttcgataccagtgtctcagccccttcccaggggattcctcagggagcatccacaaccccacaagctccaacccatccctccagggtctcagaaagcactatttctggagccaaggaggagactgtggccaccctcaccatgaccgaccgggtgcccagtcctctctccacagtggtatccacagccacaggcaatttcctcaaccgcctggtccccgccgggacctggaagcctgggacagcagggaacatctcccatgtggccgagggggacaaaccgcagcacagagccaccatctgcctgagcaagatggatatcgcctgggtgatcctggccatcagcgtgcccatctcctcctgctctgtcctgctgacggtgtgctgcatgaagaggaagaagaagaccgccaacccggagaacaacctgagctactggaacaacaccatcaccatggactacttcaacaggcatgctgtggagctgcccagggagatccagtcccttgaaacctctgaggaccagctctcagagccccgctccccagccaatggcgactatagagacactgggatggtccttgttaaccccttctgtcaagaaacactgtttgtgggaaacgatcaagtatctgagatctaactacagcaggcatcactttgccattccgtatttttcgtctctaaattataaatatacaaatacatatattataaatataacctttgtgtaaccctgacttaatgagaaacattttcagctttttttcctatgaattgtcaacatcttttttacaagtgtggtttaaaaaaaaaaaaaactttacagaatgatctgtggctttataaaataaaggtatttctaagcaaagcagttgcattgat

SEQ ID NO: 21643 - DNA, 823 bp, Homo sapiens
  ENST00000514894
cggagggagccggagcgcttctcccgagttggtgatagattggtggtcatccaacatgcagaaatgaatgagcagtgaaaagcagcagagccgatgggtcatgaggatgtaagtgcgtttgaaggcttccacaccctctactccaggacagaatcatgaataaactggaggataagcaggaccagatgataccatgaagagaagtttacaggccctctattgccaactgttaaggccctgccttctccatcagacacctgggaatcacagctggggcccctgctttggccgtttgtcctgctggaatctgatggaggaaagacgctctgagagagtaattagacgcagacagagatctctctccatagtcagaggagcctagcaggggctgaaggaactgcctgaggatgacaaagaaggggatccatgaacaaggaggtgctaacaggtttcctgctgatcttggcactgaccgaagcgctggcatttgccatccaggaaccatctcccagggaatctcttcaggtcctcccttcaggcactcccccgggaaccatggtgacagcaccccacagctctaccagacatacttctgtggtgatgctgacccccaatcccgatggacccccctcacaggctgcagctcccatggcaacaccgacaccccgtgcagaggggcaccctcctacgcacaccatctccaccatcgctgcgacagtaaccgccccccattctgaaagctccctgtccacagggcccgctccagcagccatggcaaccacatcctccaagccagagggccgccctcgagggcaggctgccc

SEQ ID NO: 21644 - DNA, 874 bp, Homo sapiens
  ENST00000512662
ccggagcgcttctcccgagttggtgatagattggtggtcatccaacatgcagaaatgaatgagcagtgaaaagcagcagagccgatgggtcatgaggatgtaagtgcgtttgaaggcttccacaccctctactccaggatgcttttcaacttatggtggtgtgacatcctgataaacacaatacagaatcatgaataaactggaggataagcaggaccagatgataccatgaagagaagtttacaggccctctattgccaactgttaaggttatctatgaagcacttgtgatgtttttgagcagtaaccaccattttttgagtatgtacatgttacacagcctgtcatataccaatcatgtcagtcaggatccccacagggagcagatggcactcaactggggtttcctgctgatcttggcactgaccgaagcgctggcatttgccatccaggaaccatctcccagggaatctcttcaggtcctcccttcaggcactcccccgggaaccatggtgacagcaccccacagctctaccagacatacttctgtggtgatgctgacccccaatcccgatggacccccctcacaggctgcagctcccatggcaacaccgacaccccgtgcagaggggcaccctcctacgcacaccatctccaccatcgctgcgacagtaaccgccccccattctgaaagctccctgtccacagggcccgctccagcagccatggcaaccacatcctccaagccagagggccgccctcgagggcaggctgcccccaccatcctgctgacaaagccaccgggggccaccagccgccccaccacagcgcccccccgcactaccacacgcaggccccccaggcccccaggctc

SEQ ID NO: 21645 - DNA, 681 bp, Homo sapiens
  ENST00000512137
gaagctagtctacacacatggatgggactatggaaatatacatgtgacttttaaacctgaacagtagctgttggtgatagattggtggtcatccaacatgcagaaatgaatgagcagtgaaaagcagcagagccgatgggtcatgaggatgtaagtgcgtttgaaggcttccacaccctctactccaggacagaatcatgaataaactggaggataagcaggaccagatgataccatgaagagaagtttacaggccctctattgccaactgttaagtttcctgctgatcttggcactgaccgaagcgctggcatttgccatccaggaaccatctcccagggaatctcttcaggtcctcccttcaggcactcccccgggaaccatggtgacagcaccccacagctctaccagacatacttctgtggtgatgctgacccccaatcccgatggacccccctcacaggctgcagctcccatggcaacaccgacaccccgtgcagaggggcaccctcctacgcacaccatctccaccatcgctgcgacagtaaccgccccccattctgaaagctccctgtccacagggcccgctccagcagccatggcaaccacatcctccaagccagagggccgccctcgagggcaggctgcccccaccatcctgctgacaaagccaccgggggc

SEQ ID NO: 21646 - DNA, 510 bp, Homo sapiens
  ENST00000511555
gtatgcaaagacagagcctctcatgagaacttggatggtggagtataaacactcatttaaaaataaatccagatgtagttggctgcagtcatctgacagaaccctgattctctcttcaataatgacgttcatttgtacctcattaattgagagtttttaataatttctccagggtaagaaaactgagtcacacaaggatatatttgtgtaacacaatttcaaaaaggcaaactcttgctcttgttaacgacagaatcatgaataaactggaggataagcaggaccagatgataccatgaagagaagtttacaggccctctattgccaactgttaagtttcctgctgatcttggcactgaccgaagcgctggcatttgccatccaggaaccatctcccagggaatctcttcaggtcctcccttcaggcactcccccgggaaccatggtgacagcaccccacagctctaccagacatacttctgtggtgatgctgacccccaatcccgatgg

SEQ ID NO: 21647 - DNA, 2470 bp, Homo sapiens
  ENST00000508711
gagagcaagacggcagcatctacggttctttctgctcaggaatgggaacccagagtgggcagtagagcggaggcaagccatgcagaggcaggagcagatgagaccctagatgccacgagaagctaaacatgtggggaaaataaagagcagattaactcaggaaaattatatggggagctcttatgctactctgaagatctgagactcgttggagaatttacaatcccaaattaactcagggagaattccaactagactctgaaatgaattagatggagatttaaaatagggcaatttagtgggaagagatacttaatttgaagacagaatcatgaataaactggaggataagcaggaccagatgataccatgaagagaagtttacaggccctctattgccaactgttaactgtcctgctgacggtgtgctgcatgaagaggaagaagaagaccgccaacccggagaacaacctgagctactggaacaacaccatcaccatggactacttcaacaggcatgctgtggagctgcccagggagatccagtcccttgaaacctctgaggaccagctctcagagccccgctccccagccaatggcgactatagagacactgggatggtccttgttaaccccttctgtcaagaaacactgtttgtgggaaacgatcaagtatctgagatctaactacagcaggcatcactttgccattccgtatttttcgtctctaaattataaatatacaaatacatatattataaatataacctttgtgtaaccctgacttaatgagaaacattttcagctttttttcctatgaattgtcaacatcttttttacaagtgtggtttaaaaaaaaaaaaaactttacagaatgatctgtggctttataaaataaaggtatttctaagcaaagcagttgcattgattgcttctcttaataactattcttgagcacctggggatcccaggaaccctggtcaggtgaggtaagagactgacctcctgtagaagctgaatgttacagtgcaagcgcacgattctttgagtgattcttaaagctctggttcctcttgatttggtgtgaccccatttcctcccttctcatacgcacacctgtaaagggaactggaccgcctcaggggaagacggcagactcatgcacagagaaggaaaagggaacatctcatcacctctgaggatgagtaccctggagccttatgacggcaccattggatgtcatgtttaattccatccaagttgtggatggcaggcaggagcatggagccctcaggaatccatggaggacatcaaggcatcccaaggccatattcccctaacattacttccactgctaacaacaggactgcctttccctggtgggaaaatgctccctttatgcccattcctgtatcccctccaacacccacatctgcattaaacacccgtgcctttctcttggagagggtttagatgcagatcccggccctggagctttaaaatgcttgcccttccttcttcaaggatcaaatgtttattggggttcagctttgttttctcaaaaggccatggtatcgtgcccctgaggaacatgtttatctaagaagctttgaggtagtagagcgataatttttgaaaccttcctcctgcaatctttaaaaaagaaaaaaaagattgcccaaacaaatcatttgggagaagacatcattatactcctacttggcactgcaaacctgctcgcagcaccagccggtggacttgccatccagctctcagcttccactgctccccttgttcccggccggctggctgcctccccgtgctgtgtccagcacggccaacaacgtcagaccctcagagacgcccaaggggcttccagaggtggccgcttctctattttttcctgattgtggctgagagagatgattactgctttgacacttcctttctctaaaagaaaaatagtttgatagtatattttgaatatagatgctcttatagtcagattgggaattgaacttgaatattgggtcatatgtttgtgttgttgctgtagtctatcatgacttttttctttctgcattttccttaaaaaaaaaaaaaagatggccttcaaaagtgtgttctcaatgttgtatgaacctccttcacatgagttcggttgttgtctctcttcaaagactcttcaacccacaaagaagcaactaaatgtttctctaagtttaattttctagcgtgttgttgtcttacctttttaaccttaccataatatttctgttaactgttacatttaatataccaatgtgtgtaagtatacagagaaaaatctgtttgtaaagtaaaatttatatataatatatgtaatcaaagatacatatgttatatatacatatgtggatgtatgacttatttttccttatccacagatttcagctaccatgtatatataaataaacttattttattagcc

SEQ ID NO: 21648 - DNA, 4833 bp, Homo sapiens
  ENST00000515826
tccaactagactctgaaatgaattagatggagatttaaaatagggcaatttagtgggaagagatacttaatttgaagacagaatcatgaataaactggaggataagcaggaccagatgataccatgaagagaagtttacaggccctctattgccaactgttaagtttcctgctgatcttggcactgaccgaagcgctggcatttgccatccaggaaccatctcccagggaatctcttcaggtcctcccttcaggcactcccccgggaaccatggtgacagcaccccacagctctaccagacatacttctgtggtgatgctgacccccaatcccgatggacccccctcacaggctgcagctcccatggcaacaccgacaccccgtgcagaggggcaccctcctacgcacaccatctccaccatcgctgcgacagtaaccgccccccattctgaaagctccctgtccacagggcccgctccagcagccatggcaaccacatcctccaagccagagggccgccctcgagggcaggctgcccccaccatcctgctgacaaagccaccgggggccaccagccgccccaccacagcgcccccccgcactaccacacgcaggccccccaggcccccaggctcttcccgaaaaggggctggtaattcatcacgccctgtcccgcctgcacctggtggccactccaggagtaaagaaggacagcgaggacgaaatccaagctccacacctctggggcagaagcggcccctggggaaaatctttcagatctacaagggcaacttcacagggtctgtggaaccggagccctctaccctcacccccaggaccccactctggggctactcctcttcaccacagccccagacagtggctgcgaccacagtgcccagcaatacctcatgggcacccaccaccacctccctggggcctgcaaaggacaagccaggccttcgcagagcagcccaggggggtggttctaccttcaccagccaaggagggacaccagatgccacagcagcctcaggtgcccctgtcagtccacaagctgccccagtgccttctcagcgcccccaccacggtgacccacaggatggccccagccatagtgactcttggcttactgttacccctggcaccagcagacctctgtctaccagctctggggtcttcacggctgccacggggcccaccccagctgccttcgataccagtgtctcagccccttcccaggggattcctcagggagcatccacaaccccacaagctccaacccatccctccagggtctcagaaagcactatttctggagccaaggaggagactgtggccaccctcaccatgaccgaccgggtgcccagtcctctctccacagtggtatccacagccacaggcaatttcctcaaccgcctggtccccgccgggacctggaagcctgggacagcagggaacatctcccatgtggccgagggggacaaaccgcagcacagagccaccatctgcctgagcaagatggatatcgcctgggtgatcctggccatcagcgtgcccatctcctcctgctcagatcctatcacctgaaagcatgcccttccacaaatgtgaatacagtactcagggctccatctgaaaatggagtgacccctcttcttcctgtcacacatctgacaagccatggatgactccccagtgacattcctgggaacccaagagagcttaattcccaactctgttttaaaactcaaggaaattgggactccatgacctcctccagagtcttgatggctactgcctcaggagaaacagagcagttgaagcttttcaactaaatgggaaagggaacagttaacatcttgtgtttgcatagagctgcgcagtttacaaaacgcttctgcatatgtcatctctataccctccggtgttcaggacaatacaggatagtggatatcaacttgaagatcatcaagacctggactcaagttgcagtaattagttgggtgatcaagatcaatactattagcttctatgaccttcagttacctgttctgaaaatgggaagagcaatagtgccttcctcaggcagttatcatgtgggctaaataagcttcaaagtgcctgggtcagtgctgggaatatagtagagaccctgtaagtctgacttgtacttttctttcttggatgaaaggtgagaccactgaaatagtgaatgttctaacccctaggtggagctttgtccttgagccacccaatagtcatataacacagtttttctttctagatctctcttgtagaggatgttgggagaacaagaagagaactgtcattaattaagcatccattgtgtgtcaggcattgtgtttggcattttgcatccatgatctctttaattctcattacaagcctatgaagttcatcttaagtgactttccaggtggaatacatggcagagtcacaatttgaacctaggtctttctgtagccaggctggctttcagtaagtaaatgaaatggtgtttgagaagcactggaaactccctgagagaaatataatcaggccaggagcatgaacatgtgaggggaagacagcgtggagcagaactttctgttctgactcccaggccttcccgcagggcaggatctctgcatctggcattctaacaacatgggctgttagagcactggactcgggggcggaggacttggattctgcaacctctaccagcccaggttagcagcatggccttgagcaagttcacctctctaggtttccatgccccaccttctagaataagaatgtaggctgggggaaggggctgatttgtttcagcacctactgtgcaccagggacaatttgaagtgctggcagatgtatgactgcatttaatcttcccaaggaagctgacgctgagagaggttaagtaacttactcaagtcatgcaagtaatagattgtcacctagattctaattctaaattcgatgtcccttttgccctattgactaggcctaagatggcatctgtcactttgattctgtttgcttataactgctcagtagatcagaggcacaaatatctttctaccttagagaggcgtgcaaactatacaaatctgactcacagatacacttttcccctgccagcctgtgttctgtgtctatggcagtgttttgtggggcatgatgggatgtgcccctacaggctgataactgaagagctgttctgtttgtcctgattgctcccctccctctagctctaactctaccaaaactgagctggagctgaggaaacagcacttttcccacttcccagatggttccctctttatggcttctgtcacaccagctagaactcctccaggtgtttcaccatgccagctgcaggagcagagtgaaaggtagtgacaatgaagaacagagacaccagagaaggggacaggggacccgggatcttgtcccagctctgccactcacatacctgtgacctgtggcaaggcggccagcactttaggccacagtttttcctctagaataaggaggcggcctgaattagcaagtttcaggctgagcaccacagccccctccttgcccctttcctcttcaaccatctgaagaaagggttttttggaaggaagggagggaaagaggaaagagatccacaatatttgaaaagttctgtaccagctaatctctcaaatccccgttagccctaacactcagaaattccttctatgttttaaagattttttaaaaaggatctagaagactgaaaagcaaattagaagtctttttgatcaaagcagataagataaagtagaaacttaccctatctcctaaccttgtacagagacctttccaggttgagaggccagcaaggctggcagctggaaagaaagctacagaattccccaggcagcctacagggccctgggctctgggctgtgaggtctcagcctatacaggtgccagcttgtgcaactgccccacaccctggcatgaacccacccctgatgctggccagaccctcaggctgctgcgaacagagctggccctctgccaacccccggtgctggcctctctggacagcccagcctgggaccccgactccccagcacagagatggttggcaccaccaggatgtcagatgtggctcttggcttcagctctcctcatccccagaggctctggtgatgatgaacctggggcaggatatactcagtcctcacttcatggcttctccccaagaggcctctgtcacccttgtccttgtgttacccttctgcagtgtgaatctggacaggccaccccacctctctgacctcagaagccttccctgctcacaagccactcaattcacacatggttaatcaacaatatcgagacataattcttcctcctgggccctgggagtctcagggatgaacagacagggtcacatgtcacactgtgctcagtcaagctgtgtggagcccacctcaggccatctgtgcaggtgggcttttgcatcaatctaaggcaggaatcagctggtaagagcatagactggccaggtgcagtggctcacacctgtaatcaatcccagcactttaggaggctgaggcaggcggattacctgaggtcaggagttcgagaccagcctaaccaacatggcaaaaccctgtctctactaaaaatacaaaaattagccagacatggtggcaggcacctgtaatatcccagcttcttgggaggctgaggcaggagaatcgcttgatcccaggaggcagaggttgcagtgagccaagattgcgccactgcactccagcctgggcaacggagctagactccatc

SEQ ID NO: 21649 - DNA, 555 bp, Homo sapiens
  ENST00000510183
ggtgaggcggccagcttcatgaggaaggagaatgcattgggaagcaagaaaagaatcatgaataaactggaggataagcaggaccagatgataccatgaagagaagtttacaggccctctattgccaactgttaagtttcctgctgatcttggcactgaccgaagcgctggcatttgccatccaggaaccatctcccagggaatctcttcaggtcctcccttcaggcactcccccgggaaccatggtgacagcaccccacagctctaccagacatacttctgtggtgatgctgacccccaatcccgatggacccccctcacaggctgcagctcccatggcaacaccgacaccccgtgcagaggggcaccctcctacgcacaccatctccaccatcgctgcgacagtaaccgccccccattctgaaagctccctgtccacagggcccgctccagcagccatggcaaccacatcctccaagccagagggccgccctcgagggcaggctgcccccaccatcctgctgacaaagccaccgggggccaccagccgcccca

SEQ ID NO: 21650 - DNA, 1929 bp, Homo sapiens
  ENST00000511388
agtattttacctcttctctctgtctccttttcaaggtttcctgctgatcttggcactgaccgaagcgctggcatttgccatccaggaaccatctcccagggaatctcttcaggtcctcccttcaggcactcccccgggaaccatggtgacagcaccccacagctctaccagacatacttctgtggtgatgctgacccccaatcccgatggacccccctcacaggctgcagctcccatggcaacaccgacaccccgtgcagaggggcaccctcctacgcacaccatctccaccatcgctgcgacagtaaccgccccccattctgaaagctccctgtccacagggcccgctccagcagccatggcaaccacatcctccaagccagagggccgccctcgagggcaggctgcccccaccatcctgctgacaaagccaccgggggccaccagccgccccaccacagcgcccccccgcactaccacacgcaggccccccaggcccccaggctcttcccgaaaaggggctggtaattcatcacgccctgtcccgcctgcacctggtggccactccaggagtaaagaaggacagcgaggacgaaatccaagctccacacctctggggcagaagcggcccctggggaaaatctttcagatctacaagggcaacttcacagggtctgtggaaccggagccctctaccctcacccccaggaccccactctggggctactcctcttcaccacagccccagacagtggctgcgaccacagtgcccagcaatacctcatgggcacccaccaccacctccctggggcctgcaaaggacaagccaggccttcgcagagcagcccaggggggtggttctaccttcaccagccaaggagggacaccagatgccacagcagcctcaggtgcccctgtcagtccacaagctgccccagtgccttctcagcgcccccaccacggtgacccacaggatggccccagccatagtgactcttggcttactgttacccctggcaccagcagacctctgtctaccagctctggggtcttcacggctgccacggggcccaccccagctgccttcgataccagtgtctcagccccttcccaggggattcctcagggagcatccacaaccccacaagctccaacccatccctccagggtctcagaaagcactatttctggagccaaggaggagactgtggccaccctcaccatgaccgaccgggtgcccagtcctctctccacagtggtatccacagccacaggcaatttcctcaaccgcctggtccccgccgggacctggaagcctgggacagcagggaacatctcccatgtggccgagggggacaaaccgcagcacagagccaccatctgcctgagcaagatggatatcgcctgggtgatcctggccatcagcgtgcccatctcctcctgctctgtcctgctgacggtgtgctgcatgaagaggaagaagaagaccgccaacccggagaacaacctgagctactggaacaacaccatcaccatggactacttcaacaggcatgctgtggagctgcccagggagatccagtcccttgaaacctctgaggaccagctctcagagccccgctccccagccaatggcgactatagagacactgggatggtccttgttaaccccttctgtcaagaaacactgtttgtgggaaacgatcaagtatctgagatctaactacagcaggcatcactttgccattccgtatttttcgtctctaaattataaatatacaaatacatatattataaatataacctttgtgtaaccctgacttaatgagaaacattttcagctttttttcctatgaattgtcaacatcttttttacaagtgtggtttaaaaaaaaaaaaaactttacagaatgatctgtggctttataa

SEQ ID NO: 21651 - DNA, 3321 bp, Homo sapiens
  ENST00000361236
cccagcccggccccgccgccccggctgcgcacgcgacgccccctccaggccccgctcctgcgccctatttggtcattcggggggcaagcggcgggaggggaaacgtgcgcggccgaaggggaagcggagccggcgccggctgcgcagaggagccgctctcgccgccgccacctcggctgggagcccacgaggctgccgcatcctgccctcggaacaatgggactcggcgcgcgaggtgcttgggccgcgctgctcctggggacgctgcaggtgctagcgctgctgggggccgcccatgaaagcgcagccatggcggagactctccaacatgtgccttctgaccatacaaatgaaacttccaacagtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaatcacaacaactatgcattctgaagcaaagaaaggatcaaaatttgatactgggagctttgttggtggtattgtattaacgctgggagttttatctattctttacattggatgcaaaatgtattactcaagaagaggcattcggtatcgaaccatagatgaacatgatgccatcatttaaggaaatccatggaccaaggatggaatacagattgatgctgccctatcaattaattttggtttattaatagtttaaaacaatattctctttttgaaaatagtataaacaggccatgcatataatgtacagtgtattacgtaaatatgtaaagattcttcaaggtaacaagggtttgggttttgaaataaacatctggatccttatagaccgttcatacaatggttttagcaagttcatagtaagacaaacaagtcctatctttttttttttggctggggtgggggcattggtcacatatgaccagtaattgaaagacgtcatcactgaaagacagaatgccatctgggcatacaaataagaagtttgtcacagcactcaggattttgggtatcttttgtagctcacataaagaacttcagtgcttttcagagctggatatatcttaattactaatgccacacagaaattatacaatcaaactagatctgaagcataatttaagaaaaacatcaacattttttgtgctttaaactgtagtagttggtctagaaacaaaatactccaagaaaaagaaaattttcaaataaaacccaaaataatagctttgcttagccctgttagggatccattggagcattaaggagcacatatttttattaacttcttttgagctttcaatgttgatgtaatttttgttctctgtgtaatttaggtaaactgcagtgtttaacataataatgttttaaagacttagttgtcagtattaaataatcctggcattatagggaaaaaacctcctagaagttagattatttgctactgtgagaatattgtcaccactggaagttactttagttcatttaattttaattttatattttgtgaatattttaagaactgtagagctgctttcaatatctagaaatttttaattgagtgtaaacacacctaactttaagaaaaagaaccgcttgtatgattttcaaaagaacatttagaattctatagagtcaaaactatagcgtaatgctgtgtttattaagccagggattgtgggacttcccccaggcaactaaacctgcaggatgaaaatgctatattttctttcatgcactgtcgatattactcagatttggggaaatgacatttttatactaaaacaaacaccaaaatattttagaataaattcttagaaagttttgagaggaatttttagagaggacatttcctccttcctgatttggatattccctcaaatccctcctcttactccatgctgaaggagaagtactctcagatgcattatgttaatggagagaaaaagcacagtattgtagagacaccaatattagctaatgtattttggagtgttttccattttacagtttatattccagcactcaaaactcagggtcaagttttaacaaaagaggtatgtagtcacagtaaatactaagatggcatttctatctcagagggccaaagtgaatcacaccagtttctgaaggtcctaaaaatagctcagatgtcctaatgaacatgcacctacatttaataggagtacaataaaactgttgtcagcttttgttttacagagaacgctagatattaagaattttgaaatggatcatttctacttgctgtgcattttaaccaataatctgatgaatatagaaaaaaatgatccaaaatatggatatgattggatgtatgtaacacatacatggagtatggaggaaattttctgaaaaatacatttagattagtttagtttgaaggagaggtgggctgatggctgagttgtatgttactaacttggccctgactggttgtgcaaccattgcttcatttctttgcaaaatgtagttaagatatactttattctaatgaaggccttttaaatttgtccactgcattcttggtatttcactacttcaagtcagtcagaacttcgtagaccgacctgaagtttctttttgaatacttgtttctttagcactttgaagatagaaaaaccactttttaagtactaagtcatcatttgccttgaaagtttcctctgcattgggtttgaagtagtttagttatgtctttttctctgtatgtaagtagtataatttgttactttcaaatacccgtactttgaatgtaggtttttttgttgttgttatctataaaaattgagggaaatggttatgcaaaaaaatattttgctttggaccatatttcttaagcataaaaaaaatgctcagttttgcttgcattccttgagaatgtatttatctgaagatcaaaacaaacaatccagatgtataagtactaggcagaagccaattttaaaatttccttgaataatccatgaaaggaataattcaaatacagataaacagagttggcagtatattatagtgataattttgtattttcacaaaaaaaaagttaaactcttcttttctttttattataatgaccagcttttggtatttcattgttaccaagttctatttttagaataaaattgttctccttctaaaa

SEQ ID NO: 21652 - DNA, 3579 bp, Homo sapiens
  ENST00000398136
aaaggcttccttccgggcaccgcgaagccagcgtgctcagcattcagggaggcagcggcgctcgccttcatccaggacaacaaaactgccatttccgaagagaaaggaaacggctcgcggtttctggggttcccaagcgcgcgcctgcgagggaggccgcgagccgagtcgccacgcccagaaccccgagcccgcccccgcgccacccagcccggccccgccgccccggctgcgcacgcgacgccccctccaggccccgctcctgcgccctatttggtcattcggggggcaagcggcgggaggggaaacgtgcgcggccgaaggggaagcggagccggcgccggctgcgcagaggagccgctctcgccgccgccacctcggctgggagcccacgaggctgccgcatcctgccctcggaacaatgggactcggcgcgcgaggtgcttgggccgcgctgctcctggggacgctgcaggtgctagcgctgctgggggccgcccatgaaagcgcagccatggcggcatctgcaaacatagagaattctgggcttccacacaactccagtgctaactcaacagagactctccaacatgtgccttctgaccatacaaatgaaacttccaacagtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaatcacaacaactatgcattctgaagcaaagaaaggatcaaaatttgatactgggagctttgttggtggtattgtattaacgctgggagttttatctattctttacattggatgcaaaatgtattactcaagaagaggcattcggtatcgaaccatagatgaacatgatgccatcatttaaggaaatccatggaccaaggatggaatacagattgatgctgccctatcaattaattttggtttattaatagtttaaaacaatattctctttttgaaaatagtataaacaggccatgcatataatgtacagtgtattacgtaaatatgtaaagattcttcaaggtaacaagggtttgggttttgaaataaacatctggatccttatagaccgttcatacaatggttttagcaagttcatagtaagacaaacaagtcctatctttttttttttggctggggtgggggcattggtcacatatgaccagtaattgaaagacgtcatcactgaaagacagaatgccatctgggcatacaaataagaagtttgtcacagcactcaggattttgggtatcttttgtagctcacataaagaacttcagtgcttttcagagctggatatatcttaattactaatgccacacagaaattatacaatcaaactagatctgaagcataatttaagaaaaacatcaacattttttgtgctttaaactgtagtagttggtctagaaacaaaatactccaagaaaaagaaaattttcaaataaaacccaaaataatagctttgcttagccctgttagggatccattggagcattaaggagcacatatttttattaacttcttttgagctttcaatgttgatgtaatttttgttctctgtgtaatttaggtaaactgcagtgtttaacataataatgttttaaagacttagttgtcagtattaaataatcctggcattatagggaaaaaacctcctagaagttagattatttgctactgtgagaatattgtcaccactggaagttactttagttcatttaattttaattttatattttgtgaatattttaagaactgtagagctgctttcaatatctagaaatttttaattgagtgtaaacacacctaactttaagaaaaagaaccgcttgtatgattttcaaaagaacatttagaattctatagagtcaaaactatagcgtaatgctgtgtttattaagccagggattgtgggacttcccccaggcaactaaacctgcaggatgaaaatgctatattttctttcatgcactgtcgatattactcagatttggggaaatgacatttttatactaaaacaaacaccaaaatattttagaataaattcttagaaagttttgagaggaatttttagagaggacatttcctccttcctgatttggatattccctcaaatccctcctcttactccatgctgaaggagaagtactctcagatgcattatgttaatggagagaaaaagcacagtattgtagagacaccaatattagctaatgtattttggagtgttttccattttacagtttatattccagcactcaaaactcagggtcaagttttaacaaaagaggtatgtagtcacagtaaatactaagatggcatttctatctcagagggccaaagtgaatcacaccagtttctgaaggtcctaaaaatagctcagatgtcctaatgaacatgcacctacatttaataggagtacaataaaactgttgtcagcttttgttttacagagaacgctagatattaagaattttgaaatggatcatttctacttgctgtgcattttaaccaataatctgatgaatatagaaaaaaatgatccaaaatatggatatgattggatgtatgtaacacatacatggagtatggaggaaattttctgaaaaatacatttagattagtttagtttgaaggagaggtgggctgatggctgagttgtatgttactaacttggccctgactggttgtgcaaccattgcttcatttctttgcaaaatgtagttaagatatactttattctaatgaaggccttttaaatttgtccactgcattcttggtatttcactacttcaagtcagtcagaacttcgtagaccgacctgaagtttctttttgaatacttgtttctttagcactttgaagatagaaaaaccactttttaagtactaagtcatcatttgccttgaaagtttcctctgcattgggtttgaagtagtttagttatgtctttttctctgtatgtaagtagtataatttgttactttcaaatacccgtactttgaatgtaggtttttttgttgttgttatctataaaaattgagggaaatggttatgcaaaaaaatattttgctttggaccatatttcttaagcataaaaaaaatgctcagttttgcttgcattccttgagaatgtatttatctgaagatcaaaacaaacaatccagatgtataagtactaggcagaagccaattttaaaatttccttgaataatccatgaaaggaataattcaaatacagataaacagagttggcagtatattatagtgataattttgtattttcacaaaaaaaaagttaaactcttcttttctttttattataatgaccagcttttggtatttcattgttaccaagttctatttttagaataaaattgttctccttct

SEQ ID NO: 21653 - DNA, 743 bp, Homo sapiens
  ENST00000532161
aggtttggaccagtcacccgctggccccggggccgcctgctgaggaaattgcctggtgcttcccctctcgctttttggatgcggcggtcgcaggccgggacgggtgcgcataacctgttgagttaccgcaagttggtttttacagcctttccctgaagttaatgtttgccgagcatctgcaaacatagagaattctgggcttccacacaactccagtgctaactcaacagagactctccaacatgtgccttctgaccatacaaatgaaacttccaacagtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaatcacaacaactatgcattctgaagcaaagaaaggatcaaaatttgatactgggagctttgttggtggtattgtattaacgctgggagttttatctattctttacattggatgcaaaatgtattactcaagaagaggcattcggtatcgaaccatagatgaacatgatgccatcatttaaggaaatccatggaccaaggatggaatacagattgatgctgccc

SEQ ID NO: 21654 - DNA, 568 bp, Homo sapiens
  ENST00000528969
tgtttcaatgaattaccgattagagaaactcatctgcaaacatagagaattctgggcttccacacaactccagtgctaactcaacagagactctccaacatgtgccttctgaccatacaaatgaaacttccaacagtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaatcacaacaactatgcattctgaagcaaagaaaggatcaaaatttgatactgggagctttgttggtggtattgtattaacgctgggagttttatctattctttacattggatgcaaaatgtattactcaagaagaggcattcggtatcgaaccatagatgaacatgatgccatcatttaaggaaatccatg

SEQ ID NO: 21655 - DNA, 549 bp, Homo sapiens
  ENST00000529492
ggccgcccatgaaagcgcagccatggcggcatctgcaaacatagagaattctgggcttccacacaactccagtgctaactcaacagagactctccaacatgtgccttctgaccatacaaatgaaacttccaacagtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaagtatgtattaaagctgaccttttttttcctatgctgcaagtagttaaatgccacatttaagtcattattctgtctggcaaaaataatatagaaactttatatgcctagatttcccttaattcctaattaaatgttcttaacacagaaaatcagagagctttaattacaatgt

SEQ ID NO: 21656 - DNA, 550 bp, Homo sapiens
  ENST00000525577
acatgtaagtgagattttcgctggtggagggtgtcaatgcctgaagggttgaagatcaggagcaatgactggattacagaatgaagaggacttactgaacaattcgcttccaaaagaaaagggagaagaagaaatccaagaagacatcagcactttcaccttttatgtcttctaggtttgacaggggtctgctattccaccctcaattcagcatctgcaaacatagagaattctgggcttccacacaactccagtgctaactcaacagagactctccaacatgtgccttctgaccatacaaatgaaacttccaacagtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcat

SEQ ID NO: 21657 - DNA, 568 bp, Homo sapiens
  ENST00000531103
aacgaataaagcactctgaaaagttgcttaattgggacatagaaatctcttacattttttccaaatctaaaggtgtactaatttaaaaattaaaaccctactgagaaggtgcagttaaataagaaaatcctattttatccctccattgtatgaaattaggggtgttggttgggtggtgcaagacctagagatgcctgtgagtagaatcggcctctcctgaaatggtccactccactcagaagagcagagtcctcagtggcagaaattggcccatctgtccccaattgtgtgggtaaatgaattttggcaaagctgttgcattcggtggctggtatatacatctgcaaacatagagaattctgggcttccacacaactccagtgctaactcaacagagactctccaacatgtgccttctgaccatacaaatgaaacttccaacagtactgtgaaaccaccaacttcagttgcctcagactccagtaatacaacggtcaccaccatgaaacctacagcggcatctaatacaacaacaccagggatggtctcaacaaatatgacttctacc

SEQ ID NO: 21658 - DNA, 467 bp, Homo sapiens
  ENST00000526676
agtcacccgctggccccggggccgcctgctgaggaaattgcctggtgcttcccctctcgctttttggatgcggcggtcgcaggccgggacgggtgcgcataacctgttgagttaccgcaagttggtttttacagcctttccctgaagttaatgtttgccgagcatctgcaaacatagagaattctgggcttccacacaactccagtgctaactcaacaggcagactcaacccaaacacttggtgaggcccttaccctgtgattttagtttgggacaaagccttgggcctctgagttcactaacatggaaagatgcaagaaccaggctgatgtcatcaatatcagtagtaaatcatcaagagactctccaacatgtgccttctgaccatacaaatgaaacttccaacagtactgtgaaaccaccaacttcagttgcctcagactccagtaatacaacggtcaccacca

SEQ ID NO: 21659 - DNA, 1786 bp, Homo sapiens
  ENST00000439858
gcttccccagtaggatccagtctgtggggctcatttgagggagaatgagcacggggcttttggaggctgcagcctagggccaagggatggaggctcacctgagtgcaggttaggcaggtgaagtgtctccccggaaaccaagctagagtgccccacctgctcggccctgccttctcggatcggatccagcacatccaggcttctcctcctcccgaggaaccagtggtgacagctgaggccatgtgagtaggatcctgaatgaggctttatctctggctgttcgtcccatcgtccaccgtggcaccagctccctcagccagccgggatgggaccagcgactgagagagccagaggcagagaggtgagggtgaccatatcctggactgtgagaggaatgggactctgggcctgtagctgccaagcaggtggcaggtgctccaggctgtgatctgaaccctctgacccctgacattgacctcctaccctgacccctgcctgaccaagccatgtctgaacaggaggctcaagccccagggggccgggggctgcccccggacatgctggcagagcaggtggagctgtggtggtcccagcagccgcggcgctcggcgctctgcttcgtcgtggccgtgggcctcgtggcaggctgtggcgcgggcggcgtggcactgctgtcaaccaccagcagccgctcaggtgaatggcggctagcaacgggcactgtgctctgtttgctggctctgctggttctggtgaaacagctgatgagctcggctgtgcaggacatgaactgcatccgccaggcccaccatgtggccctgctgcgcagtggtggaggggccgacgccctcgtggtgctgctcagtggcctcgtgctgctggtcaccggcctgaccctggccgggctggccgccgcccctgcccctgctcggccgctggccgccatgctgtctgtgggcattgctctggctgccttgggctcgcttttgctgctgggcctgctgctgtatcaagtgggtgtgagcggacactgcccctccatctgtatggccactccctccacccacagtggccatggcggccatggcagcatcttcagcatctcaggacagttgtctgctggccggcgtcacgagaccacatccagcattgccagcctcatctgacggagccagagccgtccttcttctcacagcggcctcagcgtccccagagccgagccagggtgtgagtgcatgtgaacgttgagtacacatgagtgcgtgtatgcccccaggctgggtcagctcttctgtggattgcatggcgtgtgattaaaagcccatgtgttcccacacatccacatcatgggaaggttaatgtgtgcctccttggaactgggtgttggtgtccatggaacttcctctctgtatctcaggtcagtaggcgcagaaacgcctcatgatgaagattcttgagccccatttccaagacccctcacatccaatcctgtcctgtaacatccatcaaggatttccataggggtgactggtgcccacccaagactgcaccagtgcctgctcattgaggagagtaactgctggccaggcagaaagaatatgggctctgcaatgagacagacctggaggggactctcccgttgagcactagcagctggaggagttgggagttcatggctatcatggttgtgttaatcgattgtggggatgaaatgtcattgtgtatggaaggcggggctcatggctgattggcaataaaatggcggctgccgttgtcattgtctcca

SEQ ID NO: 21660 - DNA, 1850 bp, Homo sapiens
  ENST00000432792
catttgagggagaatgagcacggggcttttggaggctgcagcctagggccaagggatggaggaatgcctcagcccagcagaaggagcagtgccacgtcagccaatcggctcaggccctgccctggaaacgacacctgttcatcctcctcccggcaggctcacctgagtgcaggttaggcaggtgaagtgtctccccggaaaccaagctagagtgccccacctgctcggccctgccttctcggatcggatccagcacatccaggcttctcctcctcccgaggaaccagtggtgacagctgaggccatgtgagtaggatcctgaatgaggctttatctctggctgttcgtcccatcgtccaccgtggcaccagctccctcagccagccgggatgggaccagcgactgagagagccagaggcagagaggtgagggtgaccatatcctggactgtgagaggaatgggactctgggcctgtagctgccaagcaggtggcaggtgctccaggctgtgatctgaaccctctgacccctgacattgacctcctaccctgacccctgcctgaccaagccatgtctgaacaggaggctcaagccccagggggccgggggctgcccccggacatgctggcagagcaggtggagctgtggtggtcccagcagccgcggcgctcggcgctctgcttcgtcgtggccgtgggcctcgtggcaggctgtggcgcgggcggcgtggcactgctgtcaaccaccagcagccgctcaggtgaatggcggctagcaacgggcactgtgctctgtttgctggctctgctggttctggtgaaacagctgatgagctcggctgtgcaggacatgaactgcatccgccaggcccaccatgtggccctgctgcgcagtggtggaggggccgacgccctcgtggtgctgctcagtggcctcgtgctgctggtcaccggcctgaccctggccgggctggccgccgcccctgcccctgctcggccgctggccgccatgctgtctgtgggcattgctctggctgccttgggctcgcttttgctgctgggcctgctgctgtatcaagtgggtgtgagcggacactgcccctccatctgtatggccactccctccacccacagtggccatggcggccatggcagcatcttcagcatctcaggacagttgtctgctggccggcgtcacgagaccacatccagcattgccagcctcatctgacggagccagagccgtccttcttctcacagcggcctcagcgtccccagagccgagccagggtgtgagtgcatgtgaacgttgagtacacatgagtgcgtgtatgcccccaggctgggtcagctcttctgtggattgcatggcgtgtgattaaaagcccatgtgttcccacacatccacatcatgggaaggttaatgtgtgcctccttggaactgggtgttggtgtccatggaacttcctctctgtatctcaggtcagtaggcgcagaaacgcctcatgatgaagattcttgagccccatttccaagacccctcacatccaatcctgtcctgtaacatccatcaaggatttccataggggtgactggtgcccacccaagactgcaccagtgcctgctcattgaggagagtaactgctggccaggcagaaagaatatgggctctgcaatgagacagacctggaggggactctcccgttgagcactagcagctggaggagttgggagttcatggctatcatggttgtgttaatcgattgtggggatgaaatgtcattgtgtatggaaggcggggctcatggctgattggcaataaaatggcggctgccgttgtcattgtctcca

SEQ ID NO: 21661 - DNA, 179 bp, Homo sapiens
  ENST00000442284
gggcttttggaggctgcagcctagggccaagggatggaggctcacctgagtgcaggttaggcaggtgaagtgtctccccggaaaccaagctagagtgccccacctgctcggccctgccttctcggatcggatccagcacatccaggcttctcgtgagttcccccattgtcccccaacgc

SEQ ID NO: 21662 - DNA, 567 bp, Homo sapiens
  ENST00000456751
ggaatgctgggactgactccacggccacgcccacctcccccacttccttgagagcatcggcaccagcccccgcccacctcgggggtaggggtcagcctctgcagaggagtctccgggaggacagatacctcgtcaggatgtaacctgtgcacggccacatagtaatattcccagaatgacccaggacctacgtcttctgccctgtcctgccttggagggctcctcccgaggaaccagtggtgacagctgaggccatgtgagtaggatcctgaatgaggctttatctctggctgttcgtcccatcgtccaccgtggcaccagctccctcagccagccgggatgggaccagcgactgagagagccagaggcagagaggtgagggtgaccatatcctggactgtgagaggaatgggactctgggcctgtagctgccaagcaggtggcaggtgctccaggctgtgatctgaaccctctgacccctgacattgacctcctaccctgacccctgcctgaccaagccatgtctgaacaggaggctcaagccccagggggccgggggctgccccc

SEQ ID NO: 21663 - DNA, 2881 bp, Homo sapiens
  ENST00000416379
ccgcaatggcccaggcagtgtggtcgcgcctcggccgcatcctctggcttgcctgcctcctgccctgggccccggcaggggtggccgcaggcctgtatgaactcaatctcaccaccgatagccctgccaccacgggagcggtggtgaccatctcggccagcctggtggccaaggacaacggcagcctggccctgcccgctgacgcccacctctaccgcttccactggatccacaccccgctggtgcttactggcaagatggagaagggtctcagctccaccatccgtgtggtcggccacgtgcccggggaattcccggtctctgtctgggtcactgccgctgactgctggatgtgccagcctgtggccaggggctttgtggtcctccccatcacagagttcctcgtgggggaccttgttgtcacccagaacacttccctaccctggcccagctcctatctcactaagaccgtcctgaaagtctccttcctcctccacgacccgagcaacttcctcaagaccgccttgtttctctacagctgggacttcggggacgggacccagatggtgactgaagactccgtggtctattataactattccatcatcgggaccttcaccgtgaagctcaaagtggtggcggagtgggaagaggtggagccggatgccacgagggctgtgaagcagaagaccggggacttctccgcctcgctgaagctgcaggaaacccttcgaggcatccaagtgttggggcccaccctaattcagaccttccaaaagatgaccgtgaccttgaacttcctggggagccctcctctgactgtgtgctggcgtctcaagcctgagtgcctcccgctggaggaaggggagtgccaccctgtgtccgtggccagcacagcgtacaacctgacccacaccttcagggaccctggggactactgcttcagcatccgggccgagaatatcatcagcaagacacatcagtaccacaagatccaggtgtggccctccagaatccagccggctgtctttgctttcccatgtgctacacttatcactgtgatgttggccttcatcatgtacatgaccctgcggaatgccactcagcaaaaggacatggtggaggtggctgattttgacttttcccccatgtctgacaagaacccggagccaccctctggggtcaggtgctgctgccagatgtgctgtgggcctttcttgctggagactccatctgagtacctggaaattgttcgtgagaaccacgggctgctcccgcccctctataagtctgtcaaaacttacaccgtgtgagcactccccctccccaccccatctcagtgttaactgactgctgacttggagtttccagcagggtggtgtgcaccactgaccaggaggggttcatttgcgtggggctgttggcctggatcatccatccatctgtacagttcagccactgccacaagcccctccctctctgtcacccctgaccccagccattcacccatctgtacagtccagccactgacataagccccactcggttaccacccccttgaccccctacctttgaagaggcttcgtgcaggactttgatgcttggggtgttccgtgttgactcccaggtgggcctggctgcccactgcccattcctctcatattggcacatctgctgtccattgggggttctcagtttcctcccccagacagccctacctgtgccagagagctagaaagaaggtcataaagggttaaaaatccataactaaaggttgtacacatagatgggcacactcacagagagaagtgtgcatgtacacacaccacacacacacacacacacacacacacacacacacacagaaatataaacacatgcgtcacatgggcatttcagatgatcagctctgtatctggttaagtcggttgctgggatgcaccctgcactagagctgaaaggaaatttgacctccaagcagccctgacaggttctgggcccgggccctccctttgtgctttgtctctgcagttcttgcgccctttataaggccatcctagtccctgctggctggcagggggctggatggggggcaggactaatactgagtgattgcagagtgctttataaatatcaccttattttatcgaaacccatctgtgaaactttcactgaggaaaaggccttgcagcggtagaagaggttgagtcaaggccgggcgcggtggctcacgcctgtaatcccagcactttgggaggccgaggcgggtggatcacgagatcaggagatcgagaccaccctggctaacacggtgaaaccccgtctctactaaaaaaatacaaaaagttagccgggcgtggtggtgggtgcctgtagtcccagctactcgggaggctgaggcaggagaatggtgcgaacccgggaggcggagcttgcagtgagcccagatggcgccactgcactccagcctgagtgacagagcgagactctgtctccaaaaaaaaaaaaagaagaggttgagtcagcagggacttgggttccctgtgtgtgaggggggcattcttgcctgccagctgctcccgaggtggccttgagaaggaagaagcaggatgacagagcctgagcagcggaaccagcctgcaccctcccttctggcccagcgacctgggctgtggctgagacaataatgaggccagaagtagccggagcctgtcaggaagggcaggggaggactgtggggtctgggctctgtcgctgtaaccatctgctcccaggctgtgtgcagaaaatggcatttacactattgtgcagctcattctcatgaaatactgccattgttgctaaataaagcttgtgtgctctgaatatagccaagcataga

SEQ ID NO: 21664 - DNA, 3015 bp, Homo sapiens
  ENST00000339375
ggcggcggcggcgcgcagcgacagagcgtcccccggcgaggacgagcgagcacggcgcccgcacctccccgcaccgcccgcgctgcgcgcccggaggagcgaccgccgcagttctcgagctccagctgcattccctccgcgtccgccccacgcttctcccgctccgggccccgcaatggcccaggcagtgtggtcgcgcctcggccgcatcctctggcttgcctgcctcctgccctgggccccggcaggggtggccgcaggcctgtatgaactcaatctcaccaccgatagccctgccaccacgggagcggtggtgaccatctcggccagcctggtggccaaggacaacggcagcctggccctgcccgctgacgcccacctctaccgcttccactggatccacaccccgctggtgcttactggcaagatggagaagggtctcagctccaccatccgtgtggtcggccacgtgcccggggaattcccggtctctgtctgggtcactgccgctgactgctggatgtgccagcctgtggccaggggctttgtggtcctccccatcacagagttcctcgtgggggaccttgttgtcacccagaacacttccctaccctggcccagctcctatctcactaagaccgtcctgaaagtctccttcctcctccacgacccgagcaacttcctcaagaccgccttgtttctctacagctgggacttcggggacgggacccagatggtgactgaagactccgtggtctattataactattccatcatcgggaccttcaccgtgaagctcaaagtggtggcggagtgggaagaggtggagccggatgccacgagggctgtgaagcagaagaccggggacttctccgcctcgctgaagctgcaggaaacccttcgaggcatccaagtgttggggcccaccctaattcagaccttccaaaagatgaccgtgaccttgaacttcctggggagccctcctctgactgtgtgctggcgtctcaagcctgagtgcctcccgctggaggaaggggagtgccaccctgtgtccgtggccagcacagcgtacaacctgacccacaccttcagggaccctggggactactgcttcagcatccgggccgagaatatcatcagcaagacacatcagtaccacaagatccaggtgtggccctccagaatccagccggctgtctttgctttcccatgtgctacacttatcactgtgatgttggccttcatcatgtacatgaccctgcggaatgccactcagcaaaaggacatggtggagaacccggagccaccctctggggtcaggtgctgctgccagatgtgctgtgggcctttcttgctggagactccatctgagtacctggaaattgttcgtgagaaccacgggctgctcccgcccctctataagtctgtcaaaacttacaccgtgtgagcactccccctccccaccccatctcagtgttaactgactgctgacttggagtttccagcagggtggtgtgcaccactgaccaggaggggttcatttgcgtggggctgttggcctggatcatccatccatctgtacagttcagccactgccacaagcccctccctctctgtcacccctgaccccagccattcacccatctgtacagtccagccactgacataagccccactcggttaccacccccttgaccccctacctttgaagaggcttcgtgcaggactttgatgcttggggtgttccgtgttgactcccaggtgggcctggctgcccactgcccattcctctcatattggcacatctgctgtccattgggggttctcagtttcctcccccagacagccctacctgtgccagagagctagaaagaaggtcataaagggttaaaaatccataactaaaggttgtacacatagatgggcacactcacagagagaagtgtgcatgtacacacaccacacacacacacacacacacacacacacacacacacagaaatataaacacatgcgtcacatgggcatttcagatgatcagctctgtatctggttaagtcggttgctgggatgcaccctgcactagagctgaaaggaaatttgacctccaagcagccctgacaggttctgggcccgggccctccctttgtgctttgtctctgcagttcttgcgccctttataaggccatcctagtccctgctggctggcagggggctggatggggggcaggactaatactgagtgattgcagagtgctttataaatatcaccttattttatcgaaacccatctgtgaaactttcactgaggaaaaggccttgcagcggtagaagaggttgagtcaaggccgggcgcggtggctcacgcctgtaatcccagcactttgggaggccgaggcgggtggatcacgagatcaggagatcgagaccaccctggctaacacggtgaaaccccgtctctactaaaaaaatacaaaaagttagccgggcgtggtggtgggtgcctgtagtcccagctactcgggaggctgaggcaggagaatggtgcgaacccgggaggcggagcttgcagtgagcccagatggcgccactgcactccagcctgagtgacagagcgagactctgtctccaaaaaaaaaaaaagaagaggttgagtcagcagggacttgggttccctgtgtgtgaggggggcattcttgcctgccagctgctcccgaggtggccttgagaaggaagaagcaggatgacagagcctgagcagcggaaccagcctgcaccctcccttctggcccagcgacctgggctgtggctgagacaataatgaggccagaagtagccggagcctgtcaggaagggcaggggaggactgtggggtctgggctctgtcgctgtaaccatctgctcccaggctgtgtgcagaaaatggcatttacactattgtgcagctcattctcatgaaatactgccattgttgctaaataaagcttgtgtgctctgaatatagccaagcataga

SEQ ID NO: 21665 - DNA, 3891 bp, Homo sapiens
  ENST00000450876
ttttaaatttttttttttgtagagaatgggtgtcgctgtgttgttcaggctgatctaaaactcctgggctcaagtgaccctctggcttcaaagcgctgtgattacaggtgtgagctgactgggcccggcctcaaatgcctttataatttaagaaatggctctgaaaaaaaaggaaatacgtgatgtgggccaaagcagcgaacgtgtgaggtgggcctgaggaaaggtcggagctggagtcccccacagggacaggtgatgttgctttgaagtgaatgagatgcgtctgaaaaaaataatctcagagttgcctgggcactagaaggggcttcccttgccccctcgattcctgcttctactccccgggctggccctgccctggaaaccacacgagggtggcccacgcatccgtcagatgtctggggaccatgtacctgctaagggaggggaggacgaggcagggacatggggatgtatcagggtcagtcatcgtgccacaacccccagcccccagggaacacgggatgggcagcatttttactttaaaatgttgcctcatctagaggggttttccaccctgttggtgctggctttggggagatatgattttatttgatttatgtatttatttatttgagatggaatttcgctctttttgcccaggctggagtgcagtggcgcaatctcggctcacggcaaccaccatctcccaggttcaagtaattctccggcctcagcctcccgagtagctgagattacaggcgttcgccaccacacccggctaattttgtattgttagtagagacggggtttcgccatgttggccaggccggtctcaaacgcctgacctcaggtgatccacccacctcggcctcccaaagtgctggaattacaggcatgagccaccgtgcctgaccgagatgcaattttagagcccaggaggccaggctgctatttcttccaggagtgatttcccaaaatggacctggagctgacaggttcctggggggacttgtggggggaccttgtgcccactcggtcgtgcatctactgtccccacatccccatcgccagaaggccagcacccacctttctgccacattttgggaaccataaaaggacccagattggagacttgttgagggacaggcctgtatgaactcaatctcaccaccgatagccctgccaccacgggagcggtggtgaccatctcggccagcctggtggccaaggacaacggcagcctggccctgcccgctgacgcccacctctaccgcttccactggatccacaccccgctggtgcttactggcaagatggagaagggtctcagctccaccatccgtgtggtcggccacgtgcccggggaattcccggtctctgtctgggtcactgccgctgactgctggatgtgccagcctgtggccaggggctttgtggtcctccccatcacagagttcctcgtgggggaccttgttgtcacccagaacacttccctaccctggcccagctcctatctcactaagaccgtcctgaaagtctccttcctcctccacgacccgagcaacttcctcaagaccgccttgtttctctacagctgggacttcggggacgggacccagatggtgactgaagactccgtggtctattataactattccatcatcgggaccttcaccgtgaagctcaaagtggtggcggagtgggaagaggtggagccggatgccacgagggctgtgaagcagaagaccggggacttctccgcctcgctgaagctgcaggaaacccttcgaggcatccaagtgttggggcccaccctaattcagaccttccaaaagatgaccgtgaccttgaacttcctggggagccctcctctgactgtgtgctggcgtctcaagcctgagtgcctcccgctggaggaaggggagtgccaccctgtgtccgtggccagcacagcgtacaacctgacccacaccttcagggaccctggggactactgcttcagcatccgggccgagaatatcatcagcaagacacatcagtaccacaagatccaggtgtggccctccagaatccagccggctgtctttgctttcccatgtgctacacttatcactgtgatgttggccttcatcatgtacatgaccctgcggaatgccactcagcaaaaggacatggtggagaacccggagccaccctctggggtcaggtgctgctgccagatgtgctgtgggcctttcttgctggagactccatctgagtacctggaaattgttcgtgagaaccacgggctgctcccgcccctctataagtctgtcaaaacttacaccgtgtgagcactccccctccccaccccatctcagtgttaactgactgctgacttggagtttccagcagggtggtgtgcaccactgaccaggaggggttcatttgcgtggggctgttggcctggatcatccatccatctgtacagttcagccactgccacaagcccctccctctctgtcacccctgaccccagccattcacccatctgtacagtccagccactgacataagccccactcggttaccacccccttgaccccctacctttgaagaggcttcgtgcaggactttgatgcttggggtgttccgtgttgactcccaggtgggcctggctgcccactgcccattcctctcatattggcacatctgctgtccattgggggttctcagtttcctcccccagacagccctacctgtgccagagagctagaaagaaggtcataaagggttaaaaatccataactaaaggttgtacacatagatgggcacactcacagagagaagtgtgcatgtacacacaccacacacacacacacacacacacacacacacacacacagaaatataaacacatgcgtcacatgggcatttcagatgatcagctctgtatctggttaagtcggttgctgggatgcaccctgcactagagctgaaaggaaatttgacctccaagcagccctgacaggttctgggcccgggccctccctttgtgctttgtctctgcagttcttgcgccctttataaggccatcctagtccctgctggctggcagggggctggatggggggcaggactaatactgagtgattgcagagtgctttataaatatcaccttattttatcgaaacccatctgtgaaactttcactgaggaaaaggccttgcagcggtagaagaggttgagtcaaggccgggcgcggtggctcacgcctgtaatcccagcactttgggaggccgaggcgggtggatcacgagatcaggagatcgagaccaccctggctaacacggtgaaaccccgtctctactaaaaaaatacaaaaagttagccgggcgtggtggtgggtgcctgtagtcccagctactcgggaggctgaggcaggagaatggtgcgaacccgggaggcggagcttgcagtgagcccagatggcgccactgcactccagcctgagtgacagagcgagactctgtctccaaaaaaaaaaaaagaagaggttgagtcagcagggacttgggttccctgtgtgtgaggggggcattcttgcctgccagctgctcccgaggtggccttgagaaggaagaagcaggatgacagagcctgagcagcggaaccagcctgcaccctcccttctggcccagcgacctgggctgtggctgagacaataatgaggccagaagtagccggagcctgtcaggaagggcaggggaggactgtggggtctgggctctgtcgctgtaaccatctgctcccaggctgtgtgcagaaaatggcatttacactattgtgcagctcattctcatgaaatactgccattgttgctaaataaagcttgtgtgctctgaatat

SEQ ID NO: 21666 - DNA, 867 bp, Homo sapiens
  ENST00000474857
cccactgcccattcctctcatattggcacatctgctgtccattgggggttctcagtttcctcccccagacagccctacctgtgccagagagctagaaagaaggtcataaagggttaaaaatccataactaaaggttgtacacatagatgggcacactcacagagagaagtgtgcatgtacacacaccacacacacacacacacacacacacacacacacacacagaaatataaacacatgcgtcacatgggcatttcagatgatcagctctgtatctggttaagtcggttgctgggatgcaccctgcactagagctgaaaggaaatttgacctccaagcagccctgacaggttctgggcccgggccctccctttgtgctttgtctctgcagttcttgcgccctttataaggccatcctagtccctgctggctggcagggggctggatggggggcaggactaatactgagtgattgcagagtgctttataaatatcaccttattttatcgaaacccatctgtgaaactttcactgaggaaaaggccttgcagcggtagaagaggttgagtcagcagggacttgggttccctgtgtgtgaggggggcattcttgcctgccagctgctcccgaggtggccttgagaaggaagaagcaggatgacagagcctgagcagcggaaccagcctgcaccctcccttctggcccagcgacctgggctgtggctgagacaataatgaggccagaagtagccggagcctgtcaggaagggcaggggaggactgtggggtctgggctctgtcgctgtaaccatctgctcccaggctgtgtgcagaaaatggcatttacactattgtgcagctcattctc

SEQ ID NO: 21667 - DNA, 2261 bp, Homo sapiens
  ENST00000345589
gcgctgcgcgcccggaggagcgaccgccgcagttctcgagctccagctgcattccctccgcgtccgccccacgcttctcccgctccgggccccgcaatggcccaggcagtgtggtcgcgcctcggccgcatcctctggcttgcctgcctcctgccctgggccccggcaggggtggccgcagagttcctcgtgggggaccttgttgtcacccagaacacttccctaccctggcccagctcctatctcactaagaccgtcctgaaagtctccttcctcctccacgacccgagcaacttcctcaagaccgccttgtttctctacagctgggacttcggggacgggacccagatggtgactgaagactccgtggtctattataactattccatcatcgggaccttcaccgtgaagctcaaagtggtggcggagtgggaagaggtggagccggatgccacgagggctgtgaagcagaagaccggggacttctccgcctcgctgaagctgcaggaaacccttcgaggcatccaagtgttggggcccaccctaattcagaccttccaaaagatgaccgtgaccttgaacttcctggggagccctcctctgactgtgtgctggcgtctcaagcctgagtgcctcccgctggaggaaggggagtgccaccctgtgtccgtggccagcacagcgtacaacctgacccacaccttcagggaccctggggactactgcttcagcatccgggccgagaatatcatcagcaagacacatcagtaccacaagatccaggtgtggccctccagaatccagccggctgtctttgctttcccatgtgctacacttatcactgtgatgttggccttcatcatgtacatgaccctgcggaatgccactcagcaaaaggacatggtggagaacccggagccaccctctggggtcaggtgctgctgccagatgtgctgtgggcctttcttgctggagactccatctgagtacctggaaattgttcgtgagaaccacgggctgctcccgcccctctataagtctgtcaaaacttacaccgtgtgagcactccccctccccaccccatctcagtgttaactgactgctgacttggagtttccagcagggtggtgtgcaccactgaccaggaggggttcatttgcgtggggctgttggcctggatcatccatccatctgtacagttcagccactgccacaagcccctccctctctgtcacccctgaccccagccattcacccatctgtacagtccagccactgacataagccccactcggttaccacccccttgaccccctacctttgaagaggcttcgtgcaggactttgatgcttggggtgttccgtgttgactcccaggtgggcctggctgcccactgcccattcctctcatattggcacatctgctgtccattgggggttctcagtttcctcccccagacagccctacctgtgccagagagctagaaagaaggtcataaagggttaaaaatccataactaaaggttgtacacatagatgggcacactcacagagagaagtgtgcatgtacacacaccacacacacacacacacacacacacacacacacacacagaaatataaacacatgcgtcacatgggcatttcagatgatcagctctgtatctggttaagtcggttgctgggatgcaccctgcactagagctgaaaggaaatttgacctccaagcagccctgacaggttctgggcccgggccctccctttgtgctttgtctctgcagttcttgcgccctttataaggccatcctagtccctgctggctggcagggggctggatggggggcaggactaatactgagtgattgcagagtgctttataaatatcaccttattttatcgaaacccatctgtgaaactttcactgaggaaaaggccttgcagcggtagaagaggttgagtcaaggccgggcgcggtggctcacgcctgtaatcccagcactttgggaggccgaggcgggtggatcacgagatcaggagatcgagaccaccctggctaacacggtgaaaccccgtctctactaaaaaaatacaaaaagttagccgggcgtggtggtgggtgcctgtagtcccagctactcgggaggctgaggcaggagaatggtgcgaacccgggaggcggagcttgcagtgagcccagatggcgccactgcactccagcctgagtgacagagcgagactctgtctccaaaaaaaaaaaaagaa

SEQ ID NO: 21668 - DNA, 589 bp, Homo sapiens
  ENST00000461092
agagcgtcccccggcgaggacgagcgagcacggcgcccgcacctccccgcaccgcccgcgctgcgcgcccggaggagcgaccgccgcagttctcgagctccagctgcattccctccgcgtccgccccacgcttctcccgctccgggccccgcaatggcccaggcagtgtggtcgcgcctcggccgcatcctctggcttgcctgcctcctgccctgggccccggcaggggtggccgcaggacccagatggtgactgaagactccgtggtctattataactattccatcatcgggaccttcaccgtgaagctcaaagtggtggcggagtgggaagaggtggagccggatgccacgagggctgtgaagcagaagaccggggacttctccgcctcgctgaagctgcaggaaacccttcgaggcatccaagtgttggggcccaccctaattcagaccttccaaaagatgaccgtgaccttgaacttcctggggagccctcctctgactgtgtgctggcgtctcaagcctgagtgcctcccgctggaggaaggggagtgccaccctgtgtccgtggccagcacagcgtacaacct

SEQ ID NO: 21669 - DNA, 547 bp, Homo sapiens
  ENST00000486839
agatgcgaatttagagcccaggaggccaggctgccatttcctctctggtggtgatttccaaaatggacccggagctgacaggttcctggggcctgtatgaactcaatctcaccaccgatagccctgccaccacgggagcggtggtgaccatctcggccagcctggtggccaaggacaacggcagcctggccctgcccgctgacgcccacctctaccgcttccactggatccacaccccgctggtgcttactggcaagatggagaagggtctcagctccaccatccgtgtggtcggccacgtgcccggggaattcccggtctctgtctgggtcactgccgctgactgctggatgtgccagcctgtggccaggggctttgtggtcctccccatcacagagttcctcgtgggggaccttgttgtcacccagaacacttccctaccctggcccagctcctatctcactaagaccgtcctgaaagtctccttcctcctccacgacccgagcaacttcctcaagaccgccttgtttctctacagctgggactt

SEQ ID NO: 21670 - DNA, 679 bp, Homo sapiens
  ENST00000445790
acaaaaattagccaggcctggtggcgggcacctgtaatcccatcttactagggaggctgaggcaggagaatcgcttgaacccgggaggcggaggttgcagtgagccgagatcgcgccattctgggacagagcgagactctgtctcaagattaaaaaaaaaaaaaaaagaaaagaggaagcagcagcagcagcagcagcaagaggaatttcgaggcctttcgcccaacgcctggcgcaccttaagctctcaacagttcttgaatgaggagtagcatctcggagccacgagcgtgcagagagaaggcacctggaggagagccccaagggacctgcaggcggcttgcagcgcagcgcacgcccctggggacgctgagcctgtatgaactcaatctcaccaccgatagccctgccaccacgggagcggtggtgaccatctcggccagcctggtggccaaggacaacggcagcctggccctgcccgctgacgcccacctctaccgcttccactggatccacaccccgctggtgcttactggcaagatggagaagggtctcagctccaccatccgtgtggtcggccacgtgcccggggaattcccggtctctgtctgggtcactgccgctgactgctggatgtgccagcctgtggccaggggctttgtggtcctccccatcacag

SEQ ID NO: 21671 - DNA, 558 bp, Homo sapiens
  ENST00000418253
ctgctggcgctgactgcgctccagtgcccagtgacagagagtcgagggattgtggatagcctgcagaagttttcctcgctccctgcttacctccccacgaacttgcacatctccaatgcagaggagtcctttttccttaaagaagccaaccaagacctcacaaggaactccagtctgcaggcccgggtggagccattcttcatctaccgagccaggacaccccctattatcaatgccagctatggcccattttcagtggagaagataatcccccaggagctcctgttgacatctacagcctttggaaacatggacaaatttcccttcaactggaaattgaaatcccacatccttgacagctccatctactccaacagacccaaagtgcagaccttgttttatgtcactggcatgggctgggatgacagtgaccttacggaagatctaccctgtgtcaagatgtttgctttccctgaggccagggaagtggcagccagctgtcggctgcaaggggccccagggctgtgtgtggctgagctggagctgctgcccgagtgg

SEQ ID NO: 21672 - DNA, 553 bp, Homo sapiens
  ENST00000535330
aattaggaactggggggtgttgaataaagctgaagatttggtgccctcgcctcagctccagactctacgggaaatgtttggtgcagcatccagaatggacaccactgctgtctgcaccgggggagcaccctctcccctcccatcatagctaattgatgtccaagtcctaccagaatctcttcatttcctctccatcctggtggccctttctgcagtagaggctgcgtgacagagagtcgagggattgtggatagcctgcagaagttttcctcgctccctgcttacctccccacgaacttgcacatctccaatgcagaggagtcctttttccttaaagaagccaaccaagacctcacaaggaactccagtctgcaggcccgggtggagccattcttcatctaccgagccaggacaccccctattatcaatgccagctatggcccattttcagtggagaagataatcccccaggagctcctgttgacatctacagcctttggaaacatggacaaatttcccttcaactggaaattgaaatcccacatccttgaca

SEQ ID NO: 21673 - DNA, 10906 bp, Homo sapiens
  ENST00000299308
tacgggaaatgtttggtgcagcatccagaatggacaccactgctgtctgcaccgggggagtgacagagagtcgagggattgtggatagcctgcagaagttttcctcgctccctgcttacctccccacgaacttgcacatctccaatgcagaggagtcctttttccttaaagaagccaaccaagacctcacaaggaactccagtctgcaggcccgggtggagccattcttcatctaccgagccaggacaccccctattatcaatgccagctatggcccattttcagtggagaagataatcccccaggagctcctgttgacatctacagcctttggaaacatggacaaatttcccttcaactggaaattgaaatcccacatccttgacagctccatctactccaacagacccaaagtgcagaccttgttttatgtcactggcatgggctgggatgacagtgaccttacggaagatctaccctgtgtcaagatgtttgctttccctgaggccagggaagtggcagccagctgtcggctgcaaggggccccagggctgtgtgtggctgagctggagctgctgcccgagtggttcagctcaggcctggacctggaaccagaggaggagatcccagccctgctcgggggcaccacgatggagctcttcttcacgctctacccagctgacaaggctggccagtgtcctctggaggaggaaggcaagtgggagaacaatatccactcgggcctggagagcccccagcaagcgtttccagcccgagagaggattgggagtgtggtggtctacccaacccaagatgatctgaagtggtccctggtgagcttggacgagaatgtggtcatctcggtacctctgaatctagtccgggaaggggacacggccacctttttggtctctctgaccagtagctctgtggcagaccagttcactcttagaattaaggcggcagcaggtgtgaagataacggcagtgagagtcagcagtgaggaccaatgggcagtccaggaggaaattgataatggcagcactcagacgtcggccaccctcacctgcatgggccatcgcccggacacgcagagcagggtaaatggatccttctatgagatcttgcaagtggactttggaattgataatagcagtgacctggctggggcccagcagattacctggcaggtggagtacccgattgaggactccatgagtgagctggtcgtctccgagatcttcgtcagccagacaaccttcgtgggcatcgtccctcttgccatggacaccgaggttttgaacactgccattctcactggaaagcctgtttcagttcctgtcaaagtcgtgggggtccaggaggatggttctgtggtcgatgtgtctgagtctgtggaatgcaagtctgccgatgaagatgtcattaaggtttccaacaactgtgattccatttttgtgaatgggaaggaaatgaagagcaaagtggacacgattgtgaacttcacccaccagcacttcacctcccagttcgaggtcactgtctgggcacccaggctccccctgcagattgagatctcagacaccgagctgagccagatcaagggctggaggatcccggttgctgccaacagaaggcctacccgggaaagcgatgacgaggacgatgaggagaagaagggacgaggctgctccctgcagtaccagcacgccacagtgcgtgtcctcacccagtttgtggccgagtcacctgacttagggcagctgacctacatgctgggccccgactggcagtttgacatcactgaccttgtgaccgagttcatgaaggtggaggagccgaaaatcgctcagttacaggacggcaggaccctggctggtcgggagccgggaataaccacggtgcaggtcctctcgccgttgtctgactccatcctggctgagaagacggtgattgtcctggatgaccgagtcaccatcgcggagctgggagtgcagctcgtagctggcatgtctctctccctgcagccacaccgagcagacaaaagggccatcgtctccacagctgctgccctggatgttcttcagtccccacagcaggaagcaatagtaagttcttggattttgttcagtgatggttcggtgacacctttagacatttacgatcctaaggattattctgttactgtctcatcattggatgaaatggtggtgtctgtccaggcaaaccttgagtccaaatggccaattgtggttgcagagggtgaaggacaagggcctttgattaagttagaaatgatgataagtgaaccttgtcagaagaccaagaggaagagtgttcttgccgtgggtaaaggaaatgtcaaggtcaaattcgaaccaagtagtgatgagcaccaaggaggcagcaatgatattgagggcataaatcgggaatataaagaccacctcagtaattccatagagcgcgaaggaaaccaggagagagcagtccaggaatggttccaccgtggcacacctgttggccaagaggaaagtaccaacaaaagcacaaccccccagtctcccatggaagggaagaataagttactcaaaagtggtggtccagatgcctttacaagcttccccactcaagggaagtcaccggaccccaataatcctagtgacctcacagtgacctcaagggggctaacggacttggagattggcatgtatgccttgctctgcgtcttctgtctggccattctggtcttcttgatcaactgcgtggcgtttgcctggaaatacagacacaaaaggtttgctgtgagtgagcagggcaacatcccccattcccacgactgggtctggcttgggaatgaagtggaacttttggagaaccctgttgacattacactcccatcagaggagtgcacaaccatgatagacaggggcctgcagttcgaggagaggaacttccttctgaatggcagttcccagaagacttttcatagtcaactactcagaccctctgactatgtctatgagaaagaaattaaaaatgaacctatgaattcttcgggcccaaagaggaagagagtcaagttcacttcctacaccaccatcctcccagaggacggcggcccatacaccaactccatcctgtttgacagcgatgataacatcaagtgggtctgccaagatatggggctgggggattcacaggactttagagactatatggaaagtctgcaagaccagatgtaaactcctttcttatgtttgtattcacctttatgccttctgttttttgaatgctggagcagtgagtttgatcagcaataggggatgatttaacaaagtttgatttgtggaggtctggtgggattcatttctaagcaggtaaaagaggtttggagagctatagaagctgggttttaagtttggaaatgcctctaaaacagccacatgtggggactggagaaattctaagacaacagttttatggactgcctggtacgagctcagtgcaaatgtattaaacctgaccccacagacattgttagtcatctcgtgacaaatggccatgtggaattagaaaagatttgggtgttgatttttctatttctagaccttttaaagcacagtggacacttattgccccttggcctgagtttagacatacatgaaagatgactgaatgtagctatcctgatttgtcatgagcgctgctcattatttttatatacatttgcacctgcacctgttcctttgacctctggaattctttttgaaacatgaagagaagaaatttcagtcttttccttgagctctgtttgatttacacatgagttttcttccctgggatttgccatgccatgttatttcctgggtctccatgcaggatgtcaggtttttccagttttctgcacttcatcatctagggatggtatccaagaagcttattctcactttgttttttccttccttttgttgttgaactttcttgtataacactgggacaaagggttttacttaaaatgttaatatacagtgagggagggccatctctttactgttttctatgtgaagtttcaaacatttggaaaaaagttgtcaatcacaaacatttatttttattctctgcttgttgaaaactcatggggaactcctggagtgcatttctgagggtaaaaaggccccaacatagctgtatttatacaagtgctttgtggccaacacaatttactatccaaactgaagtcttaaagtagaattgacctacacagaaaggaaattgcctaggcaatagatgcagattacactttccattttaccagaacaaaagtttttttttttttaaataagtagaatgacagttcaagttagcaatatatagaaatccatccatacaatgaccaaaataaataaataaataaaactcaatcatgactttggcagagataaaacattgacaagggtgtgcatttgtggagagaagcagtgggtttccccccaaaatccatacaaataaatgactattccagaactcaagaagcagctattatagaaaaaaaaattaaaaaccacagctattgaaaaattaaaacggcaagagaaaaaaagaaacaactcctgcataatgtttaaataaaaatgttattttaatagcatcatgaatggtcttaaggcaaaaatttcagattagcaaaatgtgatgacatatttattaagattgtattattggaaatgtagacactggactagtatgcctcattatgagctttactgagccatttgcatctctaagaaatatgattttaaaggcccaaagtaggaaggatctgcagggggtcacctgaagcagtgccctgactccaaatggctgataactgagctaatccaaggagaggcgttcagttgttctcttattatagatttccttgggtgggaacatgacaaccccgcctcctctagccatgacgtggcagccaaaaagttcttcctgtatctctggcccacaggactgtagtgtgtttgggaacagtgctgaaattgcaagtgatgtaggcctgacctccagagcccagcgttcagttagttgtataaaatggggcttaggaaccgaagctgatgaagttccaaaagtagttcagtttgatgggataaggaagcaaggagagccaggcattagctgcaaaaggagcttgcagagagatggctgacactttatgggaagattcctcagtcagccaaaagcttttcaaagagtttggtgcagaggtagctcagagccaaccatccaggaccgaagaaagctcatgtgctgattgacacatagctatccaggtgagtcggctccttctatgaggcttttcaatcgtctctccctttggatctctggcattccagaaagactgggaattcatttctgaaaatgatgaacctccgctgaaacggggaggaaatctcttacacacatacagcagggtcctgcccactggtaaagtgagacgttgggtagggggtgtaactggggaggaggtgaaggaaattatccctgccatggggagtgttattcaggaacataaaaattagagcattccctctgatggcagtgcttgacggggtgcagggaacaaactggggagcgttcaaacatgccagtggtttctcagcagggctggaaactggccacagtcctgaagatgcttcttgtgacaacttagagtcactgggagtcacacagctcctgtgtagccgcctttgctcctctgtgttaaaacccagtcagttcaaaataacaatcaaatggaaggccatgggggaagggttccttccaccatataacccacacccagatgtatataaacgcatatacatacatatacccgtgtgtgtgtgtgtgtgtgtgtgtgtgtgtgtgaatactgaagagccagacaacaaactatttagtaagaatcaacagtgactgtcaattgttctcagatttggcatggatactatttctcatgaaataatgtcattaaagtatttcctcctctaaatatttcctgaagatcataaaccatgggttatagcaccttgttttccagctagtcaatatacaactattaggtgctgtgccccaaaatatctaaaatgggggtaaagatataaactattaagccatgaaatctaattttctggggaccatgcatttgcctggattttccaggattttatggctgatagacccaaattattagtcttgataaacaacctgaaccaaacatttataaagtcccttcctctcccatgggaatggaatgctcagactcctgctgagggagacaccagcaagcctcttgagaaggcaccagacagtgaactctgtggtcacatgaagggaggttcagatgctagacgaccagcgtatgacctggaaccattgaggattgcaaccgctgcctccagggtccagatgtgctgcagtagagggcagagcacaggaatcaagaagcagctgccacaccaaagaactgatgcttaaacacacaggtgtgttgcatttgagagaaggcaagaagaaaagacaatagaaggttaccctggaaaaacaacacctagcaaacctcagaatactccatgtgtcccaagagaaggaataattgtctttctagctgttatatattgcacactggccaggataaattcccagactataataatcctgactatgtagacggaagtttctatttataaagtcatgcagggggaaagttgattaatttttgtcccattgccacatctgtagactaagtaatttttaacttgctaacttttagaatgtccacctttgtgcattttggtagcattcttgtttcattattttagaaaggggtcttcccattactgggatgtcggggccctgtcagagaactattattaaggctctgtgagggaactgttcagtctcacagcaaggaccacagagcgtggtttcatctgaaccctacaagtcagggacaccagtgtgttttctactcgagttacctaaaaatggtctcaattttccatttcattctctgtaaatgacacaatagatggtttatagactcagcagccctcaccttttattaaaattatatatgtgtgatgtaatgcatatcacctgtcatgtaaagggacggtatggatggtggaaaagttatgctaaaatatggattgcagatatttttgtatgtaatataggcaatataatgaaacaccgagttttttaaagtgaaagcatgcaaaatcgtagcttttaaatgtacagacatcccactcaaaaatatctaaactgatagtgggaaaaacatttgagacctagtaacatcatgaaatgcactgaatttggaattctggcctagaaaggctgtggcttatgttgggattgatgatggaatctgccagaacattttcatcttattcttcttgacttttggatttttttcttttctttttttctggaaatatttcggaaataaagtgacttcatttttcagcataaaagtatattctaaccacagggtaacacatcgtttttaacatgaaaataaacatttaaacattcttcagttgtttcattattttatctgcatgttccataaagcagctgtatggttggctataatatagatttattttttcttttcagccagagattttaatacccttgatgcagtaataaatggacatcaaaagaaaacatttcttaaaagttgccaacgtattttaccttgaaaacatttcttatttgttatcctagtaggctggggaaagcttctctccagatgtctcagaaaaagatctcctgtttctcatggccccgtccagggtcaaaccatgttgaaagtcagtgctgaaatgcatgatgctgcgggtgtttgagagcctttgacctctgtccaccctttggtctttgctcgtcaatggcttggtcttgtatatgtatctggggcaggggctttgtactgggcccagggtgctgagctttccagaacaggcagagctctagagacctaagaaaaccacaggacaggcggggattctttttgagaggctgaagtagatgtttcagctgaaagatgggtggtacacttgccaagtgcctagaggggctagaggctctctgttggtgtgtgtgtatttcttgaaactgcagagtcatttttggcatgctggcaaatgctactccttgcttttaggatgaatagggatgcctctttggcgataatttgacgtgtcataataaatgcccaataccaaacctagtctttctccaggcccttcagacatcattcaggtaactgggtgtaaacacaggagttggctttgtgaaactgaggcaggatttcctgcctctaaactattggcagcaaaagagccaaaaatgtgctcccaggtgcaaaaccccagccccatcagaattgcttctcagcactttgggtaactgttttgcactaacagcttcctccttgtcttttccctgggaacatgggagcactgacacagaactcaactggtccagccctttgggaggcccaggtgggcagatcacctgaagtcaggagtttgagaccagcctgggcaacatggtgaaaccctgtctctactaaaaatacaaaaattatccagtcgtggtggtgcatgcctgtagtcccagctactctggaggctgaggcaggagaatcacttgaacctgagaggtgaaggttgtagtgagccaagatcgtaccactgcactctggcctgggcaacaagagcgagactttgtctcaaacagaaacaaaacaagaaaaacaaaaagaacttaaccagttctccccagatctcagcgtgcatgcatatatagagtttagtaaaatgtgtttcaaaaaaagaaggataaaagaaagtttgaagtaagatttgtaaaagaatgaacactttaggttttgtgtgtgagtgcaaaatgtaaacacggcatttgaaattttttggtattgaaatccttaatgcctgttagtttctttatggttttatacaattgagataggttctgaagtttttttgttgtttgcttttagaaatttttaaaaatacaaaaaaaaagcgcagaaacattttcatctgggttactgtgtttatagactattctatgactcaagacaactaggacaccatcattttccagataagaaataacagttcaagttcattagggaaattatcttcccagtccaagcaagcaataatgttatcaacttacaatattggacaatcttcatattctatgagatgcctttaaaatttctttggatttaatgctgctcttggtcagttgttcaaatgaaacattgtaatttcatgttaacgacaagagtctcacgggagtctctttagatgctgcaggaactgagaggatagaagacctctctatacatctacattgcccattggagtaaagcactttacagagagatggatgccgctttgggatttggggtctatgtaatgctgatttttttcaaacctgtttggaaatattacttctttgggatggctgaaataacttttgacctgacacatctttctgtacttcctgtggccaaaaaagcaagtgagactttctgtttcccattgtaaggctggagctgaaatagtctgccacgttattgttatctcctttgtaagaatttgactttctgaatgaaataacagaatgccagtgtcaacactgaccatatgatatagttatttcacttagagatgcttcctcaaagagcgtgcctttttcctccatcataaccgctttaggatctctgttttatccatgtatttcccacatagtagaagcattttccatttccatgaatattacaggctgagaaggagcacacatctggcactgataagcacactggcccaggcactcagccttctcatttcattaatctggttggtgaccgtttccatcgggcacacctggaaatgtccatcggacatattgccatctcagttgctgcagtgcagtgaattaccccagagccaccagttcacatgcccaaagatgaactggcccatggagggacttgattgccaagtgacttcctttctgtagttatcctctgctgtgacccttattttggacttctagcaagggcattcagtgtggattccaagaacaaaaccaattgtccaacctccattacaggggtcttctaggtattccccacacattatttgtgggcataagcaaacaccataactatgaaaggctgagagtggagaattaagtcataaggaaatgatcaaacctagggaaaaataagtggctataaaacactgaaagatagtcacatccacatagcgtgtatcatgcaacagacccgtgctcttagagggaggtagtgtgtgtcttcccatggcaaataatttttacaatactgctcatgtttaatgtgtgtctacagggcatgctgttgtctcaaaattgaaatgtgcatcttaggtatcagttcccagcctcagactcttctcaggcaggtggaccggatctcagctgcagaacatagtgagtggccaaacctacacagcccagccagtagtgtgctttggggtgattgcaaggcagcaaacagtggggacaagttttgtctggcatttgaaaaggtgttatcccttactttccacatttctgaattggattcttgttccctggtaaacaccagatattataaacagagcatgctgttatgacattgtgcttctatatacctttttgtataatgtatctatctcattatattacctatggtttcagtatgatctgttgtgtatgttccaccgtatatttaatgtctctgtaaaggcacttccaaacattttgaaaacgaagaaataaaacatgttggatgatt

SEQ ID NO: 21674 - DNA, 5787 bp, Homo sapiens
  ENST00000534945
tgacagagagtcgagggattgtggatagcctgcagaagttttcctcgctccctgcttacctccccacgaacttgcacatctccaatgcagaggagtcctttttccttaaagaagccaaccaagacctcacaaggaactccagtctgcaggcccgggtggagccattcttcatctaccgagccaggacaccccctattatcaatgccagctatggcccattttcagtggagaagataatcccccaggagctcctgttgacatctacagcctttggaaacatggacaaatttcccttcaactggaaattgaaatcccacatccttgacagctccatctactccaacagacccaaagtgcagaccttgttttatgtcactggcatgggctgggatgacagtgaccttacggaagatctaccctgtgtcaagatgtttgctttccctgaggccagggaagtggcagccagctgtcggctgcaaggggccccagggctgtgtgtggctgagctggagctgctgcccgagtggttcagctcaggcctggacctggaaccagaggaggagatcccagccctgctcgggggcaccacgatggagctcttcttcacgctctacccagctgacaaggctggccagtgtcctctggaggaggaaggcaagtgggagaacaatatccactcgggcctggagagcccccagcaagcgtttccagcccgagagaggattgggagtgtggtggtctacccaacccaagatgatctgaagtggtccctggtgagcttggacgagaatgtggtcatctcggtacctctgaatctagtccgggaaggggacacggccacctttttggtctctctgaccagtagctctgtggcagaccagttcactcttagaattaaggcggcagcaggtgtgaagataacggcagtgagagtcagcagtgaggaccaatgggcagtccaggaggaaattgataatggcagcactcagacgtcggccaccctcacctgcatgggccatcgcccggacacgcagagcagggtaaatggatccttctatgagatcttgcaagtggactttggaattgataatagcagtgacctggctggggcccagcagattacctggcaggtggagtacccgattgaggactccatgagtgagctggtcgtctccgagatcttcgtcagccagacaaccttcgtgggcatcgtccctcttgccatggacaccgaggttttgaacactgccattctcactggaaagcctgtttcagttcctgtcaaagtcgtgggggtccaggaggatggttctgtggtcgatgtgtctgagtctgtggaatgcaagtctgccgatgaagatgtcattaaggtaaggggggatttatctacagctgtcctaagtgctcagagctttttgtcgttccttcttttgtctccaaggtcttgttctcactgagcatcccatgctctaaagggctggaggccagaatgacctcacgaaggaggaaacagctgaccgcagagactccctggaatcagcaggcggctgcagcaggtgatgctgcttccctctccctggaaaggggaatccctgacccttaatctccagcagaaagaatttattctcctccccttcttgtctcccctattcttctctctatctttcctcgtaagacaatattttcctaactttagcaatccaaataagaccttctcattttttgcaaactcactgtgcctaataatattatttactcaatatattttctttaaatgccttgcttctttcgggtagccagttagctcagtgggttagagtgtggtgctaataaatgcattactttttcaaacttaaaaactaatttagcttcattataagacaataaagtccgtgagcttggtgtattacattttttgttaatatgcattaaaataaataactattcaaataaaattaagttcacccatgtgccacctaactgaacttgaatataaccagtgggatacagtttaggaaatgggacatttctgctagattcttcactcaaattagctatgtttctgactccaaattctgctaggaaccagaaaatatttttttcatgctctctgaaggggtctttttgaaccaccaaatttaatatttctgcctattttttcttagcacattggttgctattgcttttgcagcagagacctcagggagaaaggatttgaatttttagaatgactgatccttcctcctttaaattattaagagagccccaaagtccaatctattcagctattttagaaaaatacaataactcagagttctgcccttcctcacattctacaagctcttgtttagaggttacatgaaacttggtctcagtattgaaaacttcgtggtagacaggaaaacctttaggggtttccctatagtagaaaaggtctgggaggggttgatttcttcttgttgtgacctacaggatgctgtgtcttaagcaagagacagtttcggaaaaaaagactgatgtattcgtgaggtctaattaacaaagaaattaattcctaggaaactcaagtttggcatagactctttcctggacatggaatgctcatcgtccttagatatggaaggtggactggcttaaaacctgcacacatagccctgcctggggttcctggtggtccttgtattctgtaggcaggtttgattaaatatatggccttaaatattcagagtttagaaagagctgagccaagtcacaggagattatatgcaccaatgacaaatatggatgatgaactgctgttggttgctattgacaatgcgcaagttttacactatttttactattcccatgtcattctagaaaggagacactgataagagatggtatctgtatgcttacgtcataatgggctcaaacaaatgattcagtctgtagtttcctaagccttttgttctgacctaagagcctgctatgaagccccatggggtggaatcctccttctcttgccctgaagagctctactctagaggggcaggtccaagttcacagatcccgttattgccatatacctggttttctccactccacacaaatgtactaaaagtatcctctgctcatcctcatagacgttgttttggaagatgatacctttttgctcagctgtcacctatatagcctcaggaggatggggattcgtctaacaaattattgcccagtcttcagaggaacaaagtgaaacctgcagatcgcaagctcagagctgtattcacactttttaaggggattccaggactgttgcaagtttgggggcttgtgtcaattgaggcgatttaattaaatggctgtgatgcatttactatggcttcagtgtcaatgtttgtagtaaattttactataactccaagttgaatggagttgtccacagagctatgaccttggcatcatcccagggacatcctcaaatacatggcacattcattagcaccctttggagagatcctctgagtctgtggagttgtcacacagtcatacttcagagtacagaaaacactgaatgatttttagggagagtcttgcagggctcaccaaagatctttgtgccttggaaccatgagttagataagggaaaaatgtgaatttagaaagatgtaagttatggtaatatccaaacaaatgaacttgtttggcctgtgattgtatgacttttgcgggacagaatcagaggacatacatgattttgaaaagctggaaccttggcctaatctggcaagattaaaagagataaatgtaaaatttcaagttgacaactatagtagtccttccttatctgtggtttcactttccgtggtttcatttcactgtggtcaatcacagtccaaaaacgttaaatgaaaattttcagaaagaagcaattcatgttttaaattgtgtactgttctgagtatcgtgaagaaatcttgagtcttcctgctccatcccacctgggttgtaactcatgactttgtctggcatatccatgctgtagataccacccacctctgagtcatttagtagctgcctgggtgatcaaatagactgtcgcggtatcacagtgcttgtgttcaagtcacccttatgttatttacaaatgaccccaaagtataagagtagtgatgctggcaattcggctagaccaacaagaagtcataaagtgcttcttttaagtgaaaaggtgagagttcttgacttaataaggaaggaaaaagatcatatgctggagttactaagatctacagtcagagcgaatcgtctatccatgaaatcgtgatgaaggaaaaaacattcatcgtagttttgctgtcacatctcaaatacaaaagttaaggccacagtgtgtgataaattcttcattaagatgtgaaaagacattaaatttaggtgaaagacatgaacagaaacttgttctgctggatgacagtctgattcagttctatctgtggtttcaggcatccactgggggtcttagactatattacccatggatgggaggagactgggagactgctgtacttttaggttaaaaaaaaaaaaaacaagtagaggattgtgtgtgtgtgtgtgtgtgtgtgtgcgcacacacacaagaagccttagcgtttttatcagtattgggatccagtgagtcaactgtttgataaggctgctacaggttgatttttattagcatgaatgggtgtgtgcctcagagcagaggtcacaggcaggcagtctgcagaccagatctgacccagaagtgtgtggggggtgcggggagggtctgcatagtttaaaaattgttacttaatttgttgcccccatgtaaaaattggcaagttcgcacagaaatctggatttacagtttcttatgaaaaatcacaggaccaggtggtcctgggtctccatgatttcctgtgaacctcgtctggagttgaagagaggatgctcctctgcataaaacctgtgccctccagctcactgtagtctccaccactcccttttgtctttcacatggaggttgaaggatatttgtcatttctggtcacacttgtgctcctagtttttgatagtggatttcagaggaaggtgagatattttttgtactccagtctctaaaaataaataagcaacaaatgatagacttcactctctcactctgatggagaattctgtatctttctaggccgtaagaagaacaataaaaaattgggttgtgctctgccaaaaagtgtctgagaggctgaggactcttgaaatcaaatcacaggagaaatgattgaaggaagtgtgagtgttaagcctattgatgagaagaaaaggctcaggggtgaggtggagagggagacatgacagctttttgtaagtctttcaagggccatcatgtagaagatggagtagctttgtgctttttagattccaagaatggaagttgaaaggtaccagttttagctcaatataaagaaaaagactgcagaggtagtgagttctttggttgagcttccagacatgtgatgttgctaaagatcctgactccaccttcctcaccgtttgaccttgggcaaattacttaccatctctgagcctagtttccttatctataaaatggggatggtaatgatacagtggaaacgtacttttctagagatttgttctaaagtcacagcaaacggcagaactaacaataaccaaactactccctaatccttgaaaatccccagtctcactgggtcatccaggctggagtgcagtggcgtgatctcggcttactgcagc

SEQ ID NO: 21675 - DNA, 2055 bp, Homo sapiens
  ENST00000535886
acagtcaagaaaggtgtagatcctgcagactgcgtggaggccatgctttcacatcaagccttcctcggtgacttgctcagcctgactgtgttcttatttgctgggtctctctctggaaatctccactttgagtgtttccaacaactgtgattccatttttgtgaatgggaaggaaatgaagagcaaagtggacacgattgtgaacttcacccaccagcacttcacctcccagttcgaggtcactgtctgggcacccaggctccccctgcagattgagatctcagacaccgagctgagccagatcaagggctggaggatcccggttgctgccaacagaaggcctacccgggaaagcgatgacgaggacgatgaggagaagaagggacgaggctgctccctgcagtaccagcacgccacagtgcgtgtcctcacccagtttgtggccgagtcacctgacttagggcagctgacctacatgctgggccccgactggcagtttgacatcactgaccttgtgaccgagttcatgaaggtggaggagccgaaaatcgctcagttacaggacggcaggaccctggctggtcgggagccgggaataaccacggtgcaggtcctctcgccgttgtctgactccatcctggctgagaagacggtgattgtcctggatgaccgagtcaccatcgcggagctgggagtgcagctcgtagctggcatgtctctctccctgcagccacaccgagcagacaaaagggccatcgtctccacagctgctgccctggatgttcttcagtccccacagcaggaagcaatagtaagttcttggattttgttcagtgatggttcggtgacacctttagacatttacgatcctaaggattattctgttactgtctcatcattggatgaaatggtggtgtctgtccaggcaaaccttgagtccaaatggccaattgtggttgcagagggtgaaggacaagggcctttgattaagttagaaatgatgataagtgaaccttgtcagaagaccaagaggaagagtgttcttgccgtgggtaaaggaaatgtcaaggtcaaattcgaaccaagtagtgatgagcaccaaggaggcagcaatgatattgagggcataaatcgggaatataaagaccacctcagtaattccatagagcgcgaaggaaaccaggagagagcagtccaggaatggttccaccgtggcacacctgttggccaagaggaaagtaccaacaaaagcacaaccccccagtctcccatggaagggaagaataagttactcaaaagtggtggtccagatgcctttacaagcttccccactcaagggaagtcaccggaccccaataatcctagtgacctcacagtgacctcaagggggctaacggacttggagattggcatgtatgccttgctctgcgtcttctgtctggccattctggtcttcttgatcaactgcgtggcgtttgcctggaaatacagacacaaaaggtttgctgtgagtgagcagggcaacatcccccattcccacgactgggtctggcttgggaatgaagtggaacttttggagaaccctgttgacattacactcccatcagaggagtgcacaaccatgatagacaggggcctgcagttcgaggagaggaacttccttctgaatggcagttcccagaagacttttcatagtcaactactcagaccctctgactatgtctatgagaaagaaattaaaaatgaacctatgaattcttcgggcccaaagaggaagagagtcaagttcacttcctacaccaccatcctcccagaggacggcggcccatacaccaactccatcctgtttgacagcgatgataacatcaagtgggtctgccaagatatggggctgggggattcacaggactttagagactatatggaaagtctgcaagaccagatgtaaactcctttcttatgtttgtattcacctttatgccttctgttttttgaatgctggagcagtgagtttgatcagcaataggggatgatttaacaaagtttgatttgtgg

SEQ ID NO: 21676 - DNA, 9659 bp, Homo sapiens
  ENST00000613307
atagccaggtttccaaccaacctttcctgtgctggaaaggactcacagtcaagaaaggtgtagatcctgcagactgcgtggaggccatgctttcacatcaagccttcctcggtgacttgctcagcctgactgtgttcttatttgctgggtctctctctggaaatctccactttgagtgtttccaacaactgtgattccatttttgtgaatgggaaggaaatgaagagcaaagtggacacgattgtgaacttcacccaccagcacttcacctcccagttcgaggtcactgtctgggcacccaggctccccctgcagattgagatctcagacaccgagctgagccagatcaagggctggaggatcccggttgctgccaacagaaggcctacccgggaaagcgatgacgaggacgatgaggagaagaagggacgaggctgctccctgcagtaccagcacgccacagtgcgtgtcctcacccagtttgtggccgagtcacctgacttagggcagctgacctacatgctgggccccgactggcagtttgacatcactgaccttgtgaccgagttcatgaaggtggaggagccgaaaatcgctcagttacaggacggcaggaccctggctggtcgggagccgggaataaccacggtgcaggtcctctcgccgttgtctgactccatcctggctgagaagacggtgattgtcctggatgaccgagtcaccatcgcggagctgggagtgcagctcgtagctggcatgtctctctccctgcagccacaccgagcagacaaaagggccatcgtctccacagctgctgccctggatgttcttcagtccccacagcaggaagcaatagtaagttcttggattttgttcagtgatggttcggtgacacctttagacatttacgatcctaaggattattctgttactgtctcatcattggatgaaatggtggtgtctgtccaggcaaaccttgagtccaaatggccaattgtggttgcagagggtgaaggacaagggcctttgattaagttagaaatgatgataagtgaaccttgtcagaagaccaagaggaagagtgttcttgccgtgggtaaaggaaatgtcaaggtcaaattcgaaccaagtagtgatgagcaccaaggaggcagcaatgatattgagggcataaatcgggaatataaagaccacctcagtaattccatagagcgcgaaggaaaccaggagagagcagtccaggaatggttccaccgtggcacacctgttggccaagaggaaagtaccaacaaaagcacaaccccccagtctcccatggaagggaagaataagttactcaaaagtggtggtccagatgcctttacaagcttccccactcaagggaagtcaccggaccccaataatcctagtgacctcacagtgacctcaagggggctaacggacttggagattggcatgtatgccttgctctgcgtcttctgtctggccattctggtcttcttgatcaactgcgtggcgtttgcctggaaatacagacacaaaaggtttgctgtgagtgagcagggcaacatcccccattcccacgactgggtctggcttgggaatgaagtggaacttttggagaaccctgttgacattacactcccatcagaggagtgcacaaccatgatagacaggggcctgcagttcgaggagaggaacttccttctgaatggcagttcccagaagacttttcatagtcaactactcagaccctctgactatgtctatgagaaagaaattaaaaatgaacctatgaattcttcgggcccaaagaggaagagagtcaagttcacttcctacaccaccatcctcccagaggacggcggcccatacaccaactccatcctgtttgacagcgatgataacatcaagtgggtctgccaagatatggggctgggggattcacaggactttagagactatatggaaagtctgcaagaccagatgtaaactcctttcttatgtttgtattcacctttatgccttctgttttttgaatgctggagcagtgagtttgatcagcaataggggatgatttaacaaagtttgatttgtggaggtctggtgggattcatttctaagcaggtaaaagaggtttggagagctatagaagctgggttttaagtttggaaatgcctctaaaacagccacatgtggggactggagaaattctaagacaacagttttatggactgcctggtacgagctcagtgcaaatgtattaaacctgaccccacagacattgttagtcatctcgtgacaaatggccatgtggaattagaaaagatttgggtgttgatttttctatttctagaccttttaaagcacagtggacacttattgccccttggcctgagtttagacatacatgaaagatgactgaatgtagctatcctgatttgtcatgagcgctgctcattatttttatatacatttgcacctgcacctgttcctttgacctctggaattctttttgaaacatgaagagaagaaatttcagtcttttccttgagctctgtttgatttacacatgagttttcttccctgggatttgccatgccatgttatttcctgggtctccatgcaggatgtcaggtttttccagttttctgcacttcatcatctagggatggtatccaagaagcttattctcactttgttttttccttccttttgttgttgaactttcttgtataacactgggacaaagggttttacttaaaatgttaatatacagtgagggagggccatctctttactgttttctatgtgaagtttcaaacatttggaaaaaagttgtcaatcacaaacatttatttttattctctgcttgttgaaaactcatggggaactcctggagtgcatttctgagggtaaaaaggccccaacatagctgtatttatacaagtgctttgtggccaacacaatttactatccaaactgaagtcttaaagtagaattgacctacacagaaaggaaattgcctaggcaatagatgcagattacactttccattttaccagaacaaaagtttttttttttttaaataagtagaatgacagttcaagttagcaatatatagaaatccatccatacaatgaccaaaataaataaataaataaaactcaatcatgactttggcagagataaaacattgacaagggtgtgcatttgtggagagaagcagtgggtttccccccaaaatccatacaaataaatgactattccagaactcaagaagcagctattatagaaaaaaaaattaaaaaccacagctattgaaaaattaaaacggcaagagaaaaaaagaaacaactcctgcataatgtttaaataaaaatgttattttaatagcatcatgaatggtcttaaggcaaaaatttcagattagcaaaatgtgatgacatatttattaagattgtattattggaaatgtagacactggactagtatgcctcattatgagctttactgagccatttgcatctctaagaaatatgattttaaaggcccaaagtaggaaggatctgcagggggtcacctgaagcagtgccctgactccaaatggctgataactgagctaatccaaggagaggcgttcagttgttctcttattatagatttccttgggtgggaacatgacaaccccgcctcctctagccatgacgtggcagccaaaaagttcttcctgtatctctggcccacaggactgtagtgtgtttgggaacagtgctgaaattgcaagtgatgtaggcctgacctccagagcccagcgttcagttagttgtataaaatggggcttaggaaccgaagctgatgaagttccaaaagtagttcagtttgatgggataaggaagcaaggagagccaggcattagctgcaaaaggagcttgcagagagatggctgacactttatgggaagattcctcagtcagccaaaagcttttcaaagagtttggtgcagaggtagctcagagccaaccatccaggaccgaagaaagctcatgtgctgattgacacatagctatccaggtgagtcggctccttctatgaggcttttcaatcgtctctccctttggatctctggcattccagaaagactgggaattcatttctgaaaatgatgaacctccgctgaaacggggaggaaatctcttacacacatacagcagggtcctgcccactggtaaagtgagacgttgggtagggggtgtaactggggaggaggtgaaggaaattatccctgccatggggagtgttattcaggaacataaaaattagagcattccctctgatggcagtgcttgacggggtgcagggaacaaactggggagcgttcaaacatgccagtggtttctcagcagggctggaaactggccacagtcctgaagatgcttcttgtgacaacttagagtcactgggagtcacacagctcctgtgtagccgcctttgctcctctgtgttaaaacccagtcagttcaaaataacaatcaaatggaaggccatgggggaagggttccttccaccatataacccacacccagatgtatataaacgcatatacatacatatacccgtgtgtgtgtgtgtgtgtgtgtgtgtgtgtgtgaatactgaagagccagacaacaaactatttagtaagaatcaacagtgactgtcaattgttctcagatttggcatggatactatttctcatgaaataatgtcattaaagtatttcctcctctaaatatttcctgaagatcataaaccatgggttatagcaccttgttttccagctagtcaatatacaactattaggtgctgtgccccaaaatatctaaaatgggggtaaagatataaactattaagccatgaaatctaattttctggggaccatgcatttgcctggattttccaggattttatggctgatagacccaaattattagtcttgataaacaacctgaaccaaacatttataaagtcccttcctctcccatgggaatggaatgctcagactcctgctgagggagacaccagcaagcctcttgagaaggcaccagacagtgaactctgtggtcacatgaagggaggttcagatgctagacgaccagcgtatgacctggaaccattgaggattgcaaccgctgcctccagggtccagatgtgctgcagtagagggcagagcacaggaatcaagaagcagctgccacaccaaagaactgatgcttaaacacacaggtgtgttgcatttgagagaaggcaagaagaaaagacaatagaaggttaccctggaaaaacaacacctagcaaacctcagaatactccatgtgtcccaagagaaggaataattgtctttctagctgttatatattgcacactggccaggataaattcccagactataataatcctgactatgtagacggaagtttctatttataaagtcatgcagggggaaagttgattaatttttgtcccattgccacatctgtagactaagtaatttttaacttgctaacttttagaatgtccacctttgtgcattttggtagcattcttgtttcattattttagaaaggggtcttcccattactgggatgtcggggccctgtcagagaactattattaaggctctgtgagggaactgttcagtctcacagcaaggaccacagagcgtggtttcatctgaaccctacaagtcagggacaccagtgtgttttctactcgagttacctaaaaatggtctcaattttccatttcattctctgtaaatgacacaatagatggtttatagactcagcagccctcaccttttattaaaattatatatgtgtgatgtaatgcatatcacctgtcatgtaaagggacggtatggatggtggaaaagttatgctaaaatatggattgcagatatttttgtatgtaatataggcaatataatgaaacaccgagttttttaaagtgaaagcatgcaaaatcgtagcttttaaatgtacagacatcccactcaaaaatatctaaactgatagtgggaaaaacatttgagacctagtaacatcatgaaatgcactgaatttggaattctggcctagaaaggctgtggcttatgttgggattgatgatggaatctgccagaacattttcatcttattcttcttgacttttggatttttttcttttctttttttctggaaatatttcggaaataaagtgacttcatttttcagcataaaagtatattctaaccacagggtaacacatcgtttttaacatgaaaataaacatttaaacattcttcagttgtttcattattttatctgcatgttccataaagcagctgtatggttggctataatatagatttattttttcttttcagccagagattttaatacccttgatgcagtaataaatggacatcaaaagaaaacatttcttaaaagttgccaacgtattttaccttgaaaacatttcttatttgttatcctagtaggctggggaaagcttctctccagatgtctcagaaaaagatctcctgtttctcatggccccgtccagggtcaaaccatgttgaaagtcagtgctgaaatgcatgatgctgcgggtgtttgagagcctttgacctctgtccaccctttggtctttgctcgtcaatggcttggtcttgtatatgtatctggggcaggggctttgtactgggcccagggtgctgagctttccagaacaggcagagctctagagacctaagaaaaccacaggacaggcggggattctttttgagaggctgaagtagatgtttcagctgaaagatgggtggtacacttgccaagtgcctagaggggctagaggctctctgttggtgtgtgtgtatttcttgaaactgcagagtcatttttggcatgctggcaaatgctactccttgcttttaggatgaatagggatgcctctttggcgataatttgacgtgtcataataaatgcccaataccaaacctagtctttctccaggcccttcagacatcattcaggtaactgggtgtaaacacaggagttggctttgtgaaactgaggcaggatttcctgcctctaaactattggcagcaaaagagccaaaaatgtgctcccaggtgcaaaaccccagccccatcagaattgcttctcagcactttgggtaactgttttgcactaacagcttcctccttgtcttttccctgggaacatgggagcactgacacagaactcaactggtccagccctttgggaggcccaggtgggcagatcacctgaagtcaggagtttgagaccagcctgggcaacatggtgaaaccctgtctctactaaaaatacaaaaattatccagtcgtggtggtgcatgcctgtagtcccagctactctggaggctgaggcaggagaatcacttgaacctgagaggtgaaggttgtagtgagccaagatcgtaccactgcactctggcctgggcaacaagagcgagactttgtctcaaacagaaacaaaacaagaaaaacaaaaagaacttaaccagttctccccagatctcagcgtgcatgcatatatagagtttagtaaaatgtgtttcaaaaaaagaaggataaaagaaagtttgaagtaagatttgtaaaagaatgaacactttaggttttgtgtgtgagtgcaaaatgtaaacacggcatttgaaattttttggtattgaaatccttaatgcctgttagtttctttatggttttatacaattgagataggttctgaagtttttttgttgtttgcttttagaaatttttaaaaatacaaaaaaaaagcgcagaaacattttcatctgggttactgtgtttatagactattctatgactcaagacaactaggacaccatcattttccagataagaaataacagttcaagttcattagggaaattatcttcccagtccaagcaagcaataatgttatcaacttacaatattggacaatcttcatattctatgagatgcctttaaaatttctttggatttaatgctgctcttggtcagttgttcaaatgaaacattgtaatttcatgttaacgacaagagtctcacgggagtctctttagatgctgcaggaactgagaggatagaagacctctctatacatctacattgcccattggagtaaagcactttacagagagatggatgccgctttgggatttggggtctatgtaatgctgatttttttcaaacctgtttggaaatattacttctttgggatggctgaaataacttttgacctgacacatctttctgtacttcctgtggccaaaaaagcaagtgagactttctgtttcccattgtaaggctggagctgaaatagtctgccacgttattgttatctcctttgtaagaatttgactttctgaatgaaataacagaatgccagtgtcaacactgaccatatgatatagttatttcacttagagatgcttcctcaaagagcgtgcctttttcctccatcataaccgctttaggatctctgttttatccatgtatttcccacatagtagaagcattttccatttccatgaatattacaggctgagaaggagcacacatctggcactgataagcacactggcccaggcactcagccttctcatttcattaatctggttggtgaccgtttccatcgggcacacctggaaatgtccatcggacatattgccatctcagttgctgcagtgcagtgaattaccccagagccaccagttcacatgcccaaagatgaactggcccatggagggacttgattgccaagtgacttcctttctgtagttatcctctgctgtgacccttattttggacttctagcaagggcattcagtgtggattccaagaacaaaaccaattgtccaacctccattacaggggtcttctaggtattccccacacattatttgtgggcataagcaaacaccataactatgaaaggctgagagtggagaattaagtcataaggaaatgatcaaacctagggaaaaataagtggctataaaacactgaaagatagtcacatccacatagcgtgtatcatgcaacagacccgtgctcttagagggaggtagtgtgtgtcttcccatggcaaataatttttacaatactgctcatgtttaatgtgtgtctacagggcatgctgttgtctcaaaattgaaatgtgcatcttaggtatcagttcccagcctcagactcttctcaggcaggtggaccggatctcagctgcagaacatagtgagtggccaaacctacacagcccagccagtagtgtgctttggggtgattgcaaggcagcaaacagtggggacaagttttgtctggcatttgaaaaggtgttatcccttactttccacatttctgaattggattcttgttccctggtaaacaccagatattataaacagagcatgctgttatgacattgtgcttctatatacctttttgtataatgtatctatctcattatattacctatggtttcagtatgatctgttgtgtatgttccaccgtatatttaatgtctctgtaaaggcacttccaaacattttgaaaacgaagaaataaaacatgttggatgattccttgt

SEQ ID NO: 21677 - DNA, 4947 bp, Homo sapiens
  ENST00000435159
atgcgctccgagggtgcggcccccgggccggcggcgccgctgtgcggggcgctgagcctgctgctgggcgcgctgctgggcaaagtgatagagggtcacggggtcacagacaacatacagagattctcctcactgccaccttacctacctgtgagctaccacatcctcagagcagagacctccttcttcctcaaggaagccaaccaggacctgctgcggaactccagcctgcaggcgagggtggagtccttctttacctacaaaaccaggcagcccccagtgctcaatgccagctatggacccttttctgtggagaaggttgtgcctctggacttgatgttgacttcaaactttttaggtccaaccaataagtttagttttgattggaaactaaaagcccacatcctgcgggacaaagtctacctgagccggcccaaagtgcaggttcttttccacatcatgggcagagactgggatgaccacggcgccggggagaagctgccatgcctgagggtctttgctttccgagaaaccagagaggtgcggggcagctgccggctgaagggggacctggggctgtgtgtggctgagctggagctcctgtccagctggttcagtgccccgacggtgggtgccgggaggaagaagtccatggaccagccggaggggacccctgtggagctctactacaccgtgcacccaggaaacgagcgaggggactgtgccgggggtgacttcaggaagggcaacgccatccgtccaggaaaggatgggctggaggaaaccacgtcccacctgcagaggatcggcaccgtcggcctttaccgggcccaggacagcgcccagctcagcgagctgcgtttggatggtaacgtggtcatctggctgccttccaggccagtcaagcagggagaggtggtcacggcctatgtcaccatctcgagcaattcctctgtggacctcttcatcttgagagccaaggtgaagaagggggtgaacatcctgagtgctcagacccgtgagccccggcagtggggcgtcaagcaggaggtgggcagcggcggaaagcacgtgacggccaccgtggcctgccagcgcctggggcccagcccacgcaacaggagcagcagtttattcaatgaggttgtgcagatgaactttgaaatagccagtttcagcagcctttcagggactcagcccatcacgtggcaggtggagtacccacggaaggggaccacagacatcgccgtgtccgagatctttgtcagccagaaggacctggtgggcatcgttcccttggctatggacactgaaattctgaacaccgccgtactcacaggaaagacagttgccatgcctatcaaggtggtctctgtggaggagaacagtgccgtgatggacatctcagagtcggtggagtgcaagtccacagacgaggacgttatcaaagtgtctgagcgctgtgactacatctttgtcaatggcaaagagatcaaaggaaagatggatgcggtggtgaacttcacataccagtacctgagcgcccccctgtgtgtcaccgtgtgggtgccccggctgcccctgcagatcgaggtctctgacacggagctcagccagataaagggctggagggtccccattgtgaccaataagaggcccactcgtgagagcgaggatgaggacgaggaggagcggcggggccggggctgcgcactgcaataccagcacgccaccgtgcgggtcctcacccagtttgtgtctgagggcgccggtccatggggccagccgaactacctgcttagtcctaactggcagttcgacatcactcacctggtggcagacttcatgaagctggaggaacctcacgtggccaccctccaggacagccgggtcctggttgggcgagaggttgggatgacgaccatccaggtgttgtctccactgtctgactccatcctggcagagaagacaataaccgtgctagatgacaaagtatcggtgacagacttggccatccagctcgtggctgggctgtctgtcgccctttaccccaacgcagaaaacagcaaggccgtaacagctgtggtcacagctgaggaggtgctgcggacccccaaacaggaggctgtattcagcacgtggctgcagttcagtgatggctctgtgacgcccctggacatctacgacaccaaggacttctccctggcagccacctcccaggacgaggctgtcgtgtcagtcccccagccccgctctcccaggtggcccgttgtggtggccgaaggggaaggccagggcccactgatccgagtggacatgacgatcgccgaggcctgccagaaatctaaacgcaagagcatcctggctgtgggcgtcggcaacgtcagggtcaagttcggacagaacgatgctgactccagccccggcggggactatgaggaagatgagatcaagaaccacgccagcgaccgccggcagaagggccagcaccatgagcgcacaggccaagatgggcacctctatggcagctctcccgtggagcgtgaggaaggggctctccgaagagccactaccacggccaggtccctgctggacaacaaagtggtgaagaacagtcgggcagacgggggcaggctggcaggagaggggcagctgcagaacatccccattgacttcaccaacttccctgcccacgtggacctccccaaggccgggagtgggctggaggaaaacgacctggtgcagactccgcggggcctgagtgatctggagatagggatgtacgccctcctgggggtgttctgcctggccatcctcgtcttcctgatcaactgcgccacctttgccctgaagtacaggcacaagcaagtgcccctggaaggtcaggcctccatgacccactctcacgactgggtgtggcttggcaatgaggccgaactcctggagagcatgggggatgcgccgccgccccaggacgagcacaccaccatcatagaccgcggaccgggggcctgcgaggagagcaaccatctcctgctcaatggtggctcccacaagcacgtgcagagccagattcacaggtcagccgactccggggggcggcagggcagagaacagaagcaggaccccctgcactcgcccacctccaagaggaagaaggtgaaatttaccacctttaccaccatccccccggacgacagctgccccacggtgaactccatcgtcagcagcaatgatgaggacatcaaatgggtgtgtcaagacgtggctgtgggtgcccccaaggaacttagaaactatctggagaaactcaaagataaggcttaggcccctctagccaaagggccctgcccagatgccttccttgtactggaaactggcccaagtggggcagaaggcgttgtcagtggggttaagaagggacggtcccagggtccatgctagaccagttggaaagttttgaagtcaggaaaagacgtttttgtatcaagggatttttagcagttaatggtggtggatttttaaaggtcaggggaataaagtctggggcatggggagtgcagaccaagttactgaactgcacaggcaaaattaggaaggttattttatgagtcaaaacatactacagacaagctaccaaaaattatttgttaaaaaatgcaacaagacaaataaaaagagaaataatcatctgtttatatttctaataaaggagcaaaatataaaaataggacctgctaagagacattttccattctaattcacgattcacttttccaaggacagccttcaactgtcaccacacagctgggggggagtcatttcttaacaagggatgcctcttgggatagaactagggagttttaaatctttacttgatcatcttttattttcttttccactttttccttttttctctctctctgtgtcctagacttccattgcatttatatttaatgtttatttctgagaatcaagcagtatatttttcctaaatgaaacataaattatattcctattcattagataggttcctaggaacaatgccaattaatccattgtttaagtagtaacttgaatgtttttctatatccctccagctttgttgatagtggcgggttttgtacaattggagggagccctcagagccttctgggggaggagaggaactgtccttaatccatcaccactaccatagggcaaagccagcaggtgtggccctgtgaggggctgtacagacgggatgtggccaggagaacagagccccacctggaccacctgacccctcgggattccacccctgtcatcgtggggatgttcctatatgggagaaagttgggttaaatcaaaaaagaggccacgcccaggtgtaatcagagccaacctggtgggcttggtctatcacaagacataactgatgctgaacatgaacaaagataaaaactgtttggagggtttttgagttgtttttcttatgttgttgggtggggtataccagcataaactctaaagataaaatctatgttagattgtcaatcaactgtgtttttgaacagcataattgtgtagcagcacattgcaaaaatgcattcatccaaagcgacacatgtggcaacgtagaccacgccagtgaaataagccccttcgtgatcacctgactccagttctccgtgtgctccattggctgcggctgcaggaggaagatgcctgacagccctcatgctctccgcaggggggcgctcacaaagatgccaggggtgtttattgtgtttatttttttaattactaaaatcagtagctaagaaagggtccttgaagcctcctaacctgggttggacctttgaaaaatatatttgtagcacatattatagatggaaagaagaagatatttatttatacctgtgatgccaattgtcattaaaaggcttttcatggcttgacaagtca

SEQ ID NO: 21678 - DNA, 5305 bp, Homo sapiens
  ENST00000389441
cgtttatagataccaaggatgaggatgtggatacctttcggagctattatttagtctcccacactctcccgaagacatgtcccaattcttgtttaggatgaaaactaaaggactcattgccttcccccaggaaagctaggagacaagacaagagaacaaaatccttacattgaacttgcttcttcccatcagcgctggcatggaggagccctcttgcaccaggtagaagttggcagcctgagctctggagccagacttctggggctaaatcctggctctgcccttcctggtagaggaacataggcaggctcccccactcctgccggcttcctcatctggaatgtgggaatggcagtggtgcctagcgttgtggttgttctgaggatgaaaggaatccgcatgtttggattccctgaaaagcggagcctgtgacgtgcacttgagaacaggtgctttatttggggaatgatctctggaggcagaatgagggagtgagcagcaagacaggacacattttggaaaaccagcaggaggtgcatcattgagctagctcgcatggtgggcaacttctgtgaagtcccatcgagcccctctagggaattctgcaggacaggcctcagaatccacccctgtgcctcgtcgagcccctctagggaactctgcaggacgggcctcagaatccaccccgtgcctgcaggggaaagtggtctgcacatgccctgttgaggacgttctcaggatacacccgcatgggagtgaagacagtagaaggggaagaagaggggctaagcaaggtcaggtccaggtgcagcacagccagctccttgaggagctcttaagaatgagctgtgctgtgcatgggtccctccttgaggcaaacagcctgggcttctcaccccaccaggtagtcactgggcagagaagcggggtgagcaggacataactcccgggtaactctgagggacacagctccactcacctaagggcagtcttctacggaagatgtggcaggagctgtcggcaacacacgcagcccctggggaggagtccaccaacctagccacagggaccccaggaagcctgggtactcagagagcacctttcataacagcgtctgctattattactcaaaagcaacacccaatgtctgctccataccaggacctcctcccccatagtaaggggaggaaagggaagcacctccaccagccagggcacttccctttcctcctccttgggccatgcaacgggatgaaagctcacctttccctccccttttctctctcacctcttcacaggtttctgacagatgtgactacgtctttgtcaatgggaaagaaatgaaaggcaaggtcaacgtggtggtgaacttcacctaccagcacctgagcagccccctggagatgacggtgtgggtgccccggcttccgctgcagatcgaggtctccgacaccgagctcaatcagatcaagggttggagagtgcccatcgtctccagcaggaggcctgccggggacagtgaagaggaggaggatgatgagcggaggggccgcggctgcaccctgcagtaccagcacgccatggtgcgggtcctgacgcagtttgtggctgaggcggccggccctgggggacacctggcccacctgctgggctcagactggcaagtggacatcacggagctgataaatgacttcatgcaggtggaggagcccaggatcgccaagctgcaaggcggacagatcctgatggggcaggagcttgggatgaccaccattcagatcctgtctcctctgtcagacaccatcctcgctgaaaagaccatcactgtgctggacgagaaggtgaccatcacagacctcggggtgcagctggtgacagggctgtcactctccttgcagctcagcccaggaagcaacagggccatctttgccactgcagtggctcaggaacttctgcagaggccaaaacaggaagcagccatcagttgctgggtccagttcagtgatggctcagtcacgcccttggatatttacgatgggaaagacttctccttgatggccacatctttggatgagaaggtagtctccatccaccaagaccccaaattcaagtggcctatcattgctgcggaaacagaaggacaaggcaccctggtcaaggtggaaatggttattagtgaatcctgccagaaatccaagcggaagagtgtgttagctgttggaacggcaaacatcaaagttaaatttggccaaaacgatgctaaccccaacaccagtgacagcagacacacaggggcaggggttcacatggaaaacaatgtcagtgacagaaggcccaaaaaaccctcgcaggaatgggggagtcaggaaggacagtactatggcagttcttctatgggactcatggagggacggggcaccacgacagacaggtccatcctgcagaagaagaaaggccaggaaagccttttagatgacaacagccacttgcagaccatccccagcgacctcaccagcttcccagcccaggtggacctccccagaagcaatggggaaatggatgggaatgaccttatgcaggcatccaaagggctgagcgacttagaaattgggatgtatgctttgttgggagtcttctgtttggccattttggtcttcttgataaactgtgtgacctttgcattaaaatacagacacaaacaggttcccttcgaggagcaggaagggatgagtcactctcatgactgggttgggttaagcaaccggacagagctgttggagaatcacatcaactttgcctcctcgcaagatgagcaaatcactgccattgacaggggcatggatttcgaggaaagtaaatatctcctcagcacaaactcccaaaaaagcatcaatgggcagctgttcaaacctttgggacccatcatcattgatgggaaagatcagaaaagtgagcccccaacatcccctacctcaaaaaggaaaagggtaaaatttaccaccttcaccgccgtctcctcagacgacgagtaccccaccaggaactccatcgtgatgagtagcgaggatgacattaagtgggtctgccaggatctggaccctggggactgcaaagagctgcacaactacatggagaggttacatgaaaatgtgtaagccagacacacacagacattggttctcactcacctttcagcctttaattccaggatgtgtagcaacggtgcccccggaagagaaacaaagcagcaggacaaaataaggatgacactatccatacagcctcagccaatgaccccggctcggcggcgaggcctggagtccgcatcgacgcacacattccagagtacagtgtcttgcttaagaggtttatcatgcatggcaagatttttaagacttgaaacaaaaacgagttctgaatcactgagcgtctgagagcgtccaggaaagaacagcctctctctctcgaatcaaagcaatttggatattgtaaaatccacatggctccaatattcaatattgcagactatggaagaaaagtacaactcaggtggagcatccatggatcgcatccatggatcaatgggaggaagcgtgtcatcgaaactggagcagcacatcttgctgtgagcgcgatcacaggcagtccagtgccgccgtcagctgtgggaggcatgattgtgagtcattgtctctcaaaggctgggccagagctgtctcagatcatggacaggccaaggaagtggctgacaaggactgaaagggaacatgtgggctaacaggccacaaatacctttgtaactacatgccaaggacaaacacatggacgcaaatcctctgagcccttcagggtacttctttatttgtaaactaaggatactgggcatagaatttgaatcaggttcaaagaaccacgctcttttgattcatatcaagttcacaatgtatccatttctattcctccactgcattgccatcctccccaaagccgttggtcacctgtgggtgggggagggagagggcagtttgtagtatttgctgggtcttttttctccccctgggttttgtgtcaactcccaagtgacattctgtagagaagctccccccgcaacctgggcatatgtcccacgccgtccgtctttgaagaggctggtctctaggcatgggcggtagtcacggtgaattccataccaggggatatacattcccttgctttactagaaagaaaacagggccacttgggatgggtctttcactgttcatggcagatctcctgtccaaagatgtggcctcgaggctgttgagacaaatcggggtgcctgtgtggaacgtgcagggcgtgtggagttgggggggttctgggtgtgaaagtggtggatccagcaggaagcccagcctcacacacaccggacagcacagaaaccttcttcatcttggaggtgcgaagggataaggggcatcagtgcatgtggtgaagatgcaggtttgcaagcacttggtcctgcagtcagccccgaaaggttcagcattgcttaagaccagccatgactctggatatccctgaatcccttcacttatgaagcctatgaagatgggggcaaggatacatcagagaattcctgcctcatctcacgctcactccaaggtagagaatggtgtgttgggtgattgccagccagataggatcctgcaaaagatggtcgggggcagcgggtggtgggcagaagaggccgtgctgttgaattgatcttctatttttccctctggtcattttctctctctctctgctcttcagttgtctgttttccagtctctctgtgtgtctgtctctgtatctctctcctcctttgaacctatcttctccctgcttcctctccatctcatctctgtaattttgagtgtgtgtctttactccttcttcctctccatagaattgaattctctttagatcatgtgtgtgtaaatttcaccagtttaccctcccaaccttagccctctcccctgcaactgtggtgctcttgagactgaggtttctgcagccagtaagtcacctgctcctgtccgcaagcttacctaccttgtttggttgggtgattaagctgtcaccccttttcaatgagaatcctttgctttcagtaacgtcctcatatttctttccattcttacctgtgtcatgttctgttgaatactgcagccgctgcccgcttccaaatccatctgcgtgtagaatgtactgtagattgtaagaatgtaatatatatttataaacttactgactgtaaatataaagtttgcattcagtggct

SEQ ID NO: 21679 - DNA, 5776 bp, Homo sapiens
  ENST00000422113
ccactcttcgctcgggtaaacaggaaaggaaataccccctgtggattaaaatttaaaaaaaattctgttggggtcgaaggagggaggtggggtttgcctgcgcgcgtgttggactccggagagcaactcaggagcccgcgcggtcgtcgcctcccggcctggccatggactggcgggaagagggagcagggcgcccgggctgctcgggcccctagccgggcgctccctcgccaccggccccgctgcgggcctctaggggactgagacggtctcttgttcgcctggacggcgccggggagcggaggatctgcgctccgggtctccaggatgtgcccgtctgagatggggacgctgtggcaccactggtcgccggtactcatcagcctggccgccctgttttccaaagtgacggaaggtcgagggatccttgagagcatccagaggttttccttgctgcccacctacctccccgtgacctaccacatcaacaacgcggacgtctccttcttcctgaaggaggccaaccaggatatcatgaggaactccagcctgcagtcccgggtggagtcatttctgatttacaaatccaggaggctgcctgtcctcaatgccagctacgggcctttctccatcgagcaagtggtgccccaggatttaatgctaccttccaacccatttggattcaccaacaaattttctcttaactggaaactaaaagcccacatcctgcgggacaaagtctacctgagccggcccaaagtgcaggttctgttccacatcatgggcagagactgggacgaccgcagcgccggggagaagctgccgtgcctgagggtctttgctttccgagagacccgagaggtgcggggcagctgccggctgcagggggacctggggctgtgcgtggccgagctggagctcctgtccagctggttcagcccccccacggtggttgccgggaggaggaagtccgtggaccagccggaggggacccccgtggagctctactacaccgtgcacccagggggtgagagaggggactgcgtcagggaagacgcgaggagaagcaatgggatccggacaggccacagtgacatcgatgagtccgggccccccttgcagaggatcgggagcatcttcctttatcagacacacaggaaaccctccctgagagaactgcgtctggacaacagcgtggccatccactatataccaaagaccgtgaggaaaggagacgtgctgacttttcctgtttccatctccagaaattccactgaagatcgcttcacgttgagggcaaaggtgaagaaaggcgtgaacatcatcggcgtgcgagccagcagcccttccatttgggatgtcaaggagcgcacggattatactggaaagtatgcaccagctgtcatcgtttgtcagaagaaagcagctggctcagaaaacagtgcggatggcgcctcctacgaggtcatgcagatcgatgtggaggtggaagagcctggtgacctgccagccacacagctggtcacgtggcaggtcgagtaccccggagagatcacgtctgacttgggagtgtccaagatctatgtgagcccaaaggacttgattggagttgtgccgctggctatggaggcagaaatcctgaacacagccatcctcacggggaagacggtggccgtcccggtgaaagtggtctccgtggaggacgacggcacagtgacagagctgctggagtctgtggagtgtagatcgtctgatgaagacgtgattaaggtttctgacagatgtgactacgtctttgtcaatgggaaagaaatgaaaggcaaggtcaacgtggtggtgaacttcacctaccagcacctgagcagccccctggagatgacggtgtgggtgccccggcttccgctgcagatcgaggtctccgacaccgagctcaatcagatcaagggttggagagtgcccatcgtctccagcaggaggcctgccggggacagtgaagaggaggaggatgatgagcggaggggccgcggctgcaccctgcagtaccagcacgccatggtgcgggtcctgacgcagtttgtggctgaggcggccggccctgggggacacctggcccacctgctgggctcagactggcaagtggacatcacggagctgataaatgacttcatgcaggtggaggagcccaggatcgccaagctgcaaggcggacagatcctgatggggcaggagcttgggatgaccaccattcagatcctgtctcctctgtcagacaccatcctcgctgaaaagaccatcactgtgctggacgagaaggtgaccatcacagacctcggggtgcagctggtgacagggctgtcactctccttgcagctcagcccaggaagcaacagggccatctttgccactgcagtggctcaggaacttctgcagaggccaaaacaggaagcagccatcagttgctgggtccagttcagtgatggctcagtcacgcccttggatatttacgatgggaaagacttctccttgatggccacatctttggatgagaaggtagtctccatccaccaagaccccaaattcaagtggcctatcattgctgcggaaacagaaggacaaggcaccctggtcaaggtggaaatggttattagtgaatcctgccagaaatccaagcggaagagtgtgttagctgttggaacggcaaacatcaaagttaaatttggccaaaacgatgctaaccccaacaccagtgacagcagacacacaggggcaggggttcacatggaaaacaatgtcagtgacagaaggcccaaaaaaccctcgcaggaatgggggagtcaggaaggacagtactatggcagttcttctatgggactcatggagggacggggcaccacgacagacaggtccatcctgcagaagaagaaaggccaggaaagccttttagatgacaacagccacttgcagaccatccccagcgacctcaccagcttcccagcccaggtggacctccccagaagcaatggggaaatggatgggaatgaccttatgcaggcatccaaagggctgagcgacttagaaattgggatgtatgctttgttgggagtcttctgtttggccattttggtcttcttgataaactgtgtgacctttgcattaaaatacagacacaaacaggttcccttcgaggagcaggaagggatgagtcactctcatgactgggttgggttaagcaaccggacagagctgttggagaatcacatcaactttgcctcctcgcaagatgagcaaatcactgccattgacaggggcatggatttcgaggaaagtaaatatctcctcagcacaaactcccaaaaaagcatcaatgggcagctgttcaaacctttgggacccatcatcattgatgggaaagatcagaaaagtgagcccccaacatcccctacctcaaaaaggaaaagggtaaaatttaccaccttcaccgccgtctcctcagacgacgagtaccccaccaggaactccatcgtgatgagtagcgaggatgacattaagtgggtctgccaggatctggaccctggggactgcaaagagctgcacaactacatggagaggttacatgaaaatgtgtaagccagacacacacagacattggttctcactcacctttcagcctttaattccaggatgtgtagcaacggtgcccccggaagagaaacaaagcagcaggacaaaataaggatgacactatccatacagcctcagccaatgaccccggctcggcggcgaggcctggagtccgcatcgacgcacacattccagagtacagtgtcttgcttaagaggtttatcatgcatggcaagatttttaagacttgaaacaaaaacgagttctgaatcactgagcgtctgagagcgtccaggaaagaacagcctctctctctcgaatcaaagcaatttggatattgtaaaatccacatggctccaatattcaatattgcagactatggaagaaaagtacaactcaggtggagcatccatggatcgcatccatggatcaatgggaggaagcgtgtcatcgaaactggagcagcacatcttgctgtgagcgcgatcacaggcagtccagtgccgccgtcagctgtgggaggcatgattgtgagtcattgtctctcaaaggctgggccagagctgtctcagatcatggacaggccaaggaagtggctgacaaggactgaaagggaacatgtgggctaacaggccacaaatacctttgtaactacatgccaaggacaaacacatggacgcaaatcctctgagcccttcagggtacttctttatttgtaaactaaggatactgggcatagaatttgaatcaggttcaaagaaccacgctcttttgattcatatcaagttcacaatgtatccatttctattcctccactgcattgccatcctccccaaagccgttggtcacctgtgggtgggggagggagagggcagtttgtagtatttgctgggtcttttttctccccctgggttttgtgtcaactcccaagtgacattctgtagagaagctccccccgcaacctgggcatatgtcccacgccgtccgtctttgaagaggctggtctctaggcatgggcggtagtcacggtgaattccataccaggggatatacattcccttgctttactagaaagaaaacagggccacttgggatgggtctttcactgttcatggcagatctcctgtccaaagatgtggcctcgaggctgttgagacaaatcggggtgcctgtgtggaacgtgcagggcgtgtggagttgggggggttctgggtgtgaaagtggtggatccagcaggaagcccagcctcacacacaccggacagcacagaaaccttcttcatcttggaggtgcgaagggataaggggcatcagtgcatgtggtgaagatgcaggtttgcaagcacttggtcctgcagtcagccccgaaaggttcagcattgcttaagaccagccatgactctggatatccctgaatcccttcacttatgaagcctatgaagatgggggcaaggatacatcagagaattcctgcctcatctcacgctcactccaaggtagagaatggtgtgttgggtgattgccagccagataggatcctgcaaaagatggtcgggggcagcgggtggtgggcagaagaggccgtgctgttgaattgatcttctatttttccctctggtcattttctctctctctctgctcttcagttgtctgttttccagtctctctgtgtgtctgtctctgtatctctctcctcctttgaacctatcttctccctgcttcctctccatctcatctctgtaattttgagtgtgtgtctttactccttcttcctctccatagaattgaattctctttagatcatgtgtgtgtaaatttcaccagtttaccctcccaaccttagccctctcccctgcaactgtggtgctcttgagactgaggtttctgcagccagtaagtcacctgctcctgtccgcaagcttacctaccttgtttggttgggtgattaagctgtcaccccttttcaatgagaatcctttgctttcagtaacgtcctcatatttctttccattcttacctgtgtcatgttctgttgaatactgcagccgctgcccgcttccaaatccatctgcgtgtagaatgtactgtagattgtaagaatgtaatatatatttataaacttactgactgtaaatataaagtttgcattcagtggc

SEQ ID NO: 21680 - DNA, 5631 bp, Homo sapiens
  ENST00000321639
gcgcgccaagctcggcgcccgcttctgcccgggtgggcgctgaatcccggacggaggaggagggcgggcgagcgcgagtgtgtgtgtctctctcgagtcatttacggcggagcagccggcgcgagcgccgaggaggcggcgacggcggcggcggctgcttcgtgcaactgtggcttcccccacctcctcttcctttttgctcctcgattcttcttcttcccccacacacgtccatggggagccggctcccctgccagcacctcctctcctctcggccccgtaggcaccagctgccgcttccctggccgcaagctgcgcaggtgccggctgccctggcccctggcgccgcgcccgcgtctcaccgcccgcagcccggactggcgcggcgatccgctcgcccaaactgactcggagggagcgggagccgatgcccggcagcatcgagacagcgggcgaacgggcgtccggggacagggtgggggcggcggggaggaggcgtcggagactctgaaccccagaaaagttcaaggtttgtgcaggttcccccagggaaggcgaggagcgaggcggggcagcgcgcctctctgccgagacagcgagaccttagcggggtggcccggagctgccgtgagctgcaggagcccctctgcatcttacagcgtttatggtcatcaagctggagtcgacgtcctgggcaggaagggctcggggcagggcgcattagccggctttctcgctccctcgcttctccaagccccatctacatggggcagcccgttctggccgcgccacccttgccccagccgccgagcggctgcctgggcaggaggcgctgagccggcctgtgtggagcctgggccctgatccagactggagaaagcgcgctggagcggaggagcgagccttgcgaggggacaaacatctggccgcccgcctcgggcatccggtctgggcgtcgcctagggtggtggcgaccggcgtcgccagtttcagcaccgcacggaaacttttccttctccagatggattaaagttgtctggattttctctttctttgagaaagacagcattcatttgcacctgacctgggatttttatgctgggctgctgcaggggcttggaggaagaaagcggcgctatccatgtgcggttactaccgaaaccgaggaaactggggattgcgttggaagtcggcaccctcgagtgagttcggattcgagctgggccgtgaggccgggagattcagcactgggctctaggtagcccccgggacgcccgcggccaccgggctccggactgcacgtgcagctccccccgcgcctcgcagatcctgcagggggcaccagctgggggaggtggaggctcctcccgcccggagctgcgcccccaccggctccgagggtgtagccgccagcgcctgggacgccccctccccgcaaagtgtccccgaattgcactctctggtcccggagctgcatctgagacagccgggcgccacggcagccctgagttggatgtgaccaagcccagcctggggccaagtcgtcgtcgactgttgctctctcggacccctcccgcccccgcctcggccatggccccggggatgtcgggccgcggcggcgccgccctgctctgcctctcagcgctactcgcccacgcctctggccgctcccacccggccagccccagcccgccggggccgcaggccagcccggtgctgccagtcagctaccgcctgtcgcacacgcggctggccttcttcctgcgggaggcgcggcccccgtcacccgcggtcgccaacagctctctgcagcgctccgagcccttcgtggtgttccagaccaaggagctgccggtcctcaacgtctctctggggcccttcagcaccagccaggtggtggcgcgggagctcctgcagccgtccagcaccctggacatccccgagcgcctgacggtgaactggaaggtgcgggccttcatcgtccgctcgcacgtgcccgcctcgcagcccgtggtccaggtgctgttctacgtagccggccgggactgggacgacttcggcgtcaccgagcggctgccctgtgtccgcctgcatgccttccgggatgcccgggaacaccccctgctgcgcatcgggagcatcagcctgttccgcccgccccccaggaggaccctgcaggagcacaggctggacagcaacctgatgatccgcctgccagaccggcccctcaagcccggggaagtgctcagcatcctcctctatctggcccccaactcctcctcgccctccagccccagcgtggagcacttcacactcagggtgaaggccaagaagggtgtgacccttttaggtaccaagtcacggagtggccagtggcatgtgacctcggagctgctgactggggcaaagcactcaacagccaccgtggatgtggcctgggctcagagcacacccctgccccccagggagggccagggccccttggagatcttgcagctggactttgaaatggagaacttcaccagccagtcagtcaagcggaggatcatgtggcacattgactaccgtggccacggcgccctgcctgacctggagcgggcagtcactgagctgacggtcattcagcgggatgtgcaagccatcctgcccctggccatggacacagagatcatcaacacggccattctgactggccggacagtggccatccctgtcaaggtcattgccatcgaggtgaatggcctcgtcctggacatctccgccctagtggaatgcgagtctgacaatgaagacatcatcaaggtatccagcagctgtgactacgtgtttgtgagtggaaaagagtctcgagggtccatgaacgccagggtcaccttccgctacgacgtcctcaatgctcccctggaaatgacagtctgggtccccaagctgcccttgcacattgagctctcagatgcccgcctcagccaagtgaagggctggagggtacctatcctccccgaccggaggtcagtccgggaaagcgaggatgaggatgaggaggaggaggagcggcggcagagtgcaagccgtggctgcaccctgcagtaccagcatgccaccctgcaggtcttcacccagttccacacgacatcatccgagggcactgaccaggtggtcaccatgttaggcccggactggctggtggaggtcaccgacctagtcagtgacttcatgcgggtgggcgatccccgagtggcacacatggtggacagcagcacgctggcaggactggagccaggcaccaccccctttaaggtggtgtctccgctgacggaggctgtgctcggggagacgctgctgacggtgactgaggagaaggtcagcatcacacagcttcaggcccaggtggtggccagcctggccctctccctgcggcccagccctgggagcagccacaccatcctagccaccacagctgcccaacagaccttgagcttcctcaagcaggaagccctactgagcctctggctctcctacagtgatggcaccacagccccactctccctctacagcccacgagactatggactgctagtgagcagcctggatgagcatgtggccactgtgacccaggaccgggccttccctctggtagtggctgaggccgaggggtcaggggagctgcttcgcgcagagctaaccatcgctgagagctgccagaaaaccaaacgcaagagtgtgctcgccacgacccctgtgggcctgcgggtgcactttgggagggacgaggaggaccccacttatgactacccgggccccagccaaccagggcccggcgggggcgaggacgaggcccggggagctggcccgccgggctctgcgctacccgcaccggaggctccaggcccgggcaccgccagccccgtcgtgccacccacagaagacttcctgccgctgcccaccggcttcctgcaggtgccacggggtctgacagacctggagatcggcatgtacgcgctgctgggcgtcttctgcctcgccatcctcgtcttcctcatcaactgcatcgtttttgtgctgcgctaccggcacaagcgcatcccgcccgagggccagaccagcatggaccactctcaccactgggtgttcctgggcaacgggcagccgctgcgggtgcaaggagagctgtcgccgccagcaggcaacccgctggaaaccgtgcccgccttctgccacggcgaccaccacagcagcggcagctcgcagaccagcgtccagagccaggtgcacggcaggggcgacggctcctcgggcggctcagcccgagaccaagccgaggaccccgccagctcgcccacctccaagcgcaagcgggtcaagttcaccaccttcaccacgctgccgtcagaggagctggcctatgactcggtgcccgcgggcgaagaggacgaggaggaggaagaggacctgggttggggctgcccggatgtggcgggccccacgcggcccactgcacccccggacctgcacaattacatgcgcagaatcaaagagattgcatagaggcgccagccggagtagcagggacccccccccccaacggggtcagctcggggtaggacacagccgggaccccggttcacactgactctgggcggctgaattgattttgtactccctgcccctgcagcttggctccgtgcggagcgggccgcctcagtgtctgggccttccctcgcctcacgccattaccctcttctgccccctgcaggtggagggctcttcctccagtggctcgtaaggaggaaagcaaccccagcctctgttctgccctttccaaacctcctcccatcttaagcaaccccctgccccaagagtgaggcaaggaggtccagcttggggtcaggtgggcccacgctgtgtcccgggcccgcctcccgtcccccgtgtcgtccccctgtgcagggggttctgtgggggtcttgtgtcacaggctgcacaaagactttcctcaaactaatattcagggatttctgtcctgcagggtggggaggtggcagctgcctgccctgccaaggatcttgctgtggacgaaatatctgggggttagggggacagttgtagcatctgctggcattcgggtgcctcccaggacctgggagctgactctacagagaggtctggtgccaagccaggcaccttcctgagttctcaggactcccacctctgccccaagggctttgggcagggacctaaaggggaaagagtcctggatccatctctagccaaatcacaccccagagccagaggcctggggacctccttgccttccccgtcccccacagcaaggtcaacactactacgccttagccacccgtcaccctgctgactgcgacttccctctgcagcacagggcaggcagccacctatgccccacaagacggaacccgggaggggagtagagggcaccagggaatgctgtgagggacttcagggtgggcaaatgcagaagggagccagtgtcgcccctaccccatcccacagccatttttctctcgggttctacccaccactgtgtcggatttttcttaaataaatggaagcggtcagactggaggtgggggcagcagctcccatgaacagagagta

SEQ ID NO: 21681 - DNA, 4379 bp, Homo sapiens
  ENST00000631683
agcccagcctggggccaagtcgtcgtcgactgttgctctctcggacccctcccgcccccgcctcggccatggccccggggatgtcgggccgcggcggcgccgccctgctctgcctctcagcgctactcgcccacgcctctggccgctcccacccggccagccccagcccgccggggccgcaggccagcccggtgctgccagtcagctaccgcctgtcgcacacgcggctggccttcttcctgcgggaggcgcggcccccgtcacccgcggtcgccaacagctctctgcagcgctccgagcccttcgtggtgttccagaccaaggagctgccggtcctcaacgtctctctggggcccttcagcaccagccaggtggtggcgcgggagctcctgcagccgtccagcaccctggacatccccgagcgcctgacggtgaactggaaggtgcgggccttcatcgtccgctcgcacgtgcccgcctcgcagcccgtggtccaggtgctgttctacgtagccggccgggactgggacgacttcggcgtcaccgagcggctgccctgtgtccgcctgcatgccttccgggatgcccgggaagtcaagagctcctgccgcctcagcgggggcctggccacttgtctggtgcgggcagagctgcccctggcctggttcgggcccccagcccccgctgcgccacccacggcccgccgcaagtccccggacgggctggagcccgaggcgacgggggagagccagcaggccgagctctactacacgctccacgcccctgatgcgtcggggggctgcgggggctcccgccggggggccgggcccggggtgggggcccgagcggaaagccctacccagcaccccctgctgcgcatcgggagcatcagcctgttccgcccgccccccaggaggaccctgcaggagcacaggctggacagcaacctgatgatccgcctgccagaccggcccctcaagcccggggaagtgctcagcatcctcctctatctggcccccaactcctcctcgccctccagccccagcgtggagcacttcacactcagggtgaaggccaagaagggtgtgacccttttaggtaccaagtcacggagtggccagtggcatgtgacctcggagctgctgactggggcaaagcactcaacagccaccgtggatgtggcctgggctcagagcacacccctgccccccagggagggccagggccccttggagatcttgcagctggactttgaaatggagaacttcaccagccagtcagtcaagcggaggatcatgtggcacattgactaccgtggccacggcgccctgcctgacctggagcgggcagtcactgagctgacggtcattcagcgggatgtgcaagccatcctgcccctggccatggacacagagatcatcaacacggccattctgactggccggacagtggccatccctgtcaaggtcattgccatcgaggtgaatggcctcgtcctggacatctccgccctagtggaatgcgagtctgacaatgaagacatcatcaaggtatccagcagctgtgactacgtgtttgtgagtggaaaagagtctcgagggtccatgaacgccagggtcaccttccgctacgacgtcctcaatgctcccctggaaatgacagtctgggtccccaagctgcccttgcacattgagctctcagatgcccgcctcagccaagtgaagggctggagggtacctatcctccccgaccggaggtcagtccgggaaagcgaggatgaggatgaggaggaggaggagcggcggcagagtgcaagccgtggctgcaccctgcagtaccagcatgccaccctgcaggtcttcacccagttccacacgacatcatccgagggcactgaccaggtggtcaccatgttaggcccggactggctggtggaggtcaccgacctagtcagtgacttcatgcgggtgggcgatccccgagtggcacacatggtggacagcagcacgctggcaggactggagccaggcaccaccccctttaaggtggtgtctccgctgacggaggctgtgctcggggagacgctgctgacggtgactgaggagaaggtcagcatcacacagcttcaggcccaggtggtggccagcctggccctctccctgcggcccagccctgggagcagccacaccatcctagccaccacagctgcccaacagaccttgagcttcctcaagcaggaagccctactgagcctctggctctcctacagtgatggcaccacagccccactctccctctacagcccacgagactatggactgctagtgagcagcctggatgagcatgtggccactgtgacccaggaccgggccttccctctggtagtggctgaggccgaggggtcaggggagctgcttcgcgcagagctaaccatcgctgagagctgccagaaaaccaaacgcaagagtgtgctcgccacgacccctgtgggcctgcgggtgcactttgggagggacgaggaggaccccacttatgactacccgggccccagccaaccagggcccggcgggggcgaggacgaggcccggggagctggcccgccgggctctgcgctacccgcaccggaggctccaggcccgggcaccgccagccccgtcgtgccacccacagaagacttcctgccgctgcccaccggcttcctgcaggtgccacggggtctgacagacctggagatcggcatgtacgcgctgctgggcgtcttctgcctcgccatcctcgtcttcctcatcaactgcatcgtttttgtgctgcgctaccggcacaagcgcatcccgcccgagggccagaccagcatggaccactctcaccactgggtgttcctgggcaacgggcagccgctgcgggtgcaaggagagctgtcgccgccagcaggcaacccgctggaaaccgtgcccgccttctgccacggcgaccaccacagcagcggcagctcgcagaccagcgtccagagccaggtgcacggcaggggcgacggctcctcgggcggctcagcccgagaccaagccgaggaccccgccagctcgcccacctccaagcgcaagcgggtcaagttcaccaccttcaccacgctgccgtcagaggagctggcctatgactcggtgcccgcgggcgaagaggacgaggaggaggaagaggacctgggttggggctgcccggatgtggcgggccccacgcggcccactgcacccccggacctgcacaattacatgcgcagaatcaaagagattgcatagaggcgccagccggagtagcagggacccccccccccaacggggtcagctcggggtaggacacagccgggaccccggttcacactgactctgggcggctgaattgattttgtactccctgcccctgcagcttggctccgtgcggagcgggccgcctcagtgtctgggccttccctcgcctcacgccattaccctcttctgccccctgcaggtggagggctcttcctccagtggctcgtaaggaggaaagcaaccccagcctctgttctgccctttccaaacctcctcccatcttaagcaaccccctgccccaagagtgaggcaaggaggtccagcttggggtcaggtgggcccacgctgtgtcccgggcccgcctcccgtcccccgtgtcgtccccctgtgcagggggttctgtgggggtcttgtgtcacaggctgcacaaagactttcctcaaactaatattcagggatttctgtcctgcagggtggggaggtggcagctgcctgccctgccaaggatcttgctgtggacgaaatatctgggggttagggggacagttgtagcatctgctggcattcgggtgcctcccaggacctgggagctgactctacagagaggtctggtgccaagccaggcaccttcctgagttctcaggactcccacctctgccccaagggctttgggcagggacctaaaggggaaagagtcctggatccatctctagccaaatcacaccccagagccagaggcctggggacctccttgccttccccgtcccccacagcaaggtcaacactactacgccttagccacccgtcaccctgctgactgcgacttccctctgcagcacagggcaggcagccacctatgccccacaagacggaacccgggaggggagtagagggcaccagggaatgctgtgagggacttcagggtgggcaaatgcagaagggagccagtgtcgcccctaccccatcccacagccatttttctctcgggttctacccaccactgtgtcggatttttcttaaataaatggaagcggtcagactggaggtgggggcagcagctcccatgaacagagagta

SEQ ID NO: 21682 - DNA, 736 bp, Homo sapiens
  ENST00000577271
gcctggctcctgtgagcccccgaccctctcatgacctctggacactggttcctggttgcagacctgaggcagagctgcgaagtcctgcctcccagcctgcctcacccttcaggcccctcttccagcagtgctgggatttctccctagctgggggtcttgggcaggggggtgtgctttcctggttctctcccaccccggtcccgctctgcctcaggtggtgtctccgctgacggaggctgtgctcggggagacgctgctgacggtgactgaggagaaggtcagcatcacacagcttcaggcccaggtggtggccagcctggccctctccctgcggcccagccctgggagcagccacaccatcctagccaccacagctgcccaacagaccttgagcttcctcaagcaggaagccctactgagcctctggctctcctacagtgatggcaccacagccccactctccctctacagcccacgagactatggactgctagtgagcagcctggatgagcatgtggccactgtgacccaggaccgggccttccctctggtagtggctgaggccgaggggtcaggggagctgcttcgcgcagagctaaccatcgctgagagctgccagaaaaccaaacgcaagagtgtgctcgccacgacccctgtgggcctgcgggtgcactttgggagggacgaggaggaccccacttatgactacccgggccccagccaaccagggcccggc

SEQ ID NO: 21683 - DNA, 575 bp, Homo sapiens
  ENST00000505049
agtgacattccatgagacaagcagtcctgtggtgaggcccatgtcaagaaggcctgagatctcccaccatcagctacagccaatttgtcagtcacagatcctcaaaatgagcagcagatacactcagtctgtaggatcatttagcaactcggggaaggaggtcataggttagcttttcaagacacttcctgcatctctgacctgttgcacctctgttatcttggcacctctgttatcttagcagcaagcacctgcctcagctgacccttgagccataacccataagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacag

SEQ ID NO: 21684 - DNA, 764 bp, Homo sapiens
  ENST00000505189
agtgacattccatgagacaagcagtcctgtggtgaggcccatgtcaagaaggcctgagatctcccaccatcagctacagccaatttgtcagtcacagatcctcaaaatgagcagcagatacactcagtctgtaggatcatttagcaactcggggaaggaggtcataggttagcttttcaagacacttcctgcatctctgacctgttgcacctctgttatcttggcacctctgttatcttagcagcaagcacctgcctcagctgacccttgagccataacccatagggcttattccaaagggccagtgtgcaaaatatgaatccaagatggcattgtggaaagacgctgtacctcctgtgataaaattactttggtggtgcttttttctcatgtatctcgggaaactaaaaatctgaattgtattcagtggccttttccaaatgaagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaa

SEQ ID NO: 21685 - DNA, 546 bp, Homo sapiens
  ENST00000511038
atgagacaagcagtcctgtggtgaggcccatgtcaagaaggcctgagatctcccaccatcagctacagccaatttgtcagtcactcatcatttctcattatacacagagatcctcaaaatgagcagcagatacactcagtctgtaggatcatttagcaactcggggaaggaggtcataggttagcttttcaagacacttcctgcatctctgacctgttgcacctctgttatcttggcacctctgttatcttagcagcaagcacctgcctcagctgacccttgagccataacccatagggcttattccaaagggccagtgtgcaaaatatgaatccaagatggcattgtggaaagacgctgtacctcctgtgataaaattactttggtggtgcttttttctcatgtatctcgggaaactaaaaatctgaattgtattcagtggccttttccaaatgaagctcctgaaaagtacatcaagtctaaagtgaaccagctaactcattaagactggaatcatgagcaacaatggagcagacctaacctttg

SEQ ID NO: 21686 - DNA, 1070 bp, Homo sapiens
  ENST00000508243
ttttgagccacctgacaattcagtccagcacagcaactgaaggaaggcgttccccaacctgctgtcctatgaaggcctctaggtcaccggtgctaaagccctcctttctccaccctccttaagtggaggtaaacgtcccagcaggaagtcaaggctggattggcgctcttcgcgagcaccctgggaacgggagtctgggtcacgggtgctagagccctcccctctcctcccggccggtgtatgggaaattgtccccgcagaaagtaaaggctggccaggccgcccccagcacgtagagggaatgagtcaggctccggctccacactggcacgtagtgggcggatcgcgccggcgctgagtaggaaggagcttcagccgccagcccggaacgcagttagcttttcaagacacttcctgcatctctgacctgttgcacctctgttatcttggcacctctgttatcttagcagcaagcacctgcctcagctgacccttgagccataacccataagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaaaccattggtttaggccttggaatcttaatctggggatcatttaatgccttaactggctgggcaagctcaaggtttggctggtttggattggatgcagaagaagtatcaaatccgctgctaaattacattggagctgggctatcagtagtaagtgctttcatatttttgttcatcaaaagtgaaataccaaataacacgtgttccatggataccactccattaataacagagcatgtgatc

SEQ ID NO: 21687 - DNA, 3442 bp, Homo sapiens
  ENST00000296529
aacctgctgtcctatgaaggcctctaggtcaccggtgctaaagccctcctttctccaccctccttaagtggaggtaaacgtcccagcaggaagtcaaggctggattggcgctcttcgcgagcaccctgggaacgggagtctgggtcacgggtgctagagccctcccctctcctcccggccggtgtatgggaaattgtccccgcagaaagtaaaggctggccaggccgcccccagcacgtagagggaatgagtcaggctccggctccacactggcacgtagtgggcggatcgcgccggcgctgagtaggaaggagcttcagccgccagcccggaacgcatcataggttagcttttcaagacacttcctgcatctctgacctgttgcacctctgttatcttggcacctctgttatcttagcagcaagcacctgcctcagctgacccttgagccataacccataagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaaaccattggtttaggccttggaatcttaatctggggatcatttaatgccttaactggctgggcaagctcaaggtttggctggtttggattggatgcagaagaagtatcaaatccgctgctaaattacattggagctgggctatcagtagtaagtgctttcatatttttgttcatcaaaagtgaaataccaaataacacgtgttccatggataccactccattaataacagagcatgtgatcaacacaacccaagacccctgttcctgggtggataaactttctacagtacaccaccgcatagtgggctgcagtcttgcagtgatatctggagtactctatggatctacatttgtgccaatcatctacatcaaggaccacagcaaaagaaatgatagtatatatgcaggggcaagccaatatgatttagactatgtgtttgcgcacttcagtggcatctttcttacaagtactgtctactttctggcctactgcatagccatgaaaaatagtcctaaactatatcctgaagcagtcctaccaggattcctgtcaggagtactttgggctatagctacctgctgttggttcatagcaaatcactctctgagtgctgtggtcagttttccaataatcactgctggtccaggatttatagctgcaatgtggggtatcttcatgtttaaggaaataaagggtctacaaaactacctattaatgatacttgcattttgcatcatcttgactggagccttatgcactgctttttctaaaatctaacaatgacaaaaccagcaggtggcagcagtagttaagagaacgcgtctatcggacagcggagagatcatgctgagaaaagagtgcattttcatatagcaaatggatctcagccactgttggagtgggtaaatgatttttttccccaaaaatgtgagaatgaaggaagattgagtttcattcaagtataaaaatgaaaatttcttctgatgaactgtttatgaaggtagtactttactgggtgactaaaatgtctacattattatagcattacatacgaggatgctctttttaccacagtatgtacctagtgttgcataatctagaacacagtatagagtccatatacaaagaagttacagtccatatttctcacctattaccccagtgaagtgaggcagaaataccttgggcgaggagggagagccttaccttctaatggaattagattccaaagatatttggatcctttgtttcataaagtaaatgcatagttggtaactaaatgttaaaaaggccattttattattgttagccaaaacttctgtttatttcaagttaatatcgcccaactctacatcatctacccattttagctcataatgcttttgattatcgccagataaagtccattctcagagaacaaaaatttttcatcattgagaaaatgtgcataacataatacatacatacacaagtatattcacgtacataaatacacacagatatgttgctaaagtgagattgtaggttatcagtaacaatttaaaggaaacaaccactcttttgaatgtacaacttttttttctgaaatacacttttctaaaaccctcttaactggaggtttcctgttttcttcttgttttaactggtggtttccagtaggcaaaataaaatgacaggcatgctagttttttttttttttttttttttttaagaaaactgaaattaagccaggcagggtggcgcactactataatcccagctgctggggcggctgaagtaggagggtcacttagcccaagagtgcaaatctgccagcctaggcaacatagcaaggtcccatctctaaaaaagaaatttaatttaaatttgtaagaaaaaagaaaactgaaacagaactgccagtacaatgtttgttgcaattgtttccaaaactttgagataacgaaacccctattcaaatgtaaattttacccattcccacctgatagtactgtttattactttgctatgcaggagaaacaaaacagctttttatttgtgtgtatactctgaagtcaatgtgcatgggttaaatcccacctctgcttcattttatttgtgtggctttggacaagttcctaagccctctgtgtcaggcccctcattaacaaaatggagtttatgatggcatctacctcacatggttattgtgtggttgaaattagttcaaatctgtaaagtatgttgatgagtatctggtacttggcaaacactatataattgttagctttattattatgtgttgtttgaaggggaaaaaagtttttgtagattggagaacaccatgtaagagctactaagctcaccaccttcccatccaaacaattattactcctctaaatgaatactacttaaaagtgatggagcttctgtttgtttattgaattgctaatacaaataaatatttgactataacttcttatactcattttaattttaacctgaaatgtcattaaattatgctgataaactttgaataaattgtgatacaaaagctatttttctcatttaaatatattttagaattttatattggataacttttaattattctttagttgggatttccaatttatatgcaaaattttaaatgtgaagtaaagcagtttcagaagaaaaatg

SEQ ID NO: 21688 - DNA, 731 bp, Homo sapiens
  ENST00000512481
aaaggctggccaggccgcccccagcacgtagagggaatgagtcaggctccggctccacactggcacgtagtgggcggatcgcgccggcgctgagtaggaaggagcttcagccgccagcccggaacgcatcataggttagcttttcaagacacttcctgcatctctgacctgttgcacctctgttatcttggcacctctgttatcttagcagcaagcacctgcctcagctgacccttgagccataacccatagggcttattccaaagggccagtgtgcaaaatatgaatccaagatggcattgtggaaagacgctgtacctcctgtgataaaattactttggtggtgcttttttctcatgtatctcgggaaactaaaaatctgaattgtattcagtggccttttccaaatgaagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaa

SEQ ID NO: 21689 - DNA, 576 bp, Homo sapiens
  ENST00000504569
acgtagagggaatgagtcaggctccggctccacactggcacgtagtgggcggatcgcgccggcgctgagtaggaaggagcttcagccgccagcccggaacgcaaagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaaaccattggtttaggccttggaatcttaatctggggatcatttaatgccttaactggctgggcaagctcaaggtttggctggtttggattggatgcagaagaagtatcaaatccgctgctaaattacattggagctgggctatcagtagtaag

SEQ ID NO: 21690 - DNA, 1633 bp, Homo sapiens
  ENST00000509278
cgtagagggaatgagtcaggctccggctccacactggcacgtagtgggcggatcgcgccggcgctgagtaggaaggagcttcagccgccagcccggaacgcatcataggttagcttttcaagacacttcctgcatctctgacctgttgcacctctgttatcttggcacctctgttatcttagcagcaagcacctgcctcagctgacccttgagccataacccataagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggtaattatttttccttgattgttaacgttatattatttttaaaaatgaagttccttttttggtcttttaaaagtatagctacaaaaataaatcatgttgatcttgatacctagtgaatagagcttaaaattagtcatttgacagtgctcataccagtttgtctgaaagtcagaataggagaaccattaaggttgtttcatggtaaagttagggagggtacagtcaggaaatctcttgggccattatatgaatggaagaaatttatagtcagttctactataacacctgttttgaaaacatgaatcttcaacatgattgatatattagagaacaatgtaagcataacagatttttggcttgcttatgtgcaattttgtccctgagaaacctctagataggcacagaagactgcacctagatgaataaagatgtgtgataatacacataatgcacgcagacacacgtacaatcttcaaatatcgaccagctcccttagttcatcacatgtggttatgatgtattccacccaaccacatctcctgtcccaactcctcacccaataccttcacagtaactcgtaagctgcaaccctttggatgctcacttccaggagcaaacttctggtgtttttcaattaaaatgccctatttattacagcatcatgtaattaaccagttaaccagttaaaactgtactactattttaattaggttgagtgttgttctcctagccccattttcccattatgctctgtagtttttactgcatgattttgcatagtgcagtgatttcaaggaatgcacatgttacattatagcagaactgactaatgtgaattttggggaaggagaagcaagagttatttgtatttgcctgacttccatattaaagccaggagaaggaattgagatttatggtgaacacatgttgggaattacttccttggtagtatttatcacctgacagcagttgtgttatttccccaattctttgtcttcgtgcacttagaaaataggattacctcctattttcctccagggcctttcttctcttttcctctggagttaggacaagaatgggaactacccgaagaacaaaaaaatgggtagaggatctagcttttttagtcttccacaattagctttgtgatcctgggcaaatattaccagctctgctgttttcagtttctcatttgtaaagtgaacaacttataaaatgaagtttcttttcatctctgtga

SEQ ID NO: 21691 - DNA, 3699 bp, Homo sapiens
  ENST00000514558
cgtagagggaatgagtcaggctccggctccacactggcacgtagtgggcggatcgcgccggcgctgagtaggaaggagcttcagccgccagcccggaacgcagtgagtacagccactcaaaggaaagccaagtcgctttgcaggggagcgtctcatgatttttcagaaacgtgctcatggttaaaaagaaaaatcaaggctcggaataaatacattcaagcactgttaattttagcccaaagacaggcggtacttgcctggagatttgggaaaatcaacatgaaactaaaaatgaaattttagttggagtggagcaagcagtattgatcagaacataccaaatacgaattttttcaaagtctgcgtagaagtttaaattactaggaaaaatgtaaaggagaagtatttactaataaatgaaacaaaagtaataaaataaaaatgaattaatatagtttgacaaaatatcagcgaacgctgaaaagaaaacattaaaataatgtttgagactttttaggttttgtgcaggaagaattgggaaaaatgtgctggatggagtgatactgcttttcttttccacaaaaatttcattattttagagagcggtagagcctttttaaagacagtaagttattgccaattcacaatgaaataagatcacatgctctgaaatgtacaagagctgcatgcaataaacttcatttatctataggtaataactgattgatgtttattcagtagtcgaaatgcacctcatgcactctaattagcacgtcaaattagtctctccgtttcagaggtgtagggcctttgtggagccttctcaataaaataatttgccactcttgaaggttagacattctcttctatcaatgtacacataaaggttttgttttgctttgcttgttgtgaattaaaatggggagaaaatgatgtgttagctatcacccagtcatgtgtctttttagtcataggttagcttttcaagacacttcctgcatctctgacctgttgcacctctgttatcttggcacctctgttatcttagcagcaagcacctgcctcagctgacccttgagccataacccatgtaagtcactgcagggctgaacctctctttgagcctaacagtagaataataattatttttattgaatagtgttaatgtgtcaatgttgaaatgtgcctcagtgtgtcttcctcaaccacatccctatagaggatgttttcttaatagcaatgtgtttttgttttaagaaagtccacacaatttcaaatacacattttctttactaaagtttattgaccagttttgaagtgatccttgttttcagttaaactatctttaataatggtaaataacatattttgtaggttgttgtatatttaatattctctgcaagaacacataaggaacaatacatggacctttaaatatttgtcattgtgaaataaaataacaaggaaaggtgatttcaggtgtactttattcaatacatatatacaagaagttattactataacattaaatttgcaggaaaaaagaaaccactggattattctgcttctattccagagggcttattccaaagggccagtgtgcaaaatatgaatccaagatggcattgtggaaagacgctgtacctcctgtgataaaattactttggtggtgcttttttctcatgtatctcgggaaactaaaaatctgaattgtattcagtggccttttccaaatgaagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaaaccattggtttaggccttggaatcttaatctggggatcatttaatgccttaactggctgggcaagctcaaggtttggctggtttggattggatgcagaagaagtatcaaatccgctgctaaattacattggagctgggctatcagtagtaagtgctttcatatttttgttcatcaaaagtgaaataccaaataacacgtgttccatggataccactccattaataacagagcatgtgagtatagtatgagagacaacttgatttgaaacataaaattaagataaatggataatacataaattttaaacacagatgaaaaagtggtgtttgctcatcactcctggctatgtaaaatatcttagcttatttattatgggtaggtctatgtagcaatcaatcaatatttccgcagttgagcttctcagcaagcacacgggtttatttattttgattaacagatctctactaggtgatatatatataaccccatttttgtaatgatttaaagattcctacaatagaggaaccctaaatactgtagaggaatgtgaaaataactttagaaagtcagaggaaggaggttttgaagttggtccaggggagaatagaccataggaggccaagaaaggtaagtgaagtcctatgagaataggaactggtatcccattctacccgaagtgaaaaacagaaaatatgataggagtcactgttttgatcttgaagaatctaaatcagtctggaatagtaaatctgaatgaaacaggagcaacttttaaaagggacctgataaagcgcaagtgtcagtagctacatatacaaaagtgacttcagggcaaagcctcattgtcatgaacccaggctctaatccttctcatctcaagaaatctctcctgtctgccctgggccagtgctatccagctgccctctgaatccagcgctcctcacccccagtggggtattgccccttggcagggtgcttatttaccccttacttcaaaattaatcttttctcctttccttcttcccctatccaaacttttatcaactaaaaccttagttaaattgacactaaagttgaatagtaattagcttaagtgtaaagagaagaggtttattaatccacaggcatctctaatcagggaaatgtttcagggagaagggaggagttggctttgggaaagggttccttgcctgcttcagggatccagacacctcctgcccaaccatcctccaaaacaatggaacaaaataataaaataaatgcagcttggtaaaagatacacagtaggctaactgcctgagatttttctaggcaataagtttaaagatccataaacagcatgattgatgggtacagaaccatgcatcatgagctccttatgatgaaagaaaccgttattgccaaaggaaaacttgacttagcacatgacaaagaattcaaatctactttcttgtctcttacaaaaataataggattataacatcaagaacacttcagttggccaggcgtgatggctcatgcccgtaatcccagcactgtgggaggtcaaggtgggcagatcacctgagttcaggagttcaagaccagcctgtccaacatggtgaaactctatctctactaagaatacaaaaaaaaaaaaaa

SEQ ID NO: 21692 - DNA, 555 bp, Homo sapiens
  ENST00000513744
gtagagggaatgagtcaggctccggctccacactggcacgtagtgggcggatcgcgccggcgctgagtaggaaggagcttcagccgccagcccggaacgcatcataggttagcttttcaagacacttcctgcatctctgacctgttgcacctctgttatcttggcacctctgttatcttagcagcaagcacctgcctcagctgacccttgagccataacccatgtaagtcactgcagggctgaacctctctttgagcctaacagtagaataataattatttttattgaatagtgttaatgtgtcaatgttgaaatgtgcctcagtgtgtcttcctcaaccacatccctatagaggatgttttcttaatagcaatgtgtttttgttttaagaaagtccacacaatttcaaatacacattttctttactaaagtttattgaccagttttgaagtgatccttgttttcagttaaactatctttaataatggtaaataacatattttgtaggttgttgtatatttaatattctctgcaagaacacataaggaacaatac

SEQ ID NO: 21693 - DNA, 303 bp, Homo sapiens
  ENST00000514346
gtagagggaatgagtcaggctccggctccacactggcacgtagtgggcggatcgcgccggcgctgagtaggaaggagcttcagccgccagcccggaacgcacagcaagcacctgcctcagctgacccttgagccataacccatagggcttattccaaagggccagtgtgcaaaatatgaatccaagatggcattgtggaaagacgctgtacctcctgtgataaaattactttggtggtgcttttttctcatgtatctcgggaaactaaaaatctgaattgtattcagtggccttttccaaatg

SEQ ID NO: 21694 - DNA, 535 bp, Homo sapiens
  ENST00000503200
gtagagggaatgagtcaggctccggctccacactggcacgtagtgggcggatcgcgccggcgctgagtaggaaggagcttcagccgccagcccggaacgcacagcaagcacctgcctcagctgacccttgagccataacccataagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaaaccattggtttaggccttggaatcttaatctggggatcatttaatgccttaactggctgggcaagctcaag

SEQ ID NO: 21695 - DNA, 2861 bp, Homo sapiens
  ENST00000511532
ggaaggagcttcagccgccagcccggaacgcatcataggttagcttttcaagacacttcctgcatctctgacctgttgcacctctgttatcttggcacctctgttatcttagcagcaagcacctgcctcagctgacccttgagccataacccataagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaaaccattggtttaggccttggaatcttaatctggggatcatttaatgccttaactggctgggcaagctcaaggtttggctggtttggattggatgcagaagaagtatcaaatccgctgctaaattacattggagctgggctatcagtagtaagtgctttcatatttttgttcatcaaaagtgaaataccaaataacacgtgttccatggataccactccattaataacagagcatgggctgcagtcttgcagtgatatctggagtactctatggatctacatttgtgccaatcatctacatcaaggaccacagcaaaagaaatgatagtatatatgcaggggcaagccaatatgatttagactatgtgtttgcgcacttcagtggcatctttcttacaagtactgtctactttctggcctactgcatagccatgaaaaatagtcctaaactatatcctgaagcagtcctaccaggattcctgtcaggagtactttgggctatagctacctgctgttggttcatagcaaatcactctctgagtgctgtggtcagttttccaataatcactgctggtccaggatttatagctgcaatgtggggtatcttcatgtttaaggaaataaagggtctacaaaactacctattaatgatacttgcattttgcatcatcttgactggagccttatgcactgctttttctaaaatctaacaatgacaaaaccagcaggtggcagcagtagttaagagaacgcgtctatcggacagcggagagatcatgctgagaaaagagtgcattttcatatagcaaatggatctcagccactgttggagtgggtaaatgatttttttccccaaaaatgtgagaatgaaggaagattgagtttcattcaagtataaaaatgaaaatttcttctgatgaactgtttatgaaggtagtactttactgggtgactaaaatgtctacattattatagcattacatacgaggatgctctttttaccacagtatgtacctagtgttgcataatctagaacacagtatagagtccatatacaaagaagttacagtccatatttctcacctattaccccagtgaagtgaggcagaaataccttgggcgaggagggagagccttaccttctaatggaattagattccaaagatatttggatcctttgtttcataaagtaaatgcatagttggtaactaaatgttaaaaaggccattttattattgttagccaaaacttctgtttatttcaagttaatatcgcccaactctacatcatctacccattttagctcataatgcttttgattatcgccagataaagtccattctcagagaacaaaaatttttcatcattgagaaaatgtgcataacataatacatacatacacaagtatattcacgtacataaatacacacagatatgttgctaaagtgagattgtaggttatcagtaacaatttaaaggaaacaaccactcttttgaatgtacaacttttttttctgaaatacacttttctaaaaccctcttaactggaggtttcctgttttcttcttgttttaactggtggtttccagtaggcaaaataaaatgacaggcatgctagttttttttttttttttttttttttaagaaaactgaaattaagccaggcagggtggcgcactactataatcccagctgctggggcggctgaagtaggagggtcacttagcccaagagtgcaaatctgccagcctaggcaacatagcaaggtcccatctctaaaaaagaaatttaatttaaatttgtaagaaaaaagaaaactgaaacagaactgccagtacaatgtttgttgcaattgtttccaaaactttgagataacgaaacccctattcaaatgtaaattttacccattcccacctgatagtactgtttattactttgctatgcaggagaaacaaaacagctttttatttgtgtgtatactctgaagtcaatgtgcatgggttaaatcccacctctgcttcattttatttgtgtggctttggacaagttcctaagccctctgtgtcaggcccctcattaacaaaatggagtttatgatggcatctacctcacatggttattgtgtggttgaaattagttcaaatctgtaaagtatgttgatgagtatctggtacttggcaaacactatataattgttagctttattattatgtgttgtttgaaggggaaaaaagtttttgtagattggagaacaccatgtaagagctactaagctcaccaccttcccatccaaacaattattactcctctaaatgaatactacttaaaagtgatggagcttctgtttgtttattgaattgctaatacaaataaatatttgactataa

SEQ ID NO: 21696 - DNA, 642 bp, Homo sapiens
  ENST00000502698
gtcgaaatgcacctcatgcactctaattagcacgtcaaattagtctctccgtttcagaggtgtagggcctttgtggagccttctcaataaaataatttgccactcttgaaggttagacattctcttctatcaatgtacacataaaggttttgttttgctttgcttgttgtgaattaaaatggggagaaaatgatgtgttagctatcacccagtcatgtgtctttttagtcataggttagcttttcaagacacttcctgcatctctgacctgttgcacctctgttatcttggcacctctgttatcttagcagcaagcacctgcctcagctgacccttgagccataacccataagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacag

SEQ ID NO: 21697 - DNA, 525 bp, Homo sapiens
  ENST00000514971
agtctctccgtttcagaggtgtagggcctttgtggagccttctcaataaaataatttgccactcttgaagtcataggttagcttttcaagacacttcctgcatctctgacctgttgcacctctgttatcttggcacctctgttatcttagcagcaagcacctgcctcagctgacccttgagccataacccataagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaaaccattggttta

SEQ ID NO: 21698 - DNA, 4872 bp, Homo sapiens
  ENST00000503404
gataatacataaattttaaacacagatgaaaaagtggtgtttgctcatcactcctggctatgtaaaatatcttagcttatttattatgggtaggtctatgtagcaatcaatcaatatttccgcagttgagcttctcagcaagcacacgggtttatttattttgattaacagatctctactaggtgatatatatataaccccatttttgtaatgatttaaagattcctacaatagaggaaccctaaatactgtagaggaatgtgaaaataactttagaaagtcagaggaaggaggttttgaagttggtccaggggagaatagaccataggaggccaagaaaggtaagtgaagtcctatgagaataggaactggtatcccattctacccgaagtgaaaaacagaaaatatgataggagtcactgttttgatcttgaagaatctaaatcagtctggaatagtaaatctgaatgaaacaggagcaacttttaaaagggacctgataaagcgcaagtgtcagtagctacatatacaaaagtgacttcagggcaaagcctcattgtcatgaacccaggctctaatccttctcatctcaagaaatctctcctgtctgccctgggccagtgctatccagctgccctctgaatccagcgctcctcacccccagtggggtattgccccttggcagggtgcttatttaccccttacttcaaaattaatcttttctcctttccttcttcccctatccaaacttttatcaactaaaaccttagttaaattgacactaaagttgaatagtaattagcttaagtgtaaagagaagaggtttattaatccacaggcatctctaatcagggaaatgtttcagggagaagggaggagttggctttgggaaagggttccttgcctgcttcagggatccagacacctcctgcccaaccatcctccaaaacaatggaacaaaataataaaataaatgcagcttggtaaaagatacacagtaggctaactgcctgagatttttctaggcaataagtttaaagatccataaacagcatgattgatgggtacagaaccatgcatcatgagctccttatgatgaaagaaaccgttattgccaaaggaaaacttgacttagcacatgacaaagaattcaaatctactttcttgtctcttacaaaaataataggattataacatcaagaacacttcagttggccaggcgtgatggctcatgcccgtaatcccagcactgtgggaggtcaaggtgggcagatcacctgagttcaggagttcaagaccagcctgtccaacatggtgaaactctatctctactaagaatacaaaaaaaaaaaaaatgagctgggtgtggtggcacacacctgtaatcccagctacttgggaggctgaggcaggagaatcacttgaacctgggaggaggaggttgcagtgaatcaagatcacaccactgcactccagcctggacaacaagaatgaaactccatctcaaaaaaaaaaaaccaaaaaaacacttcggctatagtattataatataccccccttatccacagggaatatgttccaagacacccaaggaatgcctgaaaccacagatagtaccaaacctatatatagtatgtctttgtatctgatcactaagacagctactaagtgactcgggggcaggcagtgtatacgatatgaataggctggacatagggatcattcacgttccaggtgagatggagaaggacgatgcagggtttcatcacactattcagaacagtgtgaaattgaaaacttatgaattattcatttccagaatttttcatttaatgtctttggactactgttgacagtgagtaactgaaaccacagaaagtgaaagtacagataagggaggggtactgtaattccatagtagaaatatgaatttgctcataatttttcctggcttagaatatcagcctaatattgaaacatggcttggaatgttttattaactaatttagtaaaaaaaacaaatcagtataagaaatgctcattgatcttaagcattccataggaggagagtctaatttccttacagattatgcagaccattaaaatatgcaaatgaaacatgagataataagttttattagtttttataggtgtatcacaatagccacatattaaatgtgagaatttgaaatggaagacttgccaactgccaagtcatcctaaatgaaagaggaaacaattagaaacagttgagtttagagatatcagaatgcataggtgacatgtttattatattttaaagcatgtttgaaagagaagagaaaagcactagaaatattgtcaccagtgtgattatcaattgaatgttcttttgttttaatttgggccaatgttttcaataggtgatcaacacaacccaagacccctgttcctgggtggataaactttctacagtacaccaccgcatagtgtaaggagaggttacttctttgctctattactctgtttcatatttggttaaagcagggattaccagcatgaagtaatgttcatctgagttcaagaagaaaattgtaatgcaagctttgacttctatctccatgcggcgaggtttttttgtccccagctgaattttaggggctgcagtcttgcagtgatatctggagtactctatggatctacatttgtgccaatcatctacatcaaggaccacagcaaaagaaatgatagtatatatgcaggggcaagccaatatgatttagactatgtgtttgcgcacttcagtggcatctttcttacaagtactgtctactttctggcctactgcatagccatgaaaaatagtcctaaactatatcctgaagcagtcctaccaggattcctgtcaggagtactttgggctatagctacctgctgttggttcatagcaaatcactctctgagtgctgtggtcagttttccaataatcactgctggtccaggatttatagctgcaatgtggggtatcttcatgtttaaggaaataaagggtctacaaaactacctattaatgatacttgcattttgcatcatcttgactggagccttatgcactgctttttctaaaatctaacaatgacaaaaccagcaggtggcagcagtagttaagagaacgcgtctatcggacagcggagagatcatgctgagaaaagagtgcattttcatatagcaaatggatctcagccactgttggagtgggtaaatgatttttttccccaaaaatgtgagaatgaaggaagattgagtttcattcaagtataaaaatgaaaatttcttctgatgaactgtttatgaaggtagtactttactgggtgactaaaatgtctacattattatagcattacatacgaggatgctctttttaccacagtatgtacctagtgttgcataatctagaacacagtatagagtccatatacaaagaagttacagtccatatttctcacctattaccccagtgaagtgaggcagaaataccttgggcgaggagggagagccttaccttctaatggaattagattccaaagatatttggatcctttgtttcataaagtaaatgcatagttggtaactaaatgttaaaaaggccattttattattgttagccaaaacttctgtttatttcaagttaatatcgcccaactctacatcatctacccattttagctcataatgcttttgattatcgccagataaagtccattctcagagaacaaaaatttttcatcattgagaaaatgtgcataacataatacatacatacacaagtatattcacgtacataaatacacacagatatgttgctaaagtgagattgtaggttatcagtaacaatttaaaggaaacaaccactcttttgaatgtacaacttttttttctgaaatacacttttctaaaaccctcttaactggaggtttcctgttttcttcttgttttaactggtggtttccagtaggcaaaataaaatgacaggcatgctagttttttttttttttttttttttttaagaaaactgaaattaagccaggcagggtggcgcactactataatcccagctgctggggcggctgaagtaggagggtcacttagcccaagagtgcaaatctgccagcctaggcaacatagcaaggtcccatctctaaaaaagaaatttaatttaaatttgtaagaaaaaagaaaactgaaacagaactgccagtacaatgtttgttgcaattgtttccaaaactttgagataacgaaacccctattcaaatgtaaattttacccattcccacctgatagtactgtttattactttgctatgcaggagaaacaaaacagctttttatttgtgtgtatactctgaagtcaatgtgcatgggttaaatcccacctctgcttcattttatttgtgtggctttggacaagttcctaagccctctgtgtcaggcccctcattaacaaaatggagtttatgatggcatctacctcacatggttattgtgtggttgaaattagttcaaatctgtaaagtatgttgatgagtatctggtacttggcaaacactatataattgttagctttattattatgtgttgtttgaaggggaaaaaagtttttgtagattggagaacaccatgtaagagctactaagctcaccaccttcccatccaaacaattattactcctctaaatgaatactacttaaaagtgatggagcttctgtttgtttattgaattgctaatacaaataaatatttgactataacttcttatactcattttaattttaacctgaaatgtcattaaattatgctgataaactttgaataaattgtgatacaaaagcta

SEQ ID NO: 21699 - DNA, 558 bp, Homo sapiens
  ENST00000512272
tagtcctgatgccactttaatactgcagggtatttctgtgacttccgccagtcacagagcttgagataaatggatggtttttgcttgtttgtgatttgccttttgaagcatgtttatgattccatttgtgcgtttgtcagaaatactgctttgagccaagattaatagtgatttatttgttttgtaaggggctgcagtcttgcagtgatatctggagtactctatggatctacatttgtgccaatcatctacatcaaggaccacagcaaaagaaatgatagtatatatgcaggggcaagccaatatgatttagactatgtgtttgcgcacttcagtggcatctttcttacaagtactgtctactttctggcctactgcatagccatgaaaaatagtcctaaactatatcctgaagcagtcctaccaggattcctgtcaggagtactttgggctatagctacctgctgttggttcatagcaaatcactctctgagtgctgtggtcagttttccaataatcactgctggtccaggatttatagctgcaatgtggggtatc

SEQ ID NO: 21700 - DNA, 3296 bp, Homo sapiens
  ENST00000515780
ttgtgcaaaaaccctaggtgtgcggacgaaagagagccaggcagaaggttacaacaggtcaggaataaataaccaccaggcggaggatccaagattctgtccttccttttgttggatgaggagcgccaggcaaacgcgtccacaaaggcttcggaaggaagcggctcgcccgcccacacccggctcctgccccggtggtacaggcatggatgggaagaaatgcagcgtatggatgttcctacctcttgtatttactttgtttacttcagctggattgtggatagtatacttcatagctgtggaagatgacaaaattttaccattaaattcagctgaaaggaaacctggtgtgaagcatgcaccatatataagcattgcaggtgatgatcctcctgcaagctgtgtgtttagtcaagttatgaacatggcagccttcctagcccttgtggtagctgttctgcgcttcatacaactgaaaccgaaggttttaaacccgtggctgaatattagtggattggtggctctgtgtctggcttccttcggaatgaccttacttggtaattttcagctcacaaatgatgaagaaatccataacgtcggaacttccttgacctttggatttggcacattgacctgctggatccaggctgcgctgacactcaaggtcaacatcaagaatgaaggacggagagttggaattccacgggttattctgtcggcatctatcactctctgtgtggtcctctacttcatcctcatggcccaaagcatccacatgtatgcagccagggtccagtggggcctggtcatgtgcttcctgtcttattttggcacctttgccgtggagttccggcattaccgctatgagattgtttgctctgagtaccaggagaatttcctaagcttctcagaaagcctgtcagaagcttctgaatatcagactgaccaggtgtaaaccatcagtttttccttgctggtgaggtgggtgtgacagtgggggaggggccagtaggacacactcacaggacttgacatagaacctcatttcacacacacacacacacacacattcatggccacatttgccaaatgagcttttcagggcgagttatttctttaatgaaaaagcacaagcccttatgtgtcgaaatacacgctgttacactgaaaatatatgcacgacagagcaagaagcttgtgcatgatcacttcttatccgtccccttcccagcactccctcctcttcccattctctccacatgtctcaagcaccctaccgagtagggcaggccaaatgttccttgggagtaatgccaactcccgacgttgccttcaggtccaaagggcttggaaccagctcgtgaggaagttctgaatctggcactaatattcttgagtggataatagtgtatcatagaataggacggaaattgtattgagatgtgaccctgtgtcgcctgtggaaaggcatagtgagaagaactttcccacgaaagcccccttcatcgttgttcagtggtcggctgtgtggatcccaggagagacatatgccacagactgtgagagcaaagcccgccgctgtgatctggacttgatgcactgtgactgagaatgatttccaaatgtgaatatgtgtagggacgtggtctatcaggcctggaacaagatgggggcagtgaaggtatggtttagtgtttgctttcatagtatgccatgtacaatgttttatatttcatagtttcttttaagtaactaccatgagtctctctaagcctcatggacaaagatgtagaccaaatgcaagagctgagcttgctttgggttcaaccatgatcaaagaaaaactgaggtcacctgcaggcttacgtgggaagctaagaaaatatcacagaaaaatggaaagaaatatggatgtgcagaggtaataaaaagagctgctgctggacatttatcaaagataggcaccttacagtatcttgttgcaagtccaaatcaggggagactttgttaatatgtatcttttgctcaaatttagtagggttttttttttttttggattaagggcttttcaaatttggaatttgtagaagccaattaaaagaatacccttcctaaaaaccaaattgacacagctggcccccctgctagccaacccgcagttcccagttcccacctgctgagagttcagaactcagaccgtaggtgtgggcttatgagactgtgcttcatgaagaaaagcagaattccaaattcaaactgttggagtgagccaagtggacagaccctccatgagtgcactttcttccaagaaatccccagatttaccccatagaggtctgggattacctggaatataatatgaaaaacattttttaggctgggtgtggggctcacacctgtaatcccagcactttgggaggctgaggcgggcggatcacctgaggttgggagctcgagaccagcctgaccaatgtgaagaaaccccgtctctactaaaaaaaatacaaaattagcctggtgtggtggcgcatgcctgtaatcccggctactcaggaggcggaggcaggagaatcacttgaacccgggaggcaggttgcggtgagacgagatcacgccattgcactccagcctgggcaaaaagagctaaaaactccatctcaaaaaaaaaagaaaaaaagaaaaacgttttttaattcaacccaaagtctgaatttcttgaggaaaaggtcaatgtcttttcatctctgtattgttccccacctcttaacacagtgcctggcacatactaggtgctcaataaatgtctgttgaatagaattattaataatttaagagtaggaaaaaggagtgtcagagagagactcaaagatgagtgagagagcatggaagatggctgtttcatgtgagacaggaatggaagaagttatgaatagggatcagatgggggagtgagaatccctgtaagtaaaatgtgaggaaaagaacaagctgagaacaagattctcctgtcaaaaaggcgtcttactgtaaatagtccaaggtgacatttgttagttttgaatactgcttttgggtttctttttttcatttttatattttaaaatttttatcaaagaacaaagacttatgtagttttcttttattctacacaatccaaattaaacagcttttggtgatgcaattgtacactttcttaagaatatatctaataccacattttagcagaaccaagcaatgactgacattattcattgggatctggccactaaataaaattcttttatgcataattgtta

SEQ ID NO: 21701 - DNA, 1990 bp, Homo sapiens
  ENST00000449862
aaaggcttcggaaggaagcggctcgcccgcccacacccggctcctgccccgggtgactattaggggccccgggggggtggcagaagcccgagacccaggggatcaactctccccgaaggcctagcagcggggaccccagaataagtcgggggcgggccccggcgcggcaggagggggccgggcgggcgggtgagcagatcccaccccttcctgaaggaagcgccctacccgccgctactgctgccgccgccgccaccgcagcaggtcacagcccctcgaggcgacagcggccccgccgcaccagagcagtggtacaggcatggatgggaagaaatgcagcgtatggatgttcctacctcttgtatttactttgtttacttcagctggattgtggatagtatacttcatagctgtggaagatgacaaaattttaccattaaattcagctgaaaggaaacctggtgtgaagcatgcaccatatataagcattgcaggtgatgatcctcctgcaagctgtgtgtttagtcaagttatgaacatggcagccttcctagcccttgtggtagctgttctgcgcttcatacaactgaaaccgaaggttttaaacccgtggctgaatattagtggattggtggctctgtgtctggcttccttcggaatgaccttacttggtaattttcagctcacaaatgatgaagaaatccataacgtcggaacttccttgacctttggatttggcacattgacctgctggatccaggctgcgctgacactcaaggtcaacatcaagaatgaaggacggagagttggaattccacgggttattctgtcggcatctatcactctctgtgtggtcctctacttcatcctcatggcccaaagcatccacatgtatgcagccagggtccagtggggcctggtcatgtgcttcctgtcttattttggcacctttgccgtggagttccggcattaccgctatgagattgtttgctctgagtaccaggagaatttcctaagcttctcagaaagcctgtcagaagcttctgaatatcagactgaccaggtgtaaaccatcagtttttccttgctggtgaggtgggtgtgacagtgggggaggggccagtaggacacactcacaggacttgacatagaacctcatttcacacacacacacacacacacattcatggccacatttgccaaatgagcttttcagggcgagttatttctttaatgaaaaagcacaagcccttatgtgtcgaaatacacgctgttacactgaaaatatatgcacgacagagcaagaagcttgtgcatgatcacttcttatccgtccccttcccagcactccctcctcttcccattctctccacatgtctcaagcaccctaccgagtagggcaggccaaatgttccttgggagtaatgccaactcccgacgttgccttcaggtccaaagggcttggaaccagctcgtgaggaagttctgaatctggcactaatattcttgagtggataatagtgtatcatagaataggacggaaattgtattgagatgtgaccctgtgtcgcctgtggaaaggcatagtgagaagaactttcccacgaaagcccccttcatcgttgttcagtggtcggctgtgtggatcccaggagagacatatgccacagactgtgagagcaaagcccgccgctgtgatctggacttgatgcactgtgactgagaatgatttccaaatgtgaatatgtgtagggacgtggtctatcaggcctggaacaagatgggggcagtgaaggtatggtttagtgtttgctttcatagtatgccatgtacaatgttttatatttcatagtttcttttaagtaactaccatgagtctctctaagcctcatggacaaagatgtagaccaaatgcaagagctgagcttgctttgggttcaaccatgatcaaagaaaaactgaggtcacctgcaggcttacgtgggaagct

SEQ ID NO: 21702 - DNA, 566 bp, Homo sapiens
  ENST00000508701
agcaggtcacagcccctcgaggcgacagcggccccgccgcaccagagcagtggtacaggcatggatgggaagaaatgcagcgtatggatgttcctacctcttgtatttactttgtttacttcagctggattgtggatagtatacttcatagctgtggaagatgacaaaattttaccattaaattcagctgaaaggaaacctggtgtgaagcatgcaccatatataagcattgcaggtgatgatcctcctgcaagctgtgtgtttagtcaagttatgaacatggcagccttcctagcccttgtggtagctgttctgcgcttcatacaactgaaaccgaaggttttaaacccgtggctgaatattagtggattggtggctctgtgtctggcttccttcggaatgaccttacttgctcacaaatgatgaagaaatccataacgtcggaacttccttgacctttggatttggcacattgacctgctggatccaggctgcgctgacactcaaggtcaacatcaagaatgaaggacggagagttggaattccacgggttattctgtcggcat

SEQ ID NO: 21703 - DNA, 403 bp, Homo sapiens
  ENST00000454948
actgctgccgccgccgccaccgcagcaggtcacagcccctcgaggcgacagcggccccgccgcaccagagcagagtctcactctgtcacccaggctggagtgaagtggagcgatctcggctcactgcaacctccgcctcctgggctcaagcgattctcctgccttagcctcctgcatagctgggactacagtggtacaggcatggatgggaagaaatgcagcgtatggatgttcctacctcttgtatttactttgtttacttcagctggattgtggatagtatacttcatagctgtggaagatgacaaaattttaccattaaattcagctgaaaggaaacctggtgtgaagcatgcaccatatataagcattgcaggtgatgatcctcctgcaagctgtgtgt

SEQ ID NO: 21704 - DNA, 1892 bp, Homo sapiens
  ENST00000281924
gcacttctgactcgagtccccgccgcgcttgtcgtcgccgccgccgggatccgcagccccgcgccatggagccggccgcgggcatccagcgccgcagctcccaggggcccaccgtcccgccgccgccccggggccacgcgccaccggctgccgcccccggcccggccccgctgagctccccggtgcgcgagccgccccagctggaggaggagcggcaggtgcggatcagcgagagcggccagttcagcgacgggctggaggaccgaggcttactagaaagcagcacccgcctgaaacctcacgaagcccagaactacaggaagaaggcattgtgggtgtcctggttctccatcattgtcaccctggccctcgcggtggctgcctttactgtctccgttatgaggtacagcgcctctgcttttgggtttgcatttgatgccatcctggacgtcctgtcatcggcgattgtcctgtggcgttacagcaacgcggccgctgtgcactctgcccatagggagtacatagcctgtgtcatcttgggggtgatattccttctgtcatccatatgtatagtggtcaaagccatccatgacctctcaactaggctgctcccagaagtggacgatttcctgttcagtgtctccattttaagtgggattctttgcagcatcctggccgtgttgaagttcatgctggggaaggttctgaccagtagagcactcataacagatgggtttaactccctcgtgggtggcgtgatgggcttctccattcttctgagcgcggaagtgttcaagcatgactcggcggtctggtacctggacggcagcataggcgttctgatcggcctcaccatatttgcctatggggtcaaactcctcatcgacatggtgccgagggtgaggcagacacgtcactacgagatgtttgagtgaagggggccagcatccgcatgagaccatcgagatgaggagtttccacataggcaaagggtgccaatatttaactgaacatctggtttctttttggaagttttctttcacatggtttgtcattacaagacaaggtctgcccagccaggtggatctaccttgcccccatcacctgccgcccccatcaaacatgttgggacaatgcccataggaatggacctccttccccgtctccagctgggactggcgttttttagtctctggagtatgatggttctcatgggtaggatgagatctttggcagaaaggtcttcggtggtgctctgagcctgcgctgcataggactgagcagacccacctcctccagcttgggtggccctgccactcctggttccaagtctctcctttcctggcaggtcttaagggaagattgtacccctcaccctttacatacccagaatcatcagtatgtcacttcctaatttctatcagtgtatctcattatttcatactgttttactaatcctaagtctaaacagatttgctcaaaaggagaccattctattttttaaagtacttagtgatacacgtataagctttgcatggacgaattaaataagcacattgaccttttcttgtacattcagaacctgaacatccatgtgaaaactgggtccatttttgagagatgtgaaactacagtttatttgtaataaataaatataatctatccgtatatgcatatatctatatgctgtgttaagtggtaatgggtacattacagtctgtgagagatggatcgctccctctgtaaggaacaagacgttctcagctgatgtcacggtaggtttagattctgtagagtgttccccaacccgcaccgttctgtacctctcacaccactgcttgcccgggcagtagtggctgaccaataaagacctttacctgttttgtatggca

SEQ ID NO: 21705 - DNA, 2260 bp, Homo sapiens
  ENST00000467316
tcatcttccattcctgtgagcggccattgcatccctgccttggatcctgagtagatttgctcaggtcatccctgcctggcaatcttcctctgccccaggggaagccaggcctggcgtgggaggttacgggcctgcacaaacctaccagcagggcctccttgggcagcgtggacctggagcttctcttggggccaccagtgtgttggggcaggggaggagctggtgtccttcgcggggagaccctagaagctaccttaagccattcccttcccttcccatgtggcctttgacagctctggtaaagtagaagtatcacatgtaagctgggagccccagtgggctgctgtgtgaaaggagatggcagtcactatctagtagctccagttctgtttttatggccatttctccaaccatgtagccaatactttgcaaaaaacttagcataatagactttacatttctcttctggagggaaaggaaaaaacctcaggttacttagaggagactcgggagggaaaggatgcaggttgggatagaatgcccttctcaatctggataacctccatcaatgtatttaacctcattcttagttttctcatcggaaagcagggatgatgatgataatgtgacgtcacacgattgagaaaggttataggtaaccacacgtcctgaacacccaactcggaatctggcccagcagacactcagatatgagtccccaagtatttgaatgtctactgtgagcctggaactgtcctggggactgtggactcaacagaaaaccacacccctgcctctaggaggtttgcgttctagcgggcacgggcgagaccagctataaaccacatatggcgtcagttcccagaagagaaataaagcaggtacagaatgatggtgggggtgacggctctattctgggaggtatctggtgacatttgagcagagacttgatgggcccaggtggtggctatcactcgtgagagctttgggcatcattcctcccagcacatgctccagttacgtggaggcaggactggcatttgggtgattttcttggattgcttggcactgccatctagcctctctccacttcctttgcagggtttaactccctcgtgggtggcgtgatgggcttctccattcttctgagcgcggaagtgttcaagcatgactcggcggtctggtacctggacggcagcataggcgttctgatcggcctcaccatatttgcctatggggtcaaactcctcatcgacatggtgccgagggtgaggcagacacgtcactacgagatgtttgagtgaagggggccagcatccgcatgagaccatcgagatgaggagtttccacataggcaaagggtgccaatatttaactgaacatctggtttctttttggaagttttctttcacatggtttgtcattacaagacaaggtctgcccagccaggtggatctaccttgcccccatcacctgccgcccccatcaaacatgttgggacaatgcccataggaatggacctccttccccgtctccagctgggactggcgttttttagtctctggagtatgatggttctcatgggtaggatgagatctttggcagaaaggtcttcggtggtgctctgagcctgcgctgcataggactgagcagacccacctcctccagcttgggtggccctgccactcctggttccaagtctctcctttcctggcaggtcttaagggaagattgtacccctcaccctttacatacccagaatcatcagtatgtcacttcctaatttctatcagtgtatctcattatttcatactgttttactaatcctaagtctaaacagatttgctcaaaaggagaccattctattttttaaagtacttagtgatacacgtataagctttgcatggacgaattaaataagcacattgaccttttcttgtacattcagaacctgaacatccatgtgaaaactgggtccatttttgagagatgtgaaactacagtttatttgtaataaataaatataatctatccgtatatgcatatatctatatgctgtgttaagtggtaatgggtacattacagtctgtgagagatggatcgctccctctgtaaggaacaagacgttctcagctgatgtcacggtaggtttagattctgtagagtgttccccaacccgcaccgttctgtacctctcacaccactgcttgcccgggcagtagtggctgaccaataaagacctttacctgttttgtatggc

SEQ ID NO: 21706 - DNA, 5078 bp, Homo sapiens
  ENST00000476823
aacccctctaagtgatgcagaataggggtttgtggcaggggtgcgactttccacatggtggttgctggtgccgacgtcctggtaaagcggttgcctctgagtgtggtgttggtctgaagtcagcagccgtgcagtcaggaaagaaggctgggcaaagagaaaggcgcaaggacaaactggcgcccatgaagatggcctggacctgtacgtgaccctcactgtctcagcctccatgacattgggcatcctgcagaagaagctggcgcctttgccacagagctatatgcacgcctggcttatgactcagcgaagctggagcggggagatgcagcaggagcggagaatccatgggctcggtgcggcccctctctcccctgggcgagcccgtggagccacagaatgcagaatgtgcctggctgagctgcggcagcaccggagccgcttcacctccacctttcactcatgcagatgtctctgggagtcagcttcaactgggaaccacgtaggaaggaaattctgggcaacgtagttccagttgagctctgtgcacgcagtatatgcagccaccgtgagggagtctgttatttttttccactttataggtaggacagtggagggagggaggggttaagtgacctgcccagagtcacctagctagtaagtgggactcccgcttcagtgcttttgaagctgccacccagtgcttctactttttcgctccaggaagcccacccgagtcctccaggagctggacctcggggccctccggtccatcgagagctcccccgagatgaagcctcccaggtacaggaaacttcccgcacagcccctggataggccgcggtggagctcagtcctggtctcttggaagttgaagtttctttatgtttcaccatgcatacttatttctcggtgacaagcttcctgtgtctctcttacgagaatgctgaccaggcttgtctggggctcaccgtgagcacccgatgcggctggcaggtggaggacgtttgtgtgtggatcatgtgtttgggccccttcacaacaactcgtaccttttactgccagctgctgccaggggctgtaggcatcccactgccgcttacagagatccaagtgtttgtttcccagtaagccatggagtttagagttgagcaaaggcctgcctggcacacgactgccactgggtcggccgagccctgggtctgcagctccctttaggagctggaggaagggccaccaaagccatgggtggcgtttcttgagctgcatctcagggtggggcagcacaccccaggccctgtgccctaggggcctagatggggtaagcacagattttctctaccgctggaaacttagggaggagggctttgcaaacagcgactgaatggagccaaaggggattcaggcatcatgggataagcaaagtgagtattcagtctccaaatctgagacctcaaagttcttgaatttcctgactgcctcagtctcccagcctatgcttcctgagtcctgttagcacctggggctgttgacatgcaattctttggtcatgtgtcttagtcagttctagctgttataacaaaacaccacagactgggtggcttataaaccacagacacttccatctcacagttctggaggctgggagtccaagacaaggtgccagcagattcagtgcctggtggggccccttttcctggttcatgagatggtggcttcttcctgtgtcctcacatgcggagggggcaagctggcactatgggacctcttttataagggcactcattccattagtgagggctctgtccttgcagcctaatcacctcccagaggccccacctcctcataccgtcaccctggcaattaggtttccatgtgtgaattttggagggacacatactcagattgtagcatcatgttcaccttattttctgtgggtgctgtctcctggacttaggctgagtcctgcacaaagagagcttccatgtggggctcctgaccccctcccactgtgtcccctgctgtgtaacctctgcataggagggactgaagagttgtcaagaggcctggtttgggacggtccttactggtcatttgaggaggtaaaacttccgtgaggtgattactttaaataagcttttaaatgtgaaataattttagattaatagaagagttttacagatagtacagagagtgcccatatcccctccatccagcctgacctactgttaacatcgcacacagccacggcaaattaatctctaccatgagatgacagcactattcacgaaaccctagactttcttctcatgtccccggttttcccactgatgacctttttgtgttccaggatccagtctggatgccatgctgcatttacttgtcacatctccttaagtctccagtgtgtgacagtctctcggtcgttcctcatgtttcatgaccttgacacgtgaggagtcgggtattttgtagacggtccctccgtttgggtttgtttgatgttgtttcgcagttaaaatgaggttatggatttggggatggaacaccgtggaggtaaagtgcccttcttgtcacatcgtatcaggggccacatgttaccaacacaacttaataatggtgatgtgaaccttgatcacttggctaaggtggtgtctgcttggtttctccattggtaagctactgtttttccctttctctactctgtgttagatttgagtctgttaagtccagcccaaactcaagggcaggggatggggtggggagattaatctccaactcttggaggatggagtagcaaagaatttgtgaacataggttgccaaaaccaccaccgtcattgacccatgttttcggagagatgctttgaccctatacagataccctgtttccagtgaagttgcttttcaaatggctttgttcagttttgaacatgatgcaggctgtctccctcttcccaggttctgacatgaggtttgtgaatttgattaataaaatgcatagggagaagccgatttctttgcctatttatgatgctgcatcagagttctgctggccgttgcattttaatattgggaaatctgaaggctgtgtctcttgggggtgacacatgggagcttgaagcagaagagctggatgggccccaatgtcaggagaatagtggtgcttacttattgcatatgggactcacttgtttgcttgcgaaggtaaggtaacaacttagaggaagtgttaagataacgtcagtagcagacgatatttttagatgctattttctctacccatgtctatgaactctcaattgccctgtgtgaatttaaggggaaaaaatatggttttaagtagctctggccctaactgaccctgtggcaaattcagttggctctgttgaaggattgttaggctggtggtgtgtttacgtgttccaaaattctcagtcaactgcttggtgagttatctgtggaaaattctatatagaagatgctgttcttagcattctgaccaactctgttattgatctatgactgctactcattttagcagaatagtggggaggtcaatctcctacaggaaaataaatacgtaatggttttttaagtaaatataaattgggattatctgtttttgagcatcttttccaattcctggtgacacataactgaggtgtgaaagcatgcagtatacccccacctggtggcagcacacctgactatttgtacttggaacaaggctgatctgtaaggcaagtgggttgcagatgatctgctccagcaggaggtgaactgttgaaatctggaactttctcttgcaggacgatttcctgttcagtgtctccattttaagtgggattctttgcagcatcctggccgtgttgaagttcatgctggggaaggttctgaccagtagagcactcataacagatgggtttaactccctcgtgggtggcgtgatgggcttctccattcttctgagcgcggaagtgttcaagcatgactcggcggtctggtacctggacggcagcataggcgttctgatcggcctcaccatatttgcctatggggtcaaactcctcatcgacatggtgccgagggtgaggcagacacgtcactacgagatgtttgagtgaagggggccagcatccgcatgagaccatcgagatgaggagtttccacataggcaaagggtgccaatatttaactgaacatctggtttctttttggaagttttctttcacatggtttgtcattacaagacaaggtctgcccagccaggtggatctaccttgcccccatcacctgccgcccccatcaaacatgttgggacaatgcccataggaatggacctccttccccgtctccagctgggactggcgttttttagtctctggagtatgatggttctcatgggtaggatgagatctttggcagaaaggtcttcggtggtgctctgagcctgcgctgcataggactgagcagacccacctcctccagcttgggtggccctgccactcctggttccaagtctctcctttcctggcaggtcttaagggaagattgtacccctcaccctttacatacccagaatcatcagtatgtcacttcctaatttctatcagtgtatctcattatttcatactgttttactaatcctaagtctaaacagatttgctcaaaaggagaccattctattttttaaagtacttagtgatacacgtataagctttgcatggacgaattaaataagcacattgaccttttcttgtacattcagaacctgaacatccatgtgaaaactgggtccatttttgagagatgtgaaactacagtttatttgtaataaataaatataatctatccgtatatgcatatatctatatgctgtgttaagtggtaatgggtacattacagtctgtgagagatggatcgctccctctgtaaggaacaagacgttctcagctgatgtcacggtaggtttagattctgtagagtgttccccaacccgcaccgttctgtacctctcacaccactgcttgcccgggcagtagtggctgaccaataaagacctttacctgttttgta

SEQ ID NO: 21707 - DNA, 525 bp, Homo sapiens
  ENST00000507319
acttcctggctgcgcgcgcaggcgcggaggtctgacggagacagcgcgtgcgcggcgtcgccgggcttgcgatgaacttccggctgtcaagctcccggccgggctgactcaagcggaggcgcgcggaacagtcgccgaggcgattcccgcccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatgatcctgcctgtgacccacacggagatctccccagaacagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctgg
